United States Patent 7,868,149 (PLANT GENOME SEQUENCE AND USES THEREOF) - sequence listing, part 97

SEQ ID NO: 51151 - DNA, 10788 bp, Oryza sativa
catagccatgcctctctctctttttttttcctttgaaagaactttggaggaagaggcataaatgacatggagtatgtattttgtggactatggatgaaatgaatgacaaatgaggaatgctaacttccagtgtagaagtaaagcattagtgggtgtatgtggaatgtgtgtgatcttgaccatgaaagtatgaaaagcatttcactagggtcacaaaacttgacaacgctcaatgtgatgacaagtagcgtatgtagcaagctaatcatgaatgatcaacctatggctttagtgggaatgaaaatatcaatgaggagtttagcatcgttatatatattttttctttttataaaattaccaagtgtgcaacatgaagagcaggatttctatcatcagactataactcattcatcaattacctagatagcatggggtccctattggatatatcaccacaagtaacaagtaatgagcaaagaataataggcatgcatgtcattttcagggagaccatagactctaattgtaccatccctagcttgggttcaattatcttcgatattttagaattgatagtcaaattaaactcaagatagaatggatgtccaaagtaaaaattgtgcaaacctacgctctgtataaaacagaggacgattcatggtagaggtggttcagtcaaactggaggttcgactgacccctcattgggtctggctgcatcaattttcctcgtgtggttcgtcatggctcatcacttctgggtgatcttactttggttatggcgttgatgtgcaagatcacccccacacttgtctttgtatctgggaggctttattggacacaaaaagaaaaataaagacaaaagtgaagcaaaaagaactcacttggttggaagaccaaggagccaactttattttattttattttattttattgaatctttttttctttttattttatggcaacaatggatatggtgggtatcctggcagaatggagaaatgagatgaggatgcacatggtgtatgagattcttaccagatagatcttaccaggcttagaactggatcgaatgtaacaaagttttgcatttgttctgcttgattccttgtgcatctctttcccatggaccaaggagcatgatataagtgtttgaagttattgtacactgctccttgattgtctttttatttcctgcaaaaggttagtggacaacaaatacccaagggactataaagatttgaaaagattttatcgtagccttgaaattagttgttcacatccacgccaaaatgaaattggattcaaaacatgagaagcgtggatcccataagtttgctaatattttattttatttttcgagagacagtccttttattctgaaacattttttttcaaatttttattattcaccagattttcgtttaagcacaacttatacagtgatgaggtaaatttgcatgaacatgctaaaggagcaattagtaatatacgcaccgtgcaccttcataggtgatatgtttctccttttcatgttagcaattgatttgttcctggccctggcctacctccattgtgaattgaacttgaggactcacccgtcaatttgaaaattttcctgcaggggttagtccacataagatatatatccaatgtctatgaacatattaactctgaaattcattaatcaaactaaactccatgtccaatttgattaaaatagactattttaacctaagcaccatgcttaatttaaaaagcctatagatgtcttgcgcgaacacccaaaacaaagcatatgcaaatagacacaagaaacataaccatgtaagatcaagtctcattcaaatgaaaataagtatgagtaaaaggaatggtgaaccttgttttatctttcgcatacctgagtgtacttaccgccagcatgatgtatattttgaaatctctggggcagtggtatggtcacatatggttgtcgatttctcctccatctttatgcagattgtaccggaggaaggcgctttgaccatgctaactcaggcaagcaagttggtcatgcacacacctcaggtgcaagatccttgtgccttgaaggcgtgatccgttggcacaatacgtaggatgcatctcttttcgagcaaatgtgcaagtgtcaactggagtggagtagccaacacttagaaatgaagagggcaactcctcttgcttgtatgcgcgtaggtgctacgggagcgataagttgtgcacagctagaagtagataaaggctgagccaaggcggcacatgagctcgagagaggcactaggtgttgccgggcagcatgattgctactagcgaggtgtatagccacatttcaaagacacgcacataatgcagtctttgatctaaatatagctcgtcagctctcttgctcttttcttcttctcccatttttttctccttttcttctatctctcttttctcctcttttttatcttcttttttttcttttttcagcaagctaggactaacaccaacttcaacccaagatggccttggttgatggaactcatcatgaaaagctcgtcgaccttccccccacacttggacttttgtgtcgcaagacatcaaaaaccaagtgtgtgatgtcggattctcctatagagtgtgttccaataccaaggatcaccaaagtgtacagttgatgtagctagtgttcttagacatcgcatgaccctcgttcttaatctcaacctgcaatggttagtgaccaagaatacccgaaggtgcatattatcctaaaaaccggttcttgcttttattggaaagaaagtgtaacgctccgcttttcatgagacgttaaaaactaattcggcaaaatcttatatgcgaaaatttcgttctttgtgtgcgagtctaagttgtgccatggatctcaattcaatctcccgttgttccatctcgttgatatcaaaatcccccacctcaagatttcaattccgattcaagtctccgaaacttaattgtctccattgaatcctcgccaaatacttgtcccgattccaaaattatccgagtccactttgaatccattccttgactcctccctgttttcctaagaccaagtatcaagttcgaaacccaaattcaaattccaaatctcctttccctccaaaccgatttcctggacaagagtctactttgcctccctcaaatccttgtggaccgattctctctcggcctatcttctcccccggtcgtttctctcctcacgtgtgtcgcccgtgcgctgagcgagagacgctccctccgtttcctttctctctctcctctcgccgcgctatgcgccgtcgccgtgattcgattttcgccaccgcctttgaaatcccgccgccaccatccaaacctccgccgctgttcgattttggcccgtgaccgcgcgtcgtggtggccgactggccggtcgccgccaccgtcagccctgtcgctcctgcgccgcgcagccgcctggccccgctgccctgccgcgctgcgccacgcagccgctcggccccgcgcgcgtgcccaagccgctccacgcgcgtcctgccaaaaccatgaggtcgagctcccactcccatccctctccctccccaaatcggcaaagaagcgagctccttttcccccttctttttctctttttcccaacctcagccaccgcacctcctctgccgccgcttggccgcttggaccgatgccagccgagctagcgcgactgccagctcactccccttgaccgccccaatgtcggttccttcccctcgaagccccatccgcctataaaacccaagccgagctcctcctcctctctatccctctcgttttcgcctgccgcgcattgtcgccctgctctgcttgcaccgtcgtcgttcgtcgtcaagcaccggggaggccggtgcgtgcgtggacgtgcgacgaggagctccgggcacctcttcttccccttccccagccgctcctagagagcttgctcccgcgccgccgccgctcgtcacggcgccctgtcccgacgcggtgaagcatctaggcccccgttattaattttggtaattaatgacaagcactaattgtggactaactattgtctttgagctatatattttaagttaggaccaagtcatatgtgcgcatggatgattatcgatggattaaaattgacggcgcaaagcaaagagaaagaagacggtaaaactagtgctttaatttagaactgatcgaggtgtagggcgatcaaatttgctagtttatttgttagtttcaccgtactatcaaggggggtaatgacctagcaaagagatgattaaattgccacattaggtcattgcattttcactttgctctctttttcatcacacacacacacaatcatttgcccttttactgggctcggcctgaccaggggtggtcagaccggccacattgtggcggtctgaccggcgcggcatggccagtctgaccggcgccacaactgcggtctgaccggcgcataaggccggtctgaccggcggcacatgcgcagtcagaccggccccctaaaggccgggatggtgctgctcggggtggccgatacagagccgatggagccgtattcggtcagaccgagccgaggccggtctaaccacccactcaacaccggtctgacaggccaagccgatggggccctctgacagcgctacaatggctagttttctagccgttgtagagtagcacggtctgaccggccgcatacctccggtcagaccggcagagcacaaagtttggggatttcgcccccaacggctagttttggttggtgggagtataaatactccccctccagcagcaagggagctctcttggcacccaattcaattgcatacaccccttgcacctctctcacacccacttgagctttgtgttcatccatttagtgtgttagaggtttgatctagccaagagtcaagtgcattgcttccattgtagagctagtgtggcacttgattgatcatctccacgccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactaccctagtgatcgaggcttgggtagtcctctccgtgggccggctcccgccttgcccaccccttgacgaagggggcatgcggtggcttcgtggttgagcggtagagttgggctcgcctcaacgaggagtaggaaaccggcgagtttccgaacctcggtgcaaaatctcttgtctccttgtctcatttgattgtcgtatttatatttgtgcaatttacatttctagagacaaacttgagatcatatcaccctaggattgctaaacattgacataggagtgtgatttactttcctagagatataattgagccactatcaccctaggtttgaaaaacataacttagttgcttagttagagttgaccctcaccaagcctagcaatttaggttagttttgattaggtgtcatttagttttaaatcgcctattcacaccccctctagtcgacatctcgatcctacatgcggtagccctccgttcctcttcctcgcttgctctccccctcctttaactcgcttggtagctcggttagccttccggtggttcttaggcgccgccccaagccccgccgccgctcgccatagccttgctgccatcggcgctcgctcccggaggccgcctctcgtcgccggacctccacggcacctccccatcccatccgacgctagaaacgggtcccctgagtcctagagatgctcccactccgccgaatcgaactcccattgctccggtggattttccccttttgctcgccgccagccgccgccatcgcaatccatcgccattgacctctcccaaagaaatccgagccgttggctcactctctcttgtcttcctcgtcattccggtgtgctccctgttgcctctcaccgtcgcaaggtgtcccggtgaaaccgccgccgtccgccgtctatctcggcatcccccttcttcctccgccagccggcccgcgtggctgccacgaaggcaccacgtcggcgccagctcgaccggaccgagtcaagctgaccccggtcagccgctccctccgtctcccgctcgcgcgtgcggtccaccgcgagccgtgaggctgcgcgtgggcccgacgcgtctcggtccatccagcgcaccgcccgtgcgccatccccaccgaaccctagcgccgccctcgcgtgcgcccatcaaaccgtgggccgtgtcaccgacaagcgggccccacctgggaccccgctcggtgcactcggtccaccggacccccccccccctctcccgtgccctaatgggccgacccccgcgctcgccaggcccaaaaaggctcggccgagccgcgcaagccatcgggccgcgccctaagccgcccaaggaagtctgattcacgtctctcctttatttcttttcagaaggatttaataaatcctttttcctttagacagaaaatcctttaatcttccaaaaatcatatcttccaatccgtagctccgattgactccgttccacttccaataattccgtaaaattcagatctatttaatggcactaattattagtctaaataggatctttatttggtcttttgtttaggtttttattgtttgcgtttagtcgcggttgccggattatcatcagtcttgggcctctcaaagattcgtgaagcttcgtgaagaccttgagcaacgcaagtcaccctttgatcaattgctcctataattggaaaatcattattattttgtttgcaatttgcattattagaatcacacacttaacatgcttggcctcggtttgtgtgccaaaccgacggacctacctagtagttgcacaaattcatgtaggctgtactaccctgattccttgtcgctccacccttgtggtacttcagtatccgtgctctctgagcgtgtataccaaatatcccacatacaccgttgtttgtcgaaaacttgggaaatgggtttgtgaagccttgaaaacccgacatgtggtgtcggtgtgtttgaaaataaaatgaattgtgaaaactcacgatgtgggagccgtgtctacgtggcgctgtcccgtattcgcatataaggaccgattcctatgggaaactcatcgagcataatcacagtgcaaccacaaggtggaatgggacaccctggctaagtaactagtcggttcagggaaacctcgcatgccaatagttgggaacaccggggcagggtcggttggagccaaactgggttcctggtaagcaagaaagagaagcttgcagaattaccgatcgaggtggttggagtttgatttgtgaaaactaaaatggcctatatttatgtgaggatttgattcttctatgtggcatgaggtgaccctaagtcggcttgagaaaggctttgtcacaaacctctcacaccggccagtgtctagagtaagttcgtgtcttgtgggtaaagtgtacccctctgcagaggttaactaactgttcgaacagccgtgcccacggtcatgggcggatgtgaggtggttcccgttgcgtagatttgattgcctgtgctttgcgaaaagttgttgtggaatgggaatcgtaaccagaatcaacctatgtggcagatggatgacctgagtggtcagaaacgaatctgtgtgattcgggatgtctgtgggcatcatagactaggcttcccgagtggaagcggattgcttgctgcttggcagctggactctgggagtccgcaaaaatgaaaaaggctctgggagccacctaatcaagtgaaatggctctgggagccgataagtaatgatctaacccgggaggtcggtacattaccatttgagttgttgaaaagcatctcttaaagtcgaatcgagactcaagtctcttttcggcccgaacttagaaagaaataaataacttagtgatttcataatgatttcagacaaaagatttgcaaaacaatcttgccactcttccaagcttgcattaaacacctaaatttccgtgacttgctgagtacggaagtactcacccttgctctatataaatatatatagttcctccgccctgaagttgaagtgaagtgaagattagggtttcgtcctggttcccagccgtcgcctgtggtgttgggtgttagaccattggttcctctgctgctgctattgttggtgtttcctcgtccgggtcgtcagttgcattatcaggctgttttgagctgcaacctatgttaaggtaaataagtcctctatttattttaaggattgcaatgattcatatttgtcaccgtgggtaccagcgctatgtcctgggactggtactgagatcgcggtttcgtaggaagcggttcgcgccgtttttcctacgacacgctccagtcaggtgctgttgtacggcggtgccggattggggtgtgacagaaagcttaccatgataatccggggtatctcctagcagtgctttgtttattgtcacaagctcgaccttagggacattgctctgcaagattagtgccacaaacaaatacgagatttgcagtatttatgataaatataagcgtctacaacaacacctctatacatgttagaaatgatgaccgaaaggtggttgtggtcctcacatagggaagtggtactaatcgaacaggactctgggtatttcttatgtgagcatgaatcctggggaattttgaaggaaaaactttcatgctcatttgcggaatgctttctctcgtcctccagagtcgatgtctcaagcttgtccgtagcctgaaggttttccttctcaagagatacatcatgcaagaatcgggttgtttcttgatgataaacaaaaacaacgttctgaggaccagagggacaaggcttaggcttgatcgagggtgatgagggtcgttcagtttcatgatgatgggaaataggttcagaagaaacgaacgaagatacaaaaatcacctcctcgaacggttcatgcttgggatgagccttcgttttgctgaaatgattcagggtgtttccataatcttcataaagatcatccctgaattggaatggaatttccgaaggatgaatttcttcttcttcaggcttcagcaattggaatgaggattcggcagttgagtcgggttccaactccacgtgcagaggttcctcatggataatctcgatctctgggatggcttcgctttggccgaaagaatcattctctaagatcagatctaagagttctcttccttcgacggttgtcttgtgtgcgaacgatcctccggcggaaatatcaagattttcagcaaactccttgtctaacccataccgaaaatgtcgtaacaacacatggtcgggtaaagacaagtctgggccagactgagttaacaatgagaatctggcccaggctgcaccgagagattccttctcattctatcggaaagagaggatgtctaatcaaagattaattacacgggttaatggaaagaaagcaaggcagaatttgcacttgagctcctcccattcaccgtggaatttcttgacagacatagtgtaccattgcttcgctccatctctaagagaaaaaggaaacaacttccactttatagtttcatgtgtcatgcctacgatggataaacatgaacacactagctcaaagtcccgaagatggcggtatggattttcaccaataccaccagagaaggtttgctctcgaatcatggctataaagccaggaccgatttcgtagccatcggaaaggattggttgtgaagaacaggatggctcacaaagatcagcccgagaagcagaaaggttttgaattgtgggttcctccatcaaggaaaggaataaaagaagaagaaataaaaataaagatacgaggatgacctagactcggataaattagcaaccgttccccagcaacggtgccagaaatgcttgttagtatttcttacgaccatagataaatccgcaagcgcacggaataccgctgtagcactttaccttcgggtgaccccaaaaggatatcaaactcagggaacgtgtgtaatctacctaaggctaagactatccaaggacaacaactgatcataggtaggctaggctagagaggactttctatgtgttttaattatctactctaagtaaggtaattccctatctgttgcttcgggcaccgacccctgctggtctgccagcgtggttccggctatagctctatgatgtatccgaacatggaggattactaggacgggattcagggctgtcaccacttgccgcctacctctgacaaatccggtggatacacaacaaacaagggtatcctctaacctagacaccatgtctaagttattaattactactctaatacttgtacaggaacttccttctttatccagagtcctagtactagagcacttagtataaatactaaacaatgaacccgcaaagatggaaatatatcttacttaaacaaagtaattaaataacataagaaataaacacgaatgcttactttatagaagaagttctccgaacccggagcagagtgtaccgacagctctggtactcctctcaaattcctcctaggaagctacactcgtcagggagaagtcggatgagcgccaaacttccgggcactcctccagagcttcccctcactctctaccttattctaatatagggctgcagg

SEQ ID NO: 51152 - DNA, 2403 bp, Oryza sativa
tattatatatttgaacaaacgttgctacacaatgagtttcatgtgtttttgtttgcagaggtacttgcttgggcgaaagaaaagagaccgagtgtaaggaatacatggataattgaagaagttgattgggaccaaaccaataccttctccaagtcttcttttatctcaccacgtcacttttggtccatagaagacaagagataaagttctacacgttttggattcggattcgggcctcctgacagcatcaacttcaaatggacctagccgctgatctagaaggaatttcagggcccatgagtacttgttggaaagcttatggagtctactttcaaatggttttggtcccatgtcaaaattcctaccgagctgccgggaatctgcaaaacaagccacgtacctcatccagtccgaatgtgatttgggttttgggccttgtaattgtgtcatgggcttagcccatgggggtgtgcgccctagggcaaccctaggacgtccctaattatacttaatccgttgccgtcatcgtttagagttgggttttgcttagattattctattaaggacagtttcaccgctagatcggtttgtggaaccccaaattcgtgtactaaatcattcatatgcaatttggttgcaatctatgttgttcttgcttgtgttattcgattcgcatgcagggattagccttctcggcgaggtcaaccgggtttcggcacgtttgataaccagaggagacgtggtgctacgattgcggggctcagtagcatgtttgttcagaagccggatcgagttgtgtcacgactccgtccaaatcgactgtttatcattacctattggaagatcgggacctaactccctcattaacgggcttgcctacgcatgcgcttgccttctccttctcatggtcacgccggttcctccatgcccgcgccatcatggagcttccccatcatcactacttcgccgggacgggaacgttcggcttggctccatcccctagccgacaaactccagagttgcacggtgcatgactgtcgcttgtgcgctcccacttcttcaggctgtcgatgccacctaagctacacagctcagcgccgcccttgaactgtggcccccagccacgaagatggagcaccacggcggaatcaactccgctagcgtgcgcactgctcgccggaccaccgttgccgctatcgtcgtcgttccgctcgctcgccggttctttggatgggaggagagagaggggatcaagagagtgattagggttaggatttctcacgcacctcgttggtcacttcatcggcgcggagcaaatccgagacatccatcagatcagccccgcattgggctgccaccaccgatgggccacagaagatcactgggccacgctcgccaccgcactcggctcgcgcttaaactggccggcccggtttttgggccagtttttagaagtaatgggctgaattgaattttttttattttaacccgccgattaaatgtttaatatttcaagaattttggttatatccctcttagctaatttaaactgctaaaaattattttgattagtaagtaaattatttctagttaaatgaaaccatgagagaagtttagctacaaaggaataatgatatgaaattattttttgaccaaagtaattatagttttatgtcaattatatttgttgttctattccttagttattttctgcccaacggtgttttgacaatgaaaattctaagggtgtgtttcggcactgctggttcccaactttctcctctcgtttttcacgcgcacgcttttcaaactgctaaacggtgtgtttttttgcaaaaagtttctatacgaaagttgcttaaaaaatcatattgatccatttttgaaaaaaaaaactaatacttaattagtcacgcgctaatggaccgctccgttttctgcccgcactgttcctagttgggcctccagtagcgaacacaccctaagtttattttatatgtaattgattaagccaacataaattagttatatgcattattttcagcaatgggacaacttaagaatggaagaacaatattgtcaattcccttgatggatctacagtctcaaaacatgttttggcttatgcttatgagccaaaatttgaatattcaaccttaaatttagagttgaatttaggttttttttttctcttttagatcgctaagaacacgtatatataaattatatttacatattacttttcgtttgcaaaaatatcatttcgcttattccgtcgataagcgaaaccatagagtccctaatttcactgaatggaagaacaatacggttttgaatttagccatgttagattttgaccagcgagagctacagtgccgcgctgcactgtgctgctgctcgctg

SEQ ID NO: 51153 - DNA, 5017 bp, Oryza sativa
tgacacatttccctccaaattttcaaatttgaatccagacagcaaaggccacgagcatcaattgttgtacacgaatactgtataatacatgaggaggactacttgctgcggatggctaccaacccgcaaacacaattacacaaatgtgttacagcctcacagcgtcactcacactcacgctcaaagcatcaaacacacgcagactcggttgaagtcttgaatcaaaaatgacgagcgaaattagctaattccaagtacgaatgaacaaacaaacaaaaaatcatcagagaagctggtcatacgcacccgatggatgtggaggcaagtcttctgccccgcgggggtggagccgtagatcctgatcaccggcacctcctccacctctccgcctacatccacacacacacacacacccaaaactcatcagccactcgacatgcgcgcggtacagagacggaacaaaggggggcgagccggaggtcgagagaggcgggtggagaagagaggggggaagggaaatgcaccgtggaagtggctgtaggagaagtcgaatccggggaggggcggcgccatgtagtagtcgagggagacgatccgcacgctgagcaccggggaggcggtccccggcggcgaggaggaggaggcggcggcggccatggtcgccgccgcacaaggccaaggcgggccgcggttttgcgcgagttgaatggagtcgaggcgctagacaggccgggcgggctgtgcgcgagttgcgggggattttatccgtgggctataagtgggccgcggctccttgcggtggaagcttccgcttggtttgactcggtcaacagggtgaggtggcgtggcctacgtgagcctgctgtgtgttcagaacacgattcttagctgttgacgttgagtttgaattagcatcggtttagattccaccctaaatttgaacacctacgtaaagtattaaatataggctaaaaaaaataactagagtaaagtgcattggtgatccttaaacttgtaggattgtgtcatataagtccctaaactttcaaaatgcatattcaggtaccagaacttgtcaaagtgtattattttggtcctaaattgacacatcccctctagaatactacgtggcgctgatgtggcaataccacatggacgtgacgtgtacttttctcttttttttcttcttttctttttctttttcattttcttttcattcttctttttttccatttcttctgcacggatcacaaagaaagagagaaagagaagaaagggaaaaagagaagaaaaaaggaaaaaaaattaaattgatcctatctgtcagtcaaaataataccacgtcatatccgtgtggcatgccacatcaacgccacgtagcatcctgaaggggttgtggcgatttgagacctagatgacacattatgacaagttctgggacttggatatgcattttgagagtttagggacctagatgacacacctctacaagtttaaggatcgcccgtacactttactcaaataactaattactccctccgtcccataatattaaaacctaggactggataggacgttttatagtacaacgaatctggacagatgcatatccagattcattgaactatgaaacatcccatccagtcctagattataatattatgggacggagggagtacacagattgcaactaatttgcgagacgaatattttaaacctaattgctctatgatttgacagcatgcgattacagtaaacatttgctaatgacggaataattaggcttaataaatttatctcactgtttactgacagattctataattagtatttttattagtgcccgaacaccccatgcgacaccctatataatacctgatgtgacacaccaaaactttacacccctgaatctaaacaccccctttacatccttaaccacaatgttagatataggccctatttagatcccactccaaaatttttcactatgtcacatcgaacgtttgaacacctgcatgaagtatgaaatataggctaaaaaaataactaattgcacaaattgcgactaatttgctagatgaatcttttaagcctaattgctgaatgatttgacaatgtggtattacagtaaatatttgctaataatgaattaattaggtttaataaatttgtctcgcctaaaacgatgatatcaaaaaagtttgggcccataaggtcccgtttagttcccaaaagtttttcccaaaaacatcacatcgattttttagatgtatgcatggagtattaaatatagattaaaataaaaactaattacacagttaagggggaaatcgcaagacgaatcttttgagcgtaattaatccatgattagccataagtgctataataacccacatgtgctaatgacggatgaattatgctcaaaaggttcgtctcgcggttttcatgcgagttataaaattagttttttcatttgtgttcgaaaacccctttcaatattcggtcaaatatccgatgtgacatctaaaaattttcatttcccgaactaaacggcccattctccggaaacgatgggccgacaattcatgccctgactttacccaagtccaaatctcccagagacggtgatcactcgtatcagcagcagtcacctgtgagtgtgagtgacctgtcgccgacgttttccccggccgccggcgacgaacacgcatgctaacgcctctcctcacgccgcgtgccagcccggtcgctgtgccgtttgccctgtgccctcgtgccgtgcacggccacgtgtccggccgcctttgctaccacgttggcttcttgggttcttccctgtggcgtcctggatcatcaggctgctatgactcgacgagtgatgtgatgcgaattgctcaatcacgtctggtcgtctggatttttaacaggttgtctgaaacagaggtgggtttttgtcacttgtcttatgcatgacgtttaaaaataatactaaattcttttaataaaattagtaaggtaaattaatactccaatcgatccaaaaatataagggattttaaatagatgtaacacttctaccgttcaaaatatcttatattttgaaacggagaagatacattataatatatcacgtcataaacatataagtttgaattcgatttcatttacagtcaaaattattattcttatttctgcttatatataagttgaatttaaacattcgaatactatatcatatatcgatccatcttttaaatattcttttagcaaaatataaaaataagaagacgtcgtctccaaagacgaatagactttccagtgggagcctgggagggcaggaggcaaacgacaactcttggcataatcacagcacacaggacccccccaacacagaaactcagctagtaattgtcactggtgacatgttaattagtctgataatactatcatcattaccgagctgtattgtccatgacaataacggagacagttcctcatcacacccacaaaaaaaaaagaaaaagaaacacaacacaataatggggactgttagaaatcatggcgtcgtgattagcaggtaagctcctctggacctgtagtgggaagggaagcaaaccacagttatccaataatagagaggggaagcaagctgttgttggtcaaagggggccttgccagagtggcaggaaacggtcaaatggacaggtggatgcacacctagcaggctagcacaaaagcccatttcattctccgaaagcagccatgaaaccttgtcagattctgatcatgaaatccagccattgatctactagtatttatttattttagagagagtggtataaaggcaaacatttacatacacgagcgtatacttatctcaatcacgcatacttcttcatccatataagtacttccgagagactgtactgttatattttaaaatcgagcaaatcaatacatacgccttgttatcagcgagtacgctgtctgctattgatttttttcatgaaaaagtctactattgatttttattatcgagccaattattggtatagattatctacttgattatatggataaattaaatattatgagaaacataattgataaatattgtaaaataagtggtctattagatgaaagttttcttttgcaaacctttttttcaagtgtggagcaaataatccgcttaaaatatagaacatgatagttatagatgatttgtaattgtagttacaagtaacacattaaactatcttgttaaagattgtaaaaaagattttccaaattatactgttccactagtggtacatgcatgcttatgcacagaaaccctcatgataattaacatgagacatggcgttctttttttcccgtgctaaaaaaaatcgtttaactgaaaaagaatacatttataccaaccataaaacaataatgtcagaatccacacaagcttacctttgacctttgcatttgctatgctattttaatggtacctttgcagatgtcttggctcttacatgagtatatcttaattaaatatcgagcttatcaacagttcggaacataacatgctttgagcctttgacctttcacacgtttgcatgtgtccagaaacatactaatcatctcaagctttgagtacatcataagcttgcttaatcaaccaggcagccagctcatctcttcagaattaaaaagtaggaatagtgaaagaatagtctatagtccatatagaaatataattttaaaataactgaaatttgaaattaaaaataataacaaatgaaagaaaagtcaagagtccttgtagaaatacaacttaaaaataactaaaattcaggattaaaaagataagaaatattaaaagaagagttcagagttcatatagaaatatataaatagtgaaacctcgaaataaaaaaaaataaatattagaagaagagtctagatttcctataggaatgtaattacaattcggaatgaaaaaataattaataaatatcatgtacataca

SEQ ID NO: 51154 - DNA, 6652 bp, Oryza sativa
ttcctgcagccctattatgtgagaaaaaaataaaacgatgctagccgcacaattgcgcagccataagatctggtaatacaaaagtaatattattaataaatttgctatgaaaaatagactttatatagccatattttctgttttgtcatcaatatatgattagaaaagagtaacaaaaaaatgtgtggtttggagctaaacacttgagcagttaaaacagaagagaggaagtactatccacttgcttcacaacagtacaacacaacacaacaactgccaccaacaaaatttcagttgctgagctattaaaaacaacactaaatttttgcctcccaatgaacaactacaccagcatcttggttgcccttttgtttatgccatcttgagccttgtgccctcgaggccttgacttccttcccctacccccacccccaacatctccctgaatttagctgctttcgcggcacagatcagtgcgcaagccataaagatcgagccttagcttcgagctggaatttatcggcggatcggctggcattttttcagtttgtgcgcgcgcctcaagctcaagaaccgggagagagatgagctgcttcccgtgctcggggtcgtcggggaagggcggggttgacgccaagagcgtggcggcgctctcgccgggtccgcggcccgcggcgagcgcggcaccaggtgaatcccgcatcttagcccccctccgatttctcttcgcagggtgtggaaagattcgatttcttctggtgaatccgcttgctggcgttgccccggtcagctgtatgattctgtatcggtttcgctggttgcgaatttgcagcgagtggctcagtgcggtagctgcgcattggtgtgatccatattggctcgaattctctcttcgtttgggtttaaagggtaacagtgagaaaaaagaagtcaattttgcatagcgttgattgtttattatgctttcttgcaaactggcgctttggtcatttgattgtggtaaataattcaaggctttaggtttgtaaatgttagtctggttgcttgttgagatagtggggttgaaggggacgcaaagctactttcttggaaagaaaatgtaattgattgttctcgtgagaagtggagtgaaagggagaggaaaataaaatctgaactgaagcttgcagctataataataatattattgcaactttcagtctcaggcgaccaggcagtaatgtttgatgtgttgtttactcttgttgtctctaactgattccttcgcgtgggtaattgcttgcttcgaccttgcttgaattacagtccaccctttgcatagttgttgtagtctgaagcgagtacagtaatttagttgcgtgttgctgcgcatgcaagtattatcattctctcatgagatcattgaattgaggaataatatgttaaaatttgcatgttggatgggtcaagatcgatcaaactcatcacgtggttcaggcattaagaaggacgattctgtccgaagaggaggaagctctgcgaatgatggtccagccaaaattttcactttccgagaattggctgttgccaccaagaatttcagaaaagactgcctgctgggtgaaggtggctttggtcgtgtctataaaggacagatggagaatggacaggtttgctattcctaacattggctgctgtgtgctcttgttcattagctgcaatttagagcatgatttttctgagtgtccgacaccttttcttttgcatatatcatctagcaggttattgccgtgaagcaacttgacagaaatggcctacaaggaaaccgagaatttctcgtggaggttctcatgctaagtctcttgcaccatcctaatctggtcagattaattggctactgcgcagatggtgaccagcggctcctagtttatgagtatatgctattggggtcactagaaaaccatcttcatggtaagcttctcagttctcactacgtgattttactgtttcagttcaaagtttgcacattatcaataacacttagttgattgagcttcacataacatacagaagaagaattgtgaatttcgtgacataatgggaaacattaatgtttaagttcagagacactaaaacacacctcctgaaatgtcaatgcacattaaattgatagtgatcaagttatgtccttatggttcctatcacaagatttgtgtttgtgctttagtctcaacctgctaagttgattcctgacctatttgatttgaaagagaacttgccagctacccttcactgtcttactgtagtttgctactgacaacatttaattttctttagacattgctatctatcattttataactcatggggcactttcttaatagatcgcccaccaggcaagaaacctcttgactggaatgcaaggatgaagattgctgttggtgcagcgaagggtttggagtacctgcatgataaggcaaatccaccagtcatatatagagatttcaaatcatcaaatattcttctgggcgaagactattacccaaagctatctgattttgggcttgcaaaacttggtccagttggtgacaaaactcacgtatcaacaagagttatgggaacatatggctattgtgctccagaatatgccatgacaggacagttgacagtaaaatctgatgtttacagctttggcgttgtcttccttgaactcattacaggacgtaaagccattgatcacacccaacctgcaggggagcaaaatcttgttgcatgggtaggttcatccttttatttttaagaatgtgtgggctcaactgtactaaattatctcccttcctttgggtgtagaggggatgttctgtttcaatttcatcatgatgtgaagtgtcttatccttataatttgcaggctcgtccactgtttagagaccgaaggaagttctgccaaatggccgatccatcgctgcaaggttgttatcccaaaaggggtttgtaccaggctttagctgttgcatctatgtgcttgcaggagaatgcaacatctcgacccctcattgcggatattgtcactgcactttcttatctagcttcaaatcattacgatcctaatgcaccttctgcaaagagttcgaggacttgcccatccaccccaaaggcaaaagcacatcgacgaacaaccagtgttcctgatgcccaacatgctgccgattcacttaactggaacttcccagacttggggaggaaggaaactactagaggggaattcgagcaggatcacagtgaaggttatggcagtggcagtagctctggaaggaatgatggtctagatgttccagaactgctggccttgcataatggacaaaataacagtgaagctgatatatatcacaagtccagtgtcaagcttgatgcccatgagaaacagagatcagggtcaggcaaaggcagcaggcagtttcgatgcacatacaaacagacattgttgcaattcttttcccgattgctgccaattttgccagacatcttctctgcttctgttgagggtaggatactctttgttggtacagttgcgcgctgttatggtccaggtgctgtatgactgtacccatggttgtattttagttgtttccaaaggtatacatgaagatcatgatctggttgaagcaagaaaccatcttgtcgcagataaggagcatgcattttgatcggtgtcaattgcattctacctgtaaagatttttattctctttgtaataggtcacagtttgtgccatacctatcattcaggaattaggatgttttatacatacagaaaacaattcttaccagaatgcgtgtacagacctacatgctacagtggattgtttgtgttttttttacatgtaacacaattattttgcggacaatgacatactgtatagaccatagagtgtatgatcatataatgtgaaagactcctgttgttagaaatttacctttgtgcctgaatgtcatattaatttgtagtgattaatgttgtggtttttactggagtggagtggaatgggagaactttgcagtgacacaacaaggagaactgggttttggcagagtttgaggatgccaggagctgaagattcagaaggttcagccttcttcagagttccagcaatccaagcacaaaggccccaaattctttcgatatattgatagctataattttatttatttgttatgagcagccgaatctccaatgcagcatagaaaaggaggtctgagttccgtagaatatcacggaagttagtttttggttggtaagctcgacatcaaataaggaatgaatctgaaactccataactccacatgccaatgtacaccagagacagaacagcgattaatttggtgctcatgttcagtttcagatggtttacaaaatagtataagtaagtctaccatctcaaaaaaaaaaaaggagctaagtcttcaggtgccatgcaaagcctgacagaactcttgttcagtcttcggcatttctgttgccatttgagctttgccagagctctctctttgtccttcccaaagcaactgttttttccttccttccttccttccttcctttctttctttctttctttctttctttttggacagtcttcggttccttcaagaagacttcaataagctgctgaaatcctgagcggatgaacaggttattaaagaaccatgtagcaaaggaagatatatgtggccggctgattgtacaacttagaaccttccaagtaacttgtaagtagataattcaagacttgcaaagctagatcatgcaaacattagccgcttctgtgagtgcaagcatacatgaactatttgtccaaaggttctaagttatgctccaagagccatcgtcccagcattcagccaccttaaatcaggaccctcacatgttgagaaaatatttgccaacacaagatttaaaggtacttttcctacccagatatccttccagaagctgctatccatgtggaaatatgcttgttggaatttggaacatatattctcactgtttttttgtcaaccaaactgttatggcatcttgtttatctatcattttagacaacagtgatatactcaagcaactccgatgacaacagtgataaaaggaaggacaaattggaatttcatgatatttgatgtcggtcaaaggcactctgtgctgcctgtagtgagtacaaacagccaggacatttcccctgtgtttgattttgaaggacaagtgaagaatcaagataccctattggcatggctcaagaaggagagtcttctcttagcagcctttgatctataacaccacacttcaaacgcctccgtcaagtctggatacttagcatgcttcgactgaagccaatctgacaaaatgtcagcttgactgttcgacggtagcgttagcacaattgaaacaatagctgattccaggctctgccagacctcactgtctaggttgatcttaggtgcttcagcatcaccgtcatcgtcatcgtgttcgggatgtccgaccaaaggctttgttctccttgcaaagccaatccaaacattgacagcatcacaacgtttctcggttgggagaacaatgttgccaaatgcaatcgcctccaggacctttgcagacacctcaatcaccttcaatctagtcttcaggcagctgattcccccacaagctttgtcgacagcttcaacgacatcggatgaaaccccaatccagtaaacaacaacacatttcatcatctccagcttgctcaagatctgacagacccaggagatatctgaaacaagagaatgcagctcctgctgaacctcggcgtcgccgtggcctaaaggcgcctctccctgttccatcaggattgaactcgtgaacccactgaacctgctcagcaaagctgcaacacaatccttcacttgagacctgacaatgtcatcatcgaaggctaacaatggcgcgtcgtcgtcttcggtgagcatgtactccagctgctcctgagccgcggacttgagctcctgcggcggcgagcgcgtcgacgtcgcgtgccggaacgccgagaggaggatgccggccaccggcgcgggatcgatcgggcggagccgcgcgaggacgcactcgtactgggggccgaggcaagggatggtcctgaggatctcctcctcgtcggcctcgtcccacggcgcggactccaggtagtcgacgcaggcggcggcgacgcgcgggcaggcgaggtgggcggcggcctggaggacgccgagcgcgccgcggacgccgaagcgggagcacggctcggcggcgtagaggaggcggagcgcggtgacgtgggggctgaggtccagctcctggcagtggacctcgacgcagtagcgggagccgaggatctggcacgtgggccagtcgtcggagaggcggtcggcgaagtacctgctcccggcggcgagcacgccggagtggcagtagagccactcgtcgcggccctccggcgtccgcagccgcaccaccacgtcgctggtcgcgaggtcccgatcttgggccgccccgctgccctcctcacgccactcatctgcgaagctcgggcccgcccgcccgccgcgtgggttcgccggagctccggcgacggctcaggtgaggtggagattggggaaatgatagtgaaa

SEQ ID NO: 51155 - DNA, 8158 bp, Oryza sativa
attacactcatcctaaaactacgaatctggacataaactatgaatctggacataacctatgtccagattcgtagtgtaatatattcggacggagggagtatttgctctaaacttcggaagaaacgttgtcttttaaaaaccttcaaaaaatacgttgtttaaccacttatttttgttaaatcaaagtgtttttattattattctgtgatgaacaattggcatcggagattattggttttgatatttggaatttatttttgaagtggttttggagatgattggatttcacaggtgaatctacaggtactgttggatgtggtccggtcagaccaggcatgtgctgccggtcagaccggcgtgtatcgcgcggtcagaccggcgcagcccgcggtctgatcggctgactctgtgtcgatttcggtttcgggttgtttgtttggatatccgtgattgtttcatgattatggcttctagatggatactatgagtatgtaatactgttgtttgctactaatgagtcaagttggagatagcttggtctcggaatatggtttctttgtttatttcatgtgtaggtgactagatgcctcgagagagtatttgctgtgatggaccgggagtcggcttggggataagacgacgttcgtggtgctcagagatcatgcgggatacttaggctagagttgatacacgtggttcgtgaagattccatatggcatacgatggaggtattgtgtgcgtatgggatgcggagtcgaatttggaaggagtttaaatttgatatgattggttatataaagtttgtttcttgtactagagggtttcctaaggtgtttaggacttctagtatgagtttggttcgtggctttaggctgcctacctcgggtatataaatagagggggagcgtgaggcttccctgtatcgcttttgagagcaattgagttgagagttgagttagggtttcgagtttagtcgaaatttttgtaaggaatactgttggtgcactttgtaaacacagagagaatcaataaagtcgtcatccactttaagagttcttcgatttgtgtttcatcgggtttcggcggtctaaccggcggcgcaccggcggtcagactggcggcatcccggcggtcagactggcgggtgacctgcggtcagaccggcttcagcgacaggtgacaggagctgatctcgacggtcagaccagagatacaatctcggtcagaccgacggcaaccaggcggtcagaccggcgcatctacttcggtcagactgcaatccgtcgaatttgagggtaacttttatttccgtaaagtattggtttttgggcataccaaccattcacccccccccctctggttggcttagttgttgtgattcaatcctacaattttaagttttttttattgaaatatctaatttataatccctataatccagtatttagccaaaaaaggaccctgattaggatgacctgctgtaatctgtttatgctaaagtgcccacctgaatgtcttcacctgaaaaaaaaaaggcaaaatagcagaggtctggattctgtatcttctgattgaacttttttagtatattcaagatcaatgtgaaataaagaagtaatctgaaacctcacaattgccatatgccaatgtgcagcactgatagctgaaagaacaaggatcgatctgctgaccaagttcactttcagaagagtcacaatccagcaatgaactcatatttccgtttcatgcctaaagtcacagataatcatatatcttttacttacacagtggcagatacagataattgtatggatattcatacatgggtggaactattcttgtttttattgcatttacaaaatgcataagcatatgcatcagaaaaggaaaaaataaaaaactaacacctatgaaatatgaatctatcatcctatgtacatctctacatattcacaagctatgaaaagaaccctgtatgtacatccaaatctgaatgaatttctaatcaagccttcatcttcgagaaaagaggaaggatccatcctttgctctaaatcggataaaagaaataccgtagactatccataattgctttcaatatgtttgtgaactaggttctacaatagtgacatcgacagagtgcttggagacgatgatgttgctggcgagatccttttggagttgcctaacattttcagctgtgatgattctacaagtgctccagtcgtcagcttccatatcaactcccaggtatgtgaaatggtcttgaacgctcaaactccatgtggagatgcacctaggaaataaacgagggaacagaaattataattagaagctaaaaaaaccagatttgagttgttaggttgttaaaatgagcctctaaacctgcagcaatttggatcttcaccactatcatcacatatctgttcggttatgtcgccctcagaatcattgacccatacctgaaattcgaacaagcatattatgtgtgtacactgtacaggatgtaacaccacatctctaaagaatattagcatatttgatttagattagtatcattgtcccatggaaggtgtgcagagcatctaacaacttgctgcactaggcattgattttgtattattaatggtaaatataaaaagggtgttaatacaaaaattcataaagtgtgctatagtgataaaatagataaagccagggccaagttaagtgtacaagagcgcattcttaattagcttatgtgcaagcctgtgaggcatacctctcttgggaagtggtggtaagttagatggggaagaaaggagaaataagggggcaaatgtggcacaatatcatgtccatgtgtgactcgaatcgtgttgggcacatatttggcaaaataagaggcaaaagcagcattgccaacacgaggctgtccgaaagtcatgagttgaacactattgcttccaagattgatctgtggacagagtaaaagaacaagactgtatcagtttacataacaaccaatgatggcattcaatttttttatggaaagaatgtgatacagatattacatctataatgtcttagaagagttgtaatctgaacactggatgtattagtaaaactttgagcctcgggggtacttacagcgagatcaagcgcacagaaggatgccatggctcctcccattgagtgccctgtaactatgacattgatatctccatatgactgtcttgccttgtggacagcacttgtgatagctagacgtaaaatcgtgttattataggaggagaaaaatccactgtgcacctttaaacagagaagtggagatattttaggggaaaaaaaaggcactgatcttcttttaataaaaggacttaaggagatagaaacactttgctagcgataataacctttgcgttaggcatgttaggatagctcagatcaagttgtttccatatcaagtccttgatccaattctgcatactgagtaagcaaatcaagatataaatcacatgggaacagggaacagtaacacactgtgcaaaatcagtgtacctgttttcttgagttcctcttattgcaacaattattgaatttaaattataatccacaccaacgaatgcctgttacattgttcacccacatagtgtcacacaatataaataaaatcattaaacgcttaatgtactcaaatatcatcgagaatttatgatattagtttgaaatttgtaagataagaacctgtaggcagttctccacatccacgattagagatttcatctcaaagccctatttcaaatgtagtcatatcaaaactagcaacaaatttatcctgtccatgacaaaagaaatatttttcctaaagaagaagaaaaggaaaatgcttttatgattcattaagaggaatggcagatcctgacaagcggacatttgaggtgattctgcccccaaccatcagtaacaatataagctttacttcgcagttaatgagtatccctctaaatatgaattgaacagaacaaacttgaaggcttcttacttgagtcaagtcattacaccttgagcacgtccatgtataaagagctgttaaatctgtcatgtacacctggagaaaacgaagagccatcagctaagttcttcttcttcttttttcatttttaaagtagctgattttattttggggcaaaaggagaaaacaagaaagagagacagttgcctttgtgaaatgcaaaacatgaacagaaatgttacctagaacacatactgcttatgtaaaaataaggaaaagtttcttacagcagaagcatattccacaagagtcatggcaagagtatggctatagttcaaagtttgctgagagtgctggacagagatatctgttataatgaaaaaagttagttcactccagtttttgatgatgagagcatgaatacaaacattgatgatcaactacatctactatacgaaggtatgcagcagacgaaccgacattatattcggtaataaaatcaaatgttgacaaatgaaaagaaaattgattaaggacatttgacttgtttggacatgcttaagatattaagccccatttgctcataagtgaaggaaagccgaaagctgatttcatattctcaatttttatggcatcaaacttataggaaaagtggccccagtatcacgttctggcctggtaaacttgtggtagcttcaagctcaatcttaaacctcaaatcagcagttccatgtgacgagtaactattaatgccccaaaaattgtgctaactgctagctaaatcttcttgtgaaattaagcccaatcggagtaggtggtgcagaaaaaatgctcgatcaagttgtgtatataatatatggcagatggcatgcagcatatagcagtactaaataaactttcaccaacagagtgtcaagcttgcattggtgaaggccaaactaaagaatactctataaatgtttgaacttcacatatttcaggatcctgagacaaagttttatgaatgcaaagaatccacaagctgtaatgaagtggaattcaagtttaaggaagcaagaaagaagttgagaactcaataaatattaggtttaaggttcaaatatgtgtttggaataataggaatctctgagcacaattatatccattatctttcttgccatcaacttctttatttccaatgttgttattttctactcacccaccaaccttgtcttccttttcagcaattagggcatcaattatattagtaaggacagggcagcaagaaattccaactgtcacccacctactcttgctcatgcatccccaattacaacagcagaacagctataacttggtcaactagtccagtaactccagtaaattactggtcatttcataccaaaccgacagccaaaacccagaacttggtaaaatcaaaagaacaagacaatctcatccatcatcagcactccccatttctctagaaaattaaaccttattacagatgcctgcataagcattggtctgctttctcccaccaaagcagtcagttactaataccttgatttgctatttgttctgttaaacgttaacccattttggaatacattgaggcaaacttagaacaattacccaacaagcatcaaaattggaaacttagggcaaagggtcacatgaaactacctctcccatgggaagcatttgacagcaagagcaccagagccaacacactgacgcatctccacctctccatgaacctacagacacatccaaaccaacctcccatcatcaaatgaatcagataagcaagcaaaaaagaacccaacttgatgagcctcgaaatgcagagcaaacaatcccagaatcgaaccggaaactacaccaagttatacccttgcatagtatgaacaagaacaaagaagaggaggaacaagattatcagtggggagaagagaagagaaaggaagcttagggggcaaagaatttgacctcatccgagctactacctccaactccaagaaagcaagaaagagaggctggattggatgaacaaagttacaaaacaaacaaaatcggaggaggccgagtattaatgcggagtgggagcccagcggtcgctttcccggcgctgtgtttggagggagaagaagaggaggaggagagagaatcagaatatgcggctctccctcctccggattatgctatgccaatgccaaggcctcaagatggtgggaccctaaaaagacatcaactttcgctgtctcgtcactcctgaatccatgatttgttcaacaagatctcgcaagaaaccgtgcatttctcatataaacaattaaacaaacgagcaccactctgtctttgaataattctgaagaaatttactgtactactcttgtcactgaataatctgaagaaattgtatccaggacattctggatctgaagaaatgagggaggatcgatgaatcactggatggatcgccgccgctgtcagggcaggtggccgtcgctggcggctccagcgaggcttcgacgcgaacgtgaggacgcgtagatcggagaaagaaatggagcccggatatctcagattggatggagctcgtgtttcctaatcgtgaacggcaccgatcgagtgcagaagaggaggcgaaccaacacatttgcgacgaattacgaagacctaatcgatcatgagatgatgagagagacctgcaagaaacagattgctcccctactcatttctccacgtaatctctcaccatgagagcacccacaatggtaaagtaaggagctatctatataaaacatatacatctcagcagtagactagattaatagtaaaccactttaatggtatgtctacatgggtatctatagctctctaatccattgtttcgtttttctatagactatctccaggttaaggttagtagatagctttgctctctctctcttcatttaatctcttctaagtaggaaaatatgctaacatggatctcttgtagagagcttatagataagcattgtgggtgccctgagtgttgcttaaacacgaagtgatatctctcaaagaaaaaaaaaagaagaggaagagcggactagtgggcctgaaatgggtcgcccccgttctgggccgtcgaggaggagagtggtgtgggctataagcccagcagaaactggaggtcttacacgaagaggcccagttgatgggccgatccatgggaaatgtctagtgggcaggcctggaagatggagtcgcgagcccacgtcgttgtaggctaacaggccgaaacagcaactgcatttgttcgtgagttaagtttgcgatgatgacgataaattgatgagatgtgtaatttgtaaatgggataatttcgtttttacccccactttaatgtctaatattgattttatccctattttttagggttttcgtttttacccccacttttttaaccgaaagaggcgtttacccctggtttagacggaagttagtgagcccgggtttatggcagttaagaaataaagaaataaatgaaataaagattttttgaatttgtgatttacctttttacccctgggaaatatctaaccctatactagtcgcttctctcctctcgcacgcgggtcactctcgaaaccgatctgggcagcacaggcgacgacgaattgggcggcgtgcgggcagcggccaggcgacgacgtgcgggcggcggccaggcgcagctcctcctgccggcgagcaggcgtgcactctgcgcgggctaggcggcgggaggaggcgatggctacggcggctcgtcgcaggaggcgacgggggcaacccagccaggcaatggtggcggcggcagcgagtgggcggcggcgacgagcgggcgtcggccatgcgcacctcctctcgctggtgagcaggcgcgcgctctgcgcgggctaggcggcgggaggaggcgatggcggccgcggctcggcactggaggcgatggcggctgggaggagttgcttgagttttcttctttttttttgacaggggatgttgctctaatttgtgatttggatctgcttgattttgggatgattgcagcttgctatttgtcttctagttttgtaaagaaaaagtgtcaaaattatgcctaaattctttcagtttttgtctaaattttatcaaatttgtggcaaaagtatg

SEQ ID NO: 51156 - DNA, 1826 bp, Oryza sativa
  unsure (1)..(1826): unsure at all n locations
catggataatactactccctccgtgtcataagataaagatttttagacttaaacatgggtattaaaaaagcatgtagaattaaataggagaaagttgtgatcggtttagaagtagaagtaggtgagaaaattaaatggtgaagagttataattagatgagaagagaatattgatgaagaaattgttatattttgggataaaacttaaggactagaagttattatattttgggatggagggagtagattctgagcttgcacgctgcacataaagtatatatttatcagctacacgtagattaactgagcctgtagctcgttaaacaaagaacaaattttatttcattataaagaaaacgtacattaattgagacgattttctttcgccgatcccaaagcttttcgattgcaagtgccgatgaataactgaggagtcattaaagtgccgatgcatgcgctcggcctgaataactgagtcatattgttcagcttgttcttatgcgtatcgcttattagaaaaaaaaataatttatagttgaaacttttatataaatgttgcaaaataaattatgactaaagaaaaatcataaaattaattttgaaatttaaattttagcttctactaataattagcataagtgggaagacggtttgtgctaaaaggacaatacaaaatgcaccgacggcagccagagtgacgcagcacaccgctagcttgaagctagagggtggaaaaccgatcatcagcacataggcacgcatgcatatttttttttttttgtggggaaggcacgcatgcatatatgaagccacaagcgcgatcatcatcatcgcgatcatcatcataatcatcagcatatatgaatgtatatatgcaatgcagccacgaccgactacgtagctggatgctggtggatgacagttgacacacgcatgcagatatatgacacaggtggaaattaagcttgagatatgatagactaatgaacaagtaattaattaaggtggtaaagagtatggtgatggttattttaggattacaattaagtaaaagttagataatagctagctagccctgtactcggaagtcaatcgctgatgttgggctgccatagctgacaatgtttctattgctgatattattgtacattatgaccttgcgatataactaatatagttggacgtagaattttaaagacagtgaatccttatattttagggtggatagagcattatctaagtcagtcttccacgggatatatatatctccagcaccgcgcacgtgcgcacataaacgccctgcgcggtgcggcagcacgcggggaacgaagctggtgagatttgtctgcaccttaccacccccaacccaaaaaggcacgtgtgtgcagatagatttatatatagcttgcaagctagctatatgacgtggtgcgcgccacgtattacatacagtcgacaccgatcgatcgatgagtcagcttgtggctttgcttgaattgctagcttagctgatcgatcgaatgcatgcgtgggcgtggcctgcacgcgccaggtgagctgacgggatcgatctcgtcgtccacctcgcttccgcggcacacgcttggaacgcatggtttggctggttaattactgcacatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51157 - DNA, 2656 bp, Oryza sativa
ggccttacgttccttcccacaatatggcccgtgtattagcacggaaagtacggctagttttaattgggctgacatgggttgggccaaatgttcccacggactccgaagtaaagcccttcttcttcggcgccggccaacttcgctcgccgccgcacaatccatttccataccctcggccgtcgtgagaaacacccttaatctacactgggatcaactcaaccaactctgaagtatacacgactttcgatccagccctaattcgatcgtgtgccgtcgctgatcctttttacttaacaattttttttaacagctgatcgccaccgtaaatcctctttgtctctgttcggctaggcgattcagttgattaacaatgcagccacgaacagagcagcagaagcttcctcatcatcatcaaatccagagcaagtacgcgctacctcaatttcatattataaggcgttttgatttttttttcttagtcacacttatttgtgtatgatcaaatttatatataaaaaaaagaaacttagtaaaatttataacaccaatttagtttcattaaatgtgacatagaatatgttttaataatatgtttagtttgtgttcaaaaatttatatattttttaaaacttgattagacttaaaaaaaatagacaacttataatttgaaattgagggagtacgtatttaacgatcttatccacaggtatgtatcgtaggctcctatccaccacctgcgtgttatatgtacttgtactatagtgcaaatgagcaatcccgctatcaatatgaaaatctgcttaggtcttattcgtttgattatattcccatgagaaaaagattataggggattaggtacggaattaatcccctcaaattaaatctcgattctcttgagtgagggattaaattaaaaaaacaagactttaatggttcgtttcctacttaagagtacaaaatttagaaggaaaaaactagaattgtgatgataagcgggaaataaaacagattacctgttgcacttgcatccctagattacgtacttgcttatacgaatgtcaatccagtactactacggtactgttatacgtacttgtgtacttacgctagtatagtgattttatccatattaaaaaaaagaagttataaacagtagtgaagtgtactagtgatggatcgatccaacatcaaaacaagctacagggatttgatcaacccctgcacttgcgtagagagcatttcggacactgtcagtcatcatctgaatttctgaaattctgaacctgacgtacgcaagaatcagcatcaagtacctgacgaaatggttgcttggctgacacttgtccagtgtgagctttccgttgaactgtcaattgcttccctcctttttcccagcttttctgtacttgttgcccatgtcgttcagttcctcatcttcttcaattttcttctccatttctcaatccattgtcagtactacatatgtgtgtacttctcgcggcgccattcttgtcatctaattgcaggttagttgtaaaatgtaaaatcgaattggacattttgaaccaggtcatggattaattgattaagatgctagaagaaattaacaagctgtgccatgcaatatatcatgcatgcatgcatgaatatgatggctaagtaggtactaatgctaatatagaagagagagagagagagagagagagagagagagagagagagagatcatctgcctaagtacatatttgaagaagctctacttaattaactagaaatggcgccaagccactcttcttgttcgatctactgctagctgctgctgctgctgctgctatactactcgatctcttgctcgatcgatcaaacgcagattgatcaagatcaactcgatctgatcatggtagacaggaaatgatatatgcatgatcgctcagaggcaaagtgcgtgattagccatgctatgcccggtgcaactcgatcaatgggagaggaagctgaatggagagtaggagtcggagccctgcgacgaggcgaccatgtcggggcgccgccgctcgccgggaacccgcaggcgccgagctggtccgccgcgtcgccgccgccccagaagccggcgaccatctgcgcgaggtcgtcgacgtcctcccggagccccatcatgccgtaggcgtcggcgtcggagtagcgccgcatgtcctgatgatcggccgcggcgccgccgcccctcggccggaggcagctctccggcaccacgctgctcaggtacccggagttgtcgtcggcgccggagaagaggaagtcgtggccgttcctgtccatgtccagcagcgacgacgacatgctggagcggtggggatcaaccgggaccatcaccggcatcgtcgagcactcgcccaccgacgacgcgcccgacgccgcgccatgtccgtggtggtggtggtggtggtggtggtgaccgtacgagccaatgtgcggcgccgcgcccacgccgccgccgtactgcaccgaggacggcgcggcggcggcagcggcgtactgcggcgcgtggaacggcgcgaggaacggcgggtagttgtaggcggcgtgggtgtagacgaagttggtgcgcgcctgggcgcccttcatggacagcgcggcgcggtcgtacgccagcgcc

SEQ ID NO: 51158 - DNA, 6119 bp, Oryza sativa
  unsure (1)..(6119): unsure at all n locations
ctcccccggcgcgcctctcgctttgtactcaactacgacttgcttctggtgtcttactacgtaggagtacctgttttcttttctttcttttttacacaacatttaacaaccctagctacaacattttttaattttctctcttgttaccatacaaagcatcaataataaggaatggaaatggtgatagctagaaattcttgttctaaaaaggagaaattatcggccaactgagcattgttttcatatcgtttttgaccttttccatttctcccatatagcatttttgtttttcttttccaacgacattttgcagtcgttaataaatagttaaattggtaaatatgaaaaaattttgaccggtcaataatcattttcataatgtctctgaccatttttcatgtgttaaagatacagctatgagcaggtttcaaaaaacgatcggttttcacgagaaccgcttggttttcgtgaaactgcccacggtcaatttagggttacatatcagttttaggctagtttccgtagtacattgattgaaaatccccgattttatcagtttttgggtaaaccggtgagaagggtttttttatttccaaaacgaaaaggtaaatcccggccatgagcgagtgaaaggcatgacacacaggtagctagatagcaatagcatagcaagcagctcgagtcactactcactagtagacgactaccagtgtgtcacacactcacactagtctatatacatatagctgtcaaatgtatacatgtgatgggtatagctagctcagctcttgaccgaccgggcatgcagtccaagtgtcgtgcgtgtagaggataagaagagtcgagatgatgtacacagtacagatggatggaacgggggtagaaggataggatgatatgtgtaggagtagagcactgttcacgtaagcacattgctgatgatgatgatgatgcatggtgtggtcgtagacgagagagagagagagagaggctaacttcacttgttctgcagaggaggcgacgcgtcagctgcctctgccagcgccccccgaaatggtaaccaaggattgtgtttggtttgcttggttgtgccttttccaccggggaaatggtaacatctcctcatacttctcctcctccccaactggccaaaccaacaagaagtatatacactagtagtagactactagtactatactgtactattggagtagtactagggctagtgctagccgtatagtatgagatattgagatatgacaacatttttttctcctgtgttttgggcctctttggatcattgcccaaaaaaaatggcattcaaaaatcgtcactcatttggtttagataagaaaaattggcattgccaaattatttagcatcctttctatgccattgcatttggcttggctaagattggtatctgcaccagtactgtaaaaaaacaatagtggtcaagctctatttttgtgttttttataagttagtctacgatattttctaatattatgtaatagtctaatatttaaataagtatgaacaaagcataggatggcattttacagcaacagagcccaacttttgggcctttttttttgccaggattcgagacgtacggcagtggcagtgtgcaatgcaatcgcagttcgacactcaaaaaggcaaggatggccacaagcttgggagatcatgctactgtagcacagctacagtaagacggcctacagggaggtatgatgagtttttaagacaatgttgactcctcgggaaataaccagcctgtatgccagattcattcgcccaatcactggatctcataatcccaggaaaagacacaacaagcaggaattctgcaagcaaaggtccagacaggttttgccaatcgtttgagagatggaagaatatccagttcagaataacaccatcatttcattttccccccgacatctcaagctgaatcatcatatcagcatcatcgtacaaccaaaagaaagaagaatcgtatagaatacaacgaaattcgtgtttgactgagttcaatgccccaggtgaggaaacagcaagccagcacccataattcagttttgcagcactggatttcacaggttttgtattgttcactgtaaattgtatacaagtgctagtcttgaggtcttgcctctctcgacaaatgtggcttccggtcatcatgtgacaggcatgcagcccgcaaatgggatttccagtgtcaaaatgccaggaagagcaagtgcttacaatgcttacaagaaatgggactcacaaaaaagtgaaatcaagaaaaatgacaacagcaacgccttcagctccctaataccagagaagttaaagaatcatagggatttcaactttttcttcttcgatgctttttgggacttggaatctttagcagcctgcatcccagaatcgttcatcagtattttccaccaagcaaaaatatgtaaaactaaaaatattcaaactattttccacggtatagctatgtgtggctgtgctattatgaacggagtatgtccatctggtaagccaagaaggcagtacttagaccctgatttttaccaagtagactatgcaatgacagtaacccagaagcttagtctcctgattctcctctttcttgtgaaggaaaactagtaaaagggtattacagtattattacctttagatttttctttttatttttcttctttttcttgctctgttctcctccgttttgaaaactcttatccttctgagcaatatgatatgactgtcagatacatgtcaaaaaactttcggcgtatggtatataaaagcagcaaaattgaaacaattcacagacattctcaagtgaatgttcatatacttgccttattcttcctttttcttttgacccccttggtttcttctccatcttttgaatcatcagaatcctgatagtcttgaaattgtaagcgcggaaatcaaataaacaaattatatatgaaagttatcatcaacatatatacctcagaagaatctccgaatgatgaaacgtgccgtactattcttcctgaagttgacggttcacctagattgacagaataaaatggtaggtcaaattcactggttcacataaacagttaataatgggcaaacattgggaatgagaaaaacgctggtgtaggtcaatcctaataccttagcagacaatgcagaaaccaagcaaccttagcattagctggtggacaaaataaatgtatgatcaagtcttataaccgtttttactaattaaggtttaaattgtttgaagtttcatgttcctatataagacagatgtgcagcccacctttgagccattttctatcttaaccatcaatccatcatatcatagaaaaaaaatatcgagcagtcatgtaataacaaatgctccaaattacggaagaagaaatgggaaaataaactgtaagacaaggttaattttcatgctcttatagttttatgagtatttgtactaaaatgcacaccattactggtttacgtaaatcattacataatgtaatctataatgacataggacacgcaatacatgcattccaaagaaccagagtaccagacatatgacagtgagatgataagaaatccgtacccttgctagcctttattgtttcttttgcatttctcacagccaatttgacaaggtctgggttcagagattccagcccatcaggctgctgaagctttctctcaaggaattttgctaaagcagcagccttgtttgtagttagtggtcctccaggatgagccatcctatttaaaggagtacagtatttgagcctttcagggtcatgtcatgagcataacaaagaacaaaaacccatgaagatcatactttacatagagcaagcctacaaaataaagtccacagagctagactccttggtcactcgtgcatgagaaaaacaataacacaatatattccaagttatctgctatgatatctaccatagtttaaacctaatattatgtttcaggcaaaatccaccagaacttgaaccatcgctcttttttacttccaaaagcgagcatagatgcaagaggcactgattaattcatagtataaacacagctataccataatccanacatgatagttgtcaaacatatagtatttcgctatctcagcaatacagatttcaaatatgtgatccaaatttctgctagcaatatattcagattagtttcctaggaggacttgaaatctttccctattaggagtcttatcttttatctcctatatatgctatattgtaagccacatgggaaggggtgacgtcccattgttattcccctgcgtttgtaaccaactcctcaatagtgatcattgccaatagacgctcatggtttttccccgtaagtgttttctacgtaaaaattcgtgtctccgttgtgcatatattttcataacaagtctactttgtcatttttggcttatgtgcaggcaacaggcaccagaggcaccttggggaaaagaaggcgcagaattgcaaacctcctagcttaattgcttaaacagtgagaaattgctataaagcaactcaaaatcccagttcaatcaacaagcctataaaaacgcacataaatgatactcctaacgtaataatttgaacttcaactacacgcaattccttcctctgaatcacacaaacagcaaaacgaccaaaccctaatccgcattcgcaaggaaacacacctagcttagctcgatcaatctgctcacgaaaaaggtatagaactaatcaagtagccgcttatacgcgggaatctagctttccccacaagtgacactagacgaatcgcttgaatcaccaaactccaagctacgaatggatctggagtcagggaaaatagaaggaaaggggggcgactgatacgatacgacacctgggctggtggcggaaggcggcagtaggcgctgtaagcggcgagaacttgctgctccggagcgcgcggcgctcctagtcggtgaggtcgccgaccgccgccatgacgccgaccgctccgcacgatcgacgtcggtcggtggaggtgtgccaagaggaaggcggcggctagactcctccggttcagttgggctcttggaccttctttgggcgcggtcggagtcggaccggactggaccggagcgtgtgttgtgttttgactttttgagttcaaacgggaggagtacttctgtatgacatacaggtgggtccgggtataaaaattcacgcttccgcgtaaactttgacgaatttttgtactccatactgttttggcttctacgatagaacattcatatggctagtttatccaaaacttggacagctagttcaaaatttggcttttaataatttccatgtgcttcagacattcatatgatgcaggccaagggtgtgtttagttccacaccaaaattggaagtttgactaaaattgtaagtttaaagaaaaaagttgaaagtttatgtatgtaggaaagttttgatgtgatgaaaaagttagaagtttaaagaaaaaattgggaactaaccaaggactaaatagtgcgagattctccgaagaaaatctgcaaagcatgatcaatgaatacaattcatccaagattcagaaataggggaatccatttcccaatcccacgacatgctaagaattgatgtagtagtattaatgtagcacgcattacacaaagctcgtcggatcgagaaatcacaaagatgctccaaacttataatgccaggacaaaagatgttcagacttattgccatgttatgtgctatcattgaacattttaacagttgaactggatgtattcacaagatcaccgaagccccggagttcagatggtagcagctaaagctagttctgccagcatctttacatcacatggtaactcggcaactacattacatgtataaaagagcaaacaaaatgacgtacacagttgaggatgaccaacagaagattcagctcaaaacaaagctagtattactgggtagtacggcaagcatgatcagaaaaatcgatttagacatagtagatcatgccgacttcgacgaggctaatgcggggtatgtgcagcgccaccgcgggacccctgcagtt

SEQ ID NO: 51159 - DNA, 8391 bp, Oryza sativa
  unsure (1)..(8391): unsure at all n locations
aggagatcagccagctcgtcccgcacctgggggtcgatccgctcctcctccgcaatctcaaaacggactctgcgacgccggctgagactaccggactcctgctcgtagatggactggaggctccggagcgtctccgacctgctgctccttgtcagggacgtgcctgaagcctcgttattggagtccctcatcaccagaccggtgccggttgtgtcctctgtgtgtatgacagccatcctcccttccgaagattcgtagctcccagaggaggctgcctcctcggcttccatttggatgaacttggcaatgctcatcaccaagtggttctcaaagttctcgtcatctttctgcacatctttgtagccatacctcacgatgcaccggtacatacggtattccctggggccgatccgtccaatgaggtaccgttcgtcctctggaacgaacggcacaggtacggacttgacgcaaacgaagaccagaacctgatggaaagcaggcaggttggtgacaaagtgcgagaagatggaaggcaccccggtgaccagctctgtgtagatgagaccgattccaggcacccgaacgatcccaaggctcggaccaagtgtcaggatccatttcattgagaccttgttctggagatcaaacaggtacttcctccgagagccgtagtgccatacgtacatgacgagcatgaacacgaaggcaaatacgattggtgcccatcctccctgaggaactttagtgactgctgccgacaggtacaccacttcgattgacccaaacgccacgacaaataacaaggcgagcaggatgtttttttgccacacaaatatgataaccaatgccatcaaccaggtggtaacaaacatcccaacgatacacgcaagacctgaaatcggcagaggaaatgacaaatgagttgcaataggagtaacataatactaaatatagcatgagaaactcctttgttttttgagaatcagataagagagctatcatctctcaggagaaaacaagaaagctaataaactagtctagttcaaaaagatgcaagcatacattggcatgcatcgccaaattaagttgaagagtgtcactattaagtagtgacctattcagaaaaataacagctggtgcacctattatgccccatgaggaggaaccaggtagctatatgaatgtgattctgaattacagaattgttgtctactataattaataatgcacattcctttaaccttttaattattcaacattggaatataaattcaaatttacatggcatgctggtaataggggatctaaactgtttgaatttataacctaaagcagtcctatagtccatactgttttcttagctactgcagtattgaagatctgagttgatcaaagttaagagtataaagaagtgttcaaacttaccgtaagcatttccaataactgtcgtgtctcggaaaccaagtgtcacagcaagacaaagaaccatcagaatccaattaatctcaggtatgtaaatctgaccatggatccaccttgatgtatgcacgaccttaacccgtggaaaacatcccaaagaaagacactgcttaacaattgaaaaggtagcagatatgatagactggctgcccacaaccgctgcaagagttgcaatgacaaacactggccaaaacagggatcctgcaaatatgatgcaatatgaagcaagaattcttggcaacatacaaaacaaattattccaaaatatgcttggagttatgaagattacttggtacagattggtaaaagctatcttctacagctgacatgtttctggaaagaaatgcagcctgccccatgtattgcagcacaagacagggatatatggcaccaacaaaagccaactacaagcaggacaagagctggagtcacaacgatagaatgacaaataccaccttaataacttaggatgcaatatgcatccccaaaaaaaatgggaattttatgttgcaacttgcagcataccctaatagatgcagcagtgaagtggccaagatcagcaaacatagcttcagtacctgaagtcacagaaattattaggaaacccattcactaaaattgtaagataaatggcttgagccacatagaagggctattcaaattcacctgttatagcaagaagtactcctccaagagaaagccaaccatcttttcctgtcatcttgaagaactttataacataatgtggagaaagagcaagaaatattctgtggttccagtggatgatattataaagcccaataacaccaatactcaacagccatactacaacaatgggcgcaaacataaatgctaccctatgagttcctcggtgttgcagtgcaaacaggccaacaagcacaatacatgcaatgaacaccacccaacctgcacaacagcaagttagttaaggtagtgaatgctgttcactgaaagaaacccctagtaatggctgctggaataggtaactgcactaaaaatcttgtatggtctcctaaaagaaaattgtatgagagagagattgagagagatctaacaggttaaatctacatcaactgtagtagcctgcaaattcagttagaattaagttctcactatatgactcgatcagacaaatatgctcctaatatggtatccagatttaaaactttaaagcagcttgatgatactaatgaacttcaaataagaactgggtattttgattcaaataagcatcttgtatggatgttatttccaggggagatttataaggccaaaggccaaagcggatccaaagtttaggaagttcaacttatgacatacagttagcaaaaaaagcaggtaacttacaaatagccaacaatttgcgacagtgtgtaatgattagaaaattagcaagactagatggactactttcttaaaacagcttgctacagaaaatgaaatgattagaaaatgctggtgctagggaatatgttgagcaaatttcttagcagctcataagcagtagaaaagacagtgctaaggcataccatctggtattcctcctgggccagggtcttttaaaccagagatggctgacaagactgcagcagacacaacaagagaatttattagcaaaaccatccaggtgaaaaagcatgcgttgaataattgaaaaaaaaaagaaagacgaagctaatctaatgtacatgccaggcataccagagatagcaggtgtgaaaacaccatcacctatcaccatgcatgcgccaaacagaacaaaaagtagtaaacaagtccgtagcttcctgtgcttctccaggaatcttttgagtggagaggaaataatgccaccaactccaggctgatagtacgttgaaagctcttcgtctgccgattgctggtttggaagcaggctgaactttgcatgcctgcagagaagtgagtataaagcaaatgttccacctacataaacaaaaattataatcaatcaaaaaacatgataaagatgactcttaaactaactagacagaacaatgcataaattcgttaaagaatggagtagcatatttattgacgatgacatatgtgagttgttacagaatatgatcctctatatactcctgatcggcttaggcagatgtgcacgatcaaaactcaagcacttttgggagttgaagaacataagttaaaatacaacgtatgtgtttctgttaaaattctgataacccagcatatagtactatgaagttactcacctttcccattatcatctgcgttcaatacaantattacatactccaagcacggaagaagtgtcaaagtccaaaatatcagcgaaaacaatccaaatatggttgtctcatcacggtaattattcagcctcccagaaaatgcacttttgtagacgtacaggggtgatgtactcaagtctccatagaccacaccaaagctctgaaatgctagcagagagatagttctgcaataacttttccattggtcctgcaaaagcacaatcatcagtacgccgaccctgtgattgtgaatagtaactattactgagaaccgatcagtacagtccagtatgtaaaacaagagagaaagcagatattggtagctgggcatgtattaaacagattattaatttgatattggtagctcatacttttattagactactcttttgtcgaggggaaaaaccaacaactatagatcacgcaaatttagaattgtcgggattaaaagtggtagctgtacacgtctcaataaaaaaaatgtgatgccaatgcgtcaacgcagcaaaaatgtgtaatactaatgtactagccaaccccatccccaaccaaacaccaaccaaaagcacagttgacttgattcatcaactacatatggctctaaaaccaagctggttctcagtttcagcgaatttaagcgaaacaagttcaccggattgatcagcacgaccgcaccgtctcgtattcgattgcaaacagtaactcgccgcaccccgcttgaaatcgcgaaatcaaaatcgaacgagaaccctctcggaatcaaacgcgagaccttcctgacggtaaaaaggcgagcaaaatcgagacgcgcgcgttatcacctcggcgtgacgaccacatcggagtcctaaccactcgcggagtcacaacacacaacccacccaatcgccttatccaaaaaaaaaaaacaactcctcccaacaatgaacagatggggaaaaaaattcacagccccttctcgaaatcgagcagaatccgatccaccaccggagacgggttgggggaagttacctgcggcgcggccgggccggtctctgcgtccattgcgctcccccccccccacccaccgtgacgacgggctgcaccgcgaagcaagcagccccagatcaaatcagatcaaatcaaaaccaaatcagctaacccgcgccttggcggccgtggggtcgcctcgccggagcaggagagaccacgacgacgacgacgacgaggaggagggggtggggctagcaagaggagagaagcttccacgcggcgcctggttttatagcgaaggagagcgcgcgcttggagagctcacgtcgccgtctcgacgaagaacgcgtaggagcagcgtggtgcggcggcggggaggcgggggcggggtgggccccggcgcagtgggttttagggcggggcgggtgactggagtgtggggtcaggagatgctgccgccctgcgggatggtgggccaggggtggcagcgagacgtgtgttgccagccgggccgagaggagcctgcccggtcgtggcctggaccgtggggccccgtatcacgcggacacctagacgcacgggtgcaattttgacacgagcggctgggatctggtgtgccgtagctgacagtggaccaacttgcggtcaggatgtactccctccgtaaaaaaaaaaacaaaaaaaaaacactaaacgatagggcacagtacaatgaatatgggcaagacgccaaaaagcgacctcttgcgccatggctgcgacaacctcagaccaaatgcaccttccttttttttatagggataggcttcgtggttcatctagataataatcaaacacccgaataaattgtgcttggtggcaccttgtatagtttattaaacacctctctgtagctatactcccttcgtggctctgtcctagaaaaaaaacttgtgaatacgtatttagatatggttagaaattggtttttttctgaataaataattgttaactactacagttgtatgactgtagagtcggttgaggatgctcgtgagagcttacatcaaaaattggcgttactcatctgccaattaccaacgagcttataatggttaaaacctacttccttggtccaaaaaatcgaatctaggactggatatgacatattctagtataataaatctgaacataggtatgtccagatttttagtattagtatcatactagaaaaaatgcccgtgcgttgcaacgggtaaaaccatttttgtattgatatacattgtaccttttggttttggataaaaacttattttcttccttcctattcagtctcggcccaacccgctacttctctctacttggcttacttcttttgaacctagaccacaagtagagctataggcctatctcgtatagtcgactgccgtgttcaacctcgaagataggaccgtgtagtatgatgccagaaccaatactccccatcaaatacgatccaatctttctcaatctcctaaaattggttgagtgctcttattcactcgatcttttctttccgtttttatcaaaaccgcagcgaatccataaaactctaggatataaatggtgacttctaaatatagagattgaatctgataaattaaagcggaaataaaagaaaaaattatggggaaaatgatgatggagtagtggagaattgatttttcaatcaattggaggagggaaagcatgagaaggccgatcgatgtggcggtggtgctagagttcggcccgacgacgaaaaaaccgggtagataaaaaaaaagaatcctcacaatgtgcacagaccctttctcatgacaaaaattgcgaataaaatataaggacaaaaaaagcggatgggaaaaaaataaaagcggaaaaaaagaagaaaaaaaaggcggataaaagagagggacttttttttgctgttttataatgtgtttttttctctggtaatttttacggtcttttttctacaccgttttttaacacagtttcttttttcgcgtggctttctttattttttttacgatcggcgacttttatatttttgtacagtcggctttttctgttttttcagcttttttccgccacattatttttcccgtttccagtccggatcggactttttttcgctgttttctttcgcgtttcattacgatgcgttttcttttcccgcatgattttttttcaccctttctaaaattatggaatttaagtagtagagattaaaactgaaaaaagtattaaaacctactcaaatacagatgacgtaccaaaatattggcaaaaatatcttaaacttttataatatgtaaagattaattactaggttattttttataggagagggagtactctacatagttagtgtggacgttctaatacgatggaagtatgatcctcggttgctgctaccaacagaacttgcaagctattcaatccgacacctcgtttgagcacttgaagactagggctgtgtttagatataaagtttagatccaaacttctatcacatcaacatgtcatacacataacttttcagccacatcatctctaattttaacaaaaatttaaactttgcgctgaactaaacatagcctagaattattaccaaaccaaatccaatcgtgtctctttaatatatctgcacgtttattctacgaattcatagtagtagctctataatctacgtacggcttctttgccacggaatattatgatgaccattaacgatcaaactaatttcaacctgtggtcaaaaggccatcatattccgcgtgaattaattgagctgctttttcagatgaaaacgaagataaaaggtgttaaacactcagactccgtgactatacgtgcgtgtactgaactccaaagtccaaaaacgtcctatcttaagggcgctcgggactgaatcgtgcaaaattctgatttgttcatttagtttttttttttggtcctagcggaacttgattcgaatagtcagatggcgtgtcctaaccaccttgtcaaaaacaattccggccacataatgaccccagtgactccaagagccgtgatataattaataataagataaagtacagtgctcgtgagattgactacaggatcgcatggaaccaagccgatctcacaaattagattggaaaactgcaattattgagttaatatatgcacagcatatgtcatctaaaaaaggagtatacagcacaggatccttattttaaaacccttttgacaatgaccagcacgtttcactctactacaattctcttacctccgtcgttttccacgtcgtgtataatatgttcttggtcaaaaaaataacaggtgctcgctgatttattttataccaacatttatatattcttcaagagtttcgagcagctcatatatcctttttagggtgtgcttaaatgaagtgttggcagcatggcaatatagaagatttgtgttgttttcgcgtgcacgcttttcgaattaagatgtattttttaaaatattatggaaaatttgattaaaaacatatactaaaaaattttaaataattaacactcaactaatcttttttatcaaaacactcaattaatattgcactaatgcctaacctcgttttacttattttcctaatttttttattttatta

SEQ ID NO: 51160 - DNA, 3756 bp, Oryza sativa
atgcacgcggcgtagggctccggggcggcgccgcagcgggcggcatggaggacgacgcggagctcgaggagggggaggcctgcggggacgagacggccttcgtcgaccccgacgtcgcgctctcttacattgtgagtggtggcccgagcgaaatgcccgcggtttcctctgctcctgttgagttcgtcgcggtttctatgcttgtttggtagttgcccgatgacgatttaagcttagttgagtagtttgatcggttatattcgtttagagaacggacatgtctagcttaaattttatgcttcgtaggagtgatgctgctgatttagcatgggaatgaagtgattgcattgatgaatcatttgaagtctgatcaattcgttgcttcggttgtcggatactggaaacaattgcattggtgcagcatttaaagtttgctctttctttttttgtttgtttcgtagtagttgttgttgatgatactatactagtctatgtagatgaatcctttgatgacgctggttattatgtaatagaatgtgaatctactggttgcaattttggtattttgtgcggtttattcgagattggcagtattagcataacattttatatggtggaatcaatctctcctccttttcttttcccttttgaactgccaggctgaattcatggtgctattacttggatttgttcatgcaaggctacacgttatttttgatagcaggactatgtgcttcctcgagctacttttaatggatcaaacatcactcttagtctacaatgcccagtgaattaattaaatacgcttatgttttgaggttactgtcaacagttactttatagtaatgaaacggaattttaaactcaaaatttccaatgcatgctttatatctgaaatcctttggaccagaagaaacggaaagggaaacaaattgaaaaggcagaaatagcgaagtgtttaattatcaaaacttgcctataggtaggttgccttttatggataacttgcaacatgaatgcgatagacaccagcaactttcacttgaagacgatatattgtattgtgccaacaatcaaatctgttgaatggttccttttttgttcttgatgtgcttttttccctcaggatgaaaaaatccaagatgtacttggccattttcagaaggacttgaaggagctgtatctgcagaaaatctaggtgagcagatatgagttgctgacgtagtcattttcactttggtacactatagagagacattaaaacaggggattaaaccatgacaggatcgaagtttggtgggtatggttcattcttgcctacttaccagcgttctccgctgccccaaactagaagtccacctaaggcggcaaatgttagctcaagatctccttatcaccagcctacagaggtgcttaaattagttttgactgtaaacattcaatgttttaaaataatgttctgatgagatgacctgtaatttagagcatgtcccagaacactttggctgtggcagctccatctgtttcaaaacataatggttccatggtgccactttctgatgattcaagtaagaaggaagtacatcaaagcacaaaagttgaaagagcctctagcacccaagattcattgaatgggctatctaagtctagtgaccacaatagatttaaagttcggatcaaagttggttcggacaatggtttggcaagaaacaatgcagctatttacagtggtttgggtcttgatatttcttcaccttcatccatagaggatagccctgatggctggggagcctctctccagaatttaacaatgtgccaattgaatctcccaggaccattcttcaggtaaattactgcatgaactctttgcacttatttttcattatgcaaggttcatacaatgaataactgtcttcattctctaaatatatggaacagatcatgacatgcttttcagttcctggagggttcttgttatcccctctgcgagatgatcttgttcaactgacacaaaaggttgtgcctacatcaaagaaatgggaaacaaatgcaaacacagaaaatgtacaagaaagatatgaagggtatgcggctaaaagggtgaaatctgatgctaagaaaaagaaagctgtagatacgaagaggtcaaaaagcagaaatgatgtcagcgcagttatgaaaaatgagattgatatagaaacacctgctggtcaaaagatcgtattggaagctctcaacataccattgctgtctaatcccagaaccatggaggcaaaggacggagccagtttgaagaggatcctatgcgagacaccttggtggaaaataaagatgcccgattgaaagaacggaccatcacagtgacttaatggcaatcaaatatgaaaatgtcaaagccgaggcagcggaatgtttagagaacagtggtcctggcagttcaggaatggatttttcagcagtcaagggggaagtgaaattcaaggcagaaaaagcagagatccatgtagaagacaggaatactactagtgaaaaggacttccaatcggatagaaaacaagaaagaaaaataaaaacagagagtaagtgcaatgccacaggagttaactttgaaggtaacaaggttatgaatgaaagaacacctgttgtcggcaggagcataggaaaggtttctagtaaagaaacattacttaatgatattaatgaagaaaatgtctccaagagtgagtccagaagaagtcagaaagagcaaaacatgaatgcttcatcatcttctgatttcctggaagatgacaggggtgtcctttcttctggtgcagttaaggagaggaaaaatgattcgcaatccaaatctagccatccaggaaggaaacccaaagcaaaatcacatagagatgttagggagcacttacctgaaggatcttatggaggcaaggatgatacattggagaatggaagtgggctgggagagttacggccaaaaaaaatttggaagaatgatagtgagagggattctgatatgcctgggacatcaaaaagggaaatttcatctagtttgaagaatgataggcacacacctgctgaggagcagaggatgcatgtacctccatctgttagtgcacctactgcaaatgcagctcctatgcttcctgcccccgtcgtgatagaggaacattgggtatgctgtgacatatgccagaaatggcgtctcctgccatataagatgaatccttctctgctaccaaagaagtggaaatgtagcatgctacagtggctgtaagttcaacttttcaaatccacatataatcttcaaatttcgtttattttagtaccttatgttccctttatacttcctgctcattttgctgcctctcttattacttcattgaaccaatgagtgtatcagtattcggtagttagcataataacatgtaataagaggcaccatgtgcattgagggttgtttgattggactgcctaaaattactccatccgtttaatgcatatgtttgattattatttctcctaattatatgttctcaataaatattaaagatataatggtaacacaatgcttttaatgagaaacatactaatgccatcactaaaattgtattacatggcgaactttctttccgttctatctcgaatgcaagaaattttttgggtggagtgactagtggctacaggattggagtttgggtatactcttttaatggtttcatgtgccccctatatgcacctgaactgtttaggctg

SEQ ID NO: 51161 - DNA, 15387 bp, Oryza sativa
  unsure (1)..(15387): unsure at all n locations
ttggatatcataaacgagcatattggatagattttggcaagtcataattaagtttggtttgaaggtgacttgtgaaatgtttgtcgggaagatcttttttctgtcttaagtactatacttgttttacatcctgttgtgatgttgctcatgaattctgctgcataaccttattgctacatattcaaatggcaatgccgttatgtggagtcatatggtgatgaccaactcattccattccccaaaaccaaaaagggttaggtttgggattagaatctaatgaccctaaaaccctgaagtgaacacctcataacttgatagtacgttacttacagtgcgtcatgccatcgattacagttatgatctgatgactctgtttatattcttagacaaatgatgtcaactgtgccttcgatgcaactcggaaatcacagatggcaattgcttcggctgctagcaaccaagaaaatggaatagatggtctttcttcagtaaaaacagttttggattttaacttccaaagtgtgaatgatctactaaggctcgtgcggctttcaatggagtctatcagctgctgacatgttcagaatccaggaaaatgacatccctttacaaggtgctgttggatgtgcattccatatttgagtaatgtcccagacttgccagtagcatttggttgaaaagttcaactgtgcgaaattcataggtcttctcatttaagtgtgctggttaatttgtacatgaagtgttagtcttatcttctattcggaggcctgtttttacccattgctagcatctagttggatggttttatccatgagggaggttgctgaagatgtgctttgcagattgcactgatcaacttgattttgggcaagactgcctagttacagactgcacttgataagcttatacacaatgctactggacagcagctcctttgtagataatcttctttcctccatgctgtaaatgatgtattttcgtcatggagttgacttatggttgaatagtatcatatgttcctttgagaagggcaaaatggtggtttccacttagcaattttgatggtacgtttcagttacaaataaattaagttcaacacactctccgcaccactaatgcttatgtaatgtttgattctttagcaggtcagaggacaaaagtgttaattagtgtgctaaccaagaaatcagccagtggtgtctctttttcagtgccacttctggataaagttcaagcaggtaccttcactgatactatagtaccttagtacattcaaaccttgcacctcatgatagtgcggaataaaatgacttcttgaatgaattggtctcatgctattctgcaaaggtgaaaatgacctcttcattgataccatcctaggtgtataggtgccctgtgacttttgcagtaaattagagtatatgcttaagtgctgaaataagaacattgtaattccttggttcttctttctgtaatgctttctactctgtagggttatactataatttacatatgcatgcacacaccaccactgtaaggttcttcgacccaaaactagaactgaaagttaggaacttccactatacagatggcagcacctgaactgaaaatacattgattaccattttccactccttactcctaacagtaatcagtgatgtttgtcttttctttttcagatttcaaacaagaaatcacttggaccatcacatgtgtatgaacaatgtacaaagattttcatgtacaataggctaactcgttccttgactatcagtacgacgactataaccagcgcgtgtacatgtatatatacccgaatggtcgaagcgtttgtcttgcgtgctggtacactcgtgacaccaatgtacttttagtccacatttttcttctggcaaattttgttagtttcacattagtcgttgagatgtgatagaacttatctggactgagaatgtgttgcagaatgcaaaataagctctgtattctgtactgtttgtatcgcgaatcgcatcttcagttcagttgagtaaagtgatgctaattttagttatgcaattatcctttgtttattctgcaaatgaatactgtggcggcaacgtaaatctgcatgtccacgaaatcatgctaaaaactactcacatggcattctatatttaaaaaatgtgcctgctcgatcgtatgctgcaatgcaaatgtgtgtgtgtgtgtgtgtgtgtttttttttttttggtgggggggggggggttacaatttcgatcagaaaaatcatcatatgctgcattgcaaacttgttaaatttggggttggtttcgatcagaaaaatcgtaaaaagacagttatgcaccacagttcggtttcgattaattttatactgatgtatcagatcaagatcatttccatttgcgaacaattcttcagaaatttcatctcccagcctaacacatcggccactgcgtatatctcttctgtacgcggatgcgtcgtgtcgtccgacgaaaacttgtgcaaatgcagtgcctcgccagcgccggcgtccacccagctgaacccgatctccttcttgacgcctctgtccctcatcttcctcctcaccttggcgacgccgtcccagtcgcccacgtcggcgtagatgttcgacaggaggacgtacgcgccggactccgtcggctccttctccgtcaaaattctggcgatcctctcgccgatctccgcgtcgccatggattctgcaggctccgagcaagctctgcagcgccgacacgctcggccccgccggcatccgcatcatgagctcctcagcctccgccagcctccctgcccggcctaacatgtcgacgacgcaggagtagtgctccggccacagctcgacgccgcgatcggcagccatcgagtcgaagatgtccctgccggcgtcgaccatcccgccgtaccggcaggccgtgaggacggcgaggagcacgacgccgtccggtgcgacgccggagcgcgccatgtcgccgaagaggctcatgacggcgccgtagctcccgtgcctggcgttcgccgagatgatcgccgtccaggcgatgaggctccgctgctccgtctcgtggaacgccttccgggactcttccaagttgccacgcttcgcgtacatgtcgatgagggcgccggcgacgtactcgctgtcgccgaagcccatgctgagagccctggagtggtacatctggccgtacgccatggacaccgtctccaccgcggtcaccgcgctgaggacgctcgcgaacgtggtctcgttgggtgtcaggcacctggccatggacgagaagagctcgagggcgtcgttgcaccggccgttctgcgcgtagcccgagatcacagcgttccacgcgatgatctcccggcgaggcatgaggtcgaacaccatcctcgcgtcgtccatgcgacgcgccttggcatacatggtgatgaggctgttcgacgccgccgcttcgccggacacggcggccttgaggcacgccgcgtggaccatctgcgctcccctcgccggacagtccgtggcagcgccgacatcagcgccacgaaggtgacctcgttcggcggcacgccgtctcgccgcatgccattgaacagcgtgagggcgtcctcgccgtccatggagatggccgtggtccatgacacgacgtcgcgctcgctcatggcgtcgaacagcctccgggcgctgccgggagcgccgcacttgtagtacatcgcgacgagcacgttgccgatggagacgtatccctcgacgcccagcttcaccgcaaagccatggacttgccggccgagctcgagcttcccctcgccgccacatgccgggatcacgctgcagaccgatatccggtcaggctggacgtcgccgtccctgagcatccggaggaacacgccaatcacctcggccgggcagtcgccgtcttgcgcgagcccgcagatcaacgcgttccatgagacgaggtccctcgccggcatatcgtcgaacacactcctggcctccccgagagaccctccacgtgagtacgcagtgacgagcgcgttgccgacgaacacatcagccgcgagcccggaccgccaagccagcgcgtgcagctgccgcacgaggaagccctccccccggccggcggccagcgagagcgcgacggtgcacgtgacggcgtcgggccgcacggcgccggagcggagcatccacgacgcgaagtcgagcgcctcggccgggtcagggaacgcggagaggatggtgttgtaggagctgacatccctcgcccgcgccgcggcgaacaccccgacggcggaagggaacgacccggtcttggcgtagcgggcggcgagggagttggtcacggcggcgaagccgtggaggccggtggttacggcgacggcgtggagcgccgggagggaggccgggtcggacgccctgacggcggccgagaaggcgatggggttgacgcggcggtggcgggcgagcgacgggtggggaattccgtcgaacgggtggtgggcggcagcggtggagagcgtgcggatccgcagccgccgtagtggcatctagtgtagtttttcaaccacggatttgagatcctctcactaaagtcacatgattttgagtcactgacatgtgggccctctttgttatggacccacatgccagagactctagtaggataaaagcccaagggccaaacccctcctcttcttcctccggtctctcgctcctcgcgcaaatctccggtcgctgcagcccttcggccatggcggcgtcgtccgtgctgcagcctgcggcggccgccgccgcgtggccgcgcttcctcccctctcctcgccggagcgccgcccaggtactaaggtttccttcacttcttaggcctgcaactcctgtttcgtggcgtggggcaggcaattcgtcgaatggcttgtggttgggaagaaatcaagaaattgcagcgcagcgacagtaaaattctagggtaattggctaaggtagtgaagatgctacattctcgggaacgaatcacctgaccgggctgaaatctgtgtagtgtagttcaaggcgtactgtaactttgtaggtgcagtttgtggtgaaaattttccatctcgtgtgttgtttgaaacatgaaactagctcagtcttagcttgaaacaacaacagaacttacttcttggtgtagaaacgttaggtgtgttgtgactactgactagtttcccataattctgtccccctttttggccttatccagttgcaatgtaatcttatcagatgtttctttcaggaagagttgcttgatacactaacagttcaacacaatatccttttgatgtttatgttccttgtatacaattactctgaatgagaaaccccccatttcatattataagatgctttgatttttttctaagttaaacttccataagttcaatcaagttaaagaaaaatatagcaactcttataacacgaaattaattctattaaatctaacatcgaatatattttgattatatgtttgcttgatgttaccatgtttctatgcttttctataaatttgatcaaatttaaagaagtttgatttagaaaaaaaaatcaagtgtcttgtaatatgaaaatggagggagtaacaccctattagcatccctacaacaaatcactgattcctgaactattttgtggttaaattaaaggcttctgaatagttcttatttatatccgaactctcagatgtgtcatttattcttggaacagacatatcaagttctttccatgcacaagtttgagtggaagcgccctttcagcggtaggtaccaacattcgctgcaatttacaacattcagtgacaggactggagttgtaaacttgtaattcaaactttggtttcacatcgttgccctgaagtgttgagataaattttgtgactgcatctgcaggttcacaccggtccggtattcttcttgtttgcagaagttcaggttcctctgtaaaagcagctacttcaagcagacccgaagctgtttcctcttctcataacgatcaatccagcaaacatttatttggttctgtttcagatgcttataccattatctctggctattggattggccctgatatggatgatggctgtggtaatgttgtggccattctccaaagaattgtatgatactgcatttgctgttaaaccacatgaattttctggcgtttgaagataatttttatatgctagatcatcctccacattaaagtatatccataaccttttccaaacaatgcctatttgcccggcgaaaaaaataatgcctatttctgatcgtattatttcttatatgaatcaatgtgccactgcaaatggtttaatcatgtgtcattattggtatgtttgcaaaatgtattgttagattctattccagttggcctaaaagtgcaggcaggcttgtttaaataagatctgagtgggatagaactagcagagtcttttgttacaagctacttgacacaaattcacagaatcacagtgatatttacatggtactattatgaaagataattaagaaacgacttgccaaagcaagtcttctcgtcaacttagcatatagactagtcactgaaagtgggcccactcacctcctatatagagcagtgtacacctggagctggagctcaagctatagctcaggtgactgacaatggcgtacagggccttggaggtgacgctcatctcggcgaggaatctgaagaaggtgaacttgatcactcccatggaggtgtacgccgtcgtctccgtctccggcaacccgctcgcccgccagtgcacgctccccgaccgccacggcggccgcaacccgacgtggaacgccacgctccacctcgccgtccccgccgccgcgccgggcgcgttcctccacgtcctcctccgcaccgagcgcgccctcggcgaccgcgacgtcggcgaggtgttcgtccccgtcgccgacctgcagctcgccgccgccgcgcactaccagtacctggtccacaaggtgcagagcaccaccgagcactgcggcgtgctcagcctgtcgtaccggctaggccccgtcgtcgtgccggcgccgccgctggcagcggacaccggcgctgtcccggcgtacctggtggtgccgtgctacgcgaacgcgccgccgtacgtctacctgtcgccggccaatcctgcccgcggcgaggccgcgtcggcgtcgccgtcgccgccgccgcggcgcaagaggagcggtgactttgggcagtggctcggcggcgccgtccggggaatgttgtccggcgaggccatgtcgccggacacggcggcctacgacgccgggtacaaaaccctgatcggggtggctgatggcagacgtgtcaagttctagctagtaggagtactattccagattagcgtggcttgaataaaatggaaaaggtttcttatgtactatttgcacgggtgggagaactaacctttgaactagcaagtattgggtgggaaccgcggtagaaatttatctcttggaatccacggttagatcgaaaaatggacgtccgagattcgtccacgtcatcattagtaaaaaaatttactaattatgaataaatgtatgagtaaaatttttacttgtgatnangtggtngaatctcgaacgtctatttttcgatccaatagtagtttctaactttccaccatatatatggtttccactgtatatttttcctctttttactaatcagtagcacgttttcttttctttcttggaatatttatgcattactcgtcattcaacaaacatactctgcatgaaaattcatcgccgatttatttaggtcagtttggacgccttaggtggacaaacgagaatcgacagtcccttgttgatgccgttattccaaggagcgcttctgatagttgtgattttttttctactctacccattctaaaatataatatttttatgttatttagcaaataataaggttaggttaaaaaaattccttttcaagtcatttcatttgttaatgttttttatattttgaattggtcagactttctttctaattggcttcaaaaaaaatgatgagaatcatgagaataaatgcataaatgcttatattgtgatatactccatccatccaaaaatatattagtatctagcctttaaaattgatcttaaaatataacaacttctccatctgcattcttttctcagccaatcataatatttcaccattcaaatttcctacacactttccctcaaaaaaaaaatttcctacacacatccttttctcaaccaatcataacattctccaaatttaatttcatcaactttctaaatacccgtgttcaaccctaacaatctctaattttatgacagagatagtaaaatttgaatcctaaaaacacctatattttactccctccattttatattgtaagactttctaatattgcctatatttatatagatgttaatgaatctagatacatacatatacatatgaaaaggaggaagtagaacggaaggagtagttgttatagtgtaagttgttgcaagataattttgtatactcatgttgtctagtttttttcctctaattttttttggggtacatgtatttttttagttgatgcaaagggtggggaatttttattcgaccattaatgaaatatttcattgtctaaaacaattcaacagatatctcaagatttcaaacgtattttgaagttgtttgattcacgtatatccaccggtgtcaatgaggtttaagtaaggcttgagcaggctccagtgccactgagtaattaactgaccaaaaccaatcaggacacagaaatcaacctgctaaaccacatcagaaaaaataacaaattgaaggagacagcagaaacaacatgcatatgttcttgcccgctcagattatttcctctggatatagatgaatcaattctgtccatcttgcatgagactatgtacagtcatacagattatatctgaagaacttgctaataataccgcatcaacattattcacgatcgagcatacgcaccccggcactaatctgccgaagaccggtcaggattcggtggttaccaatctgtctcgatcggtttggcattattcccagtgcagtgttaccttgagcatctatatcattctcatgtaattaactggattcaataaaacttccttcatcttaaaaaacctggggaatcttcagttttgcatcattcatgatgtcatgatgatgatgactcaattggaagtttggaaaaagttttaagataaacacagtaattcttcctgattcttttacggttactctctagactccagtggatttattctcaggagatatttatatctctcatcattcaagaaaagatatttctgacgagaacatcttcagttaaaacaaaaagaaaagcagttacactttcactacttcctatagcacattcgagcagtaaagccggttaaggaaaacaactccaagttaaaagaaggaaaagcagttagactttcacttgctacagcacattcaaaggctgagtagtaaaaaagccaaaaactcgcatcttcagcaacacgcgaaagaagaataaaccatttaaaaactcgaaaaattgagccagacaaagatatggtatcgatcctctgctatgataatcatcgaaaattatggacacgcagcactagaaaggccagtcctgcaagaactatatcctcaagctatcatctatccagcatcagatgcctcctgatctatcctaccattatattcaaacttatttgataaaaaatctaactgcaggaaacctccccaatcagggagagtgatgataatatgtaggctgctcgattattctccattgaatatttgaatggctcaacaatccggaggtgttgctttgtggatcttttaggaaaaagttattccgatctctacactaattagaaatacacatgttgtttaattatagacattagaattcaaacctagtaaactctgcttcactaatagtgcgcttttatgtacttaaaatggtccgttgaattatagatattagaatctaaacctggtaaactccgctacactaatagtgtgctatgtacttaaaaaggtccgattggtggctaataagctcgcaccaataagttattactcaaattacgtagttacatgtatttctaatataactagtagtactagcaaatatgatacattatcactcactagtaattactattatagagcatcttaaatctcatctcatataaatatgatacgcataattatatcaaatcatcatcccgttcacatcatttacacagtatctcaacatatatccatctattatttcaataatatttgtcataaattgatccatacatatcatagtaaagcgtgggtatcatctaattacattaggttgaacattcatatttccaacgatactcacttggaacatgtttgaggatgattctagttgttataccgtcttttaaaatcttcaatcaccctaaacagtttagattctcccgtagatatcaaattctataaatatgtaactgtacaatctagaaaataagctagtaaaaaccaaaagataagaaaccctctttctatattctcgttagctgattaccgataaattgcttctcaatatttttgactccttaagacatttctaacccaatgactaagatagtattcatagtattaaataagcagccacctaaaatgaaaaatgatgtgacaagtgaataaatgaggaaagagaagaaaaccatgtcttacatgagacagagtttctacacaacatccaagacatcatgtgatataatttgcattaaatttgagtatggaatagtggtatttgcattgaaagagtagtgtctagtattagtttcttgatgatgtgaagtttatgaaaactgtgtctagtgtcatgggttaggaatggccttataacaagtttctagttcctgctttaaccaccaactttctgccaaactttggtactttaggtagttttggaatattacaagtgggtcccactccacctcttatacatacacctgcatgctgaagctgtgaagcataccatcactccactccatcacctcctgcttgagcaagcaagcaagcaatcgctgcagccaactgttcgaccagagcgagttagccatggcgtacagagttcttgaggtgaccctccactcggcgagggacctgaagaacgtcaacttcatctcgcgcatggaggtgtacgcggtggcgaccatctccggcgacccgctgacgcggcagtgcacgccgccggacccctacggcggccgccacccggcctggaacgccacgctccgcttcaccgtcccgcctaccgccgcctccgccgccggctgcctccacgtcctcctccgcgccgagcgctccctcggcgaccgcgacatcgcgaggtcatcatcccgctcgccgacgtcctctccggcccctacgacctcggcgcccgcccgccgcagttcgctcctaccaggtccgcaagctccatcgctccgagacccgcggcgtgctccacctctcctaccgcctcggccccgtcgtcgcgccgcagtccgtcttcgcctacccggcgccgccgccgccgccgccgcagctgttcgagaccgctcctccctcgccgccttacgttcccccaccaccggacgcctaccttcgtaaaccgtcgccgccgtctccaccacccgccaagctgtcgccgccgccaccgccacagacacagacacagccgctggcaaagccgccggcgccggcgacgccgtcgcgagctggcgggcacgtggcggcgctggcgccacctgcggtggcgaaggccgacaggcacgtgtcgacgccgtcaccggcgaaggccgactggcagatggtgggcacgccgacggcgacgaaaggggcgagcaagcatggcagcctggagttcgagcgggggctcaacgccgggctggtcggcggcgccatcggcgggatgctggtcggcaccgagatggtgtccgacgcggcgttctaccacgccggctacagggccgggctcgccgaccgcgacggatgggccgtctactaaaccgtcgtcgccatggctgcaggtgcagcgccatgcatggtcggtcggcgaagatgcttagctgaataaaagtctctggttttctttttttggccttttgagattagctcaataaaagtcgatgaaatttactttggctgagagtttgtaactcttcctcttcggctagtgaattaatcgacttgttgtatatattttgttactggttatgatgtaatatatggccacgaaaatccaagaacatgacatgctcattagaatggcttttgagaaattaaaaaaaagttcgaagaaaatctttgaaaaggagtcgggagttcctgcttttttattatggaagaaagaaaagaggtaacccaatttgttaagaaaaatcggaccctaaaactttatcattgtacgattaacttaagaaaaaccggcaagaatctcaatgaagaaaataacaggactactcaaagacggcataccactataacctagcacccttaggactaaagtaccgatataagtcatcgttgtcaagcttaaagtataggagtacaagcaactccgacttcctattacaaacaaaagccaacgatcacctaatgtagggagcgtgcctaaactctaggaccatgaaagaaaaaccgcaacgacgcatctaagaaggaaaatttatggtgccggtgacatcgcctctaaggaagaaaggagggaaatataaggtgccaatagacgtcgatgtcaaaggctttcatccaatattctccctgccaactacaccattcacaagtgcctcctctatatcaggaggagttaaatgttatcattaccaagctcatcaacccacccccatccatggtcatgacctagtctcgttggatttgtgcaccgctcccgactggctttctacaacattatcgctgccaccaacccgagcaccaagagtcacttagagccagggaggggagagtcgaggcctttgccgtcgccttccttgcaaccacagtggtttccggcactctgctccggcggtggtgagaccccgggcggcaaaatttaaatttgaaacagtaaattcgataaattcgatcaaaatcggttcaaatttcctggctcccaaccccgatatctcactcccccgccgtcgttgtgaaccctgctctgctgttcatcagttgtagacaaattcggactctgttccaaaatcccagtcgatcagttaatccgagacagttcagtatagtgccagcaaaatcagctaaactccgtataatagcaatcggaaacagcaaagcaagcaagcaagcccgaaatcgacatgcttaccaacacgagttcgagtccacttccatgcacgaagctatatatacatacatggatgcatcgagcttttgttgccaaaacaacggaactttccatcgacgatcttgctgagaattgctagctcgatcagctccgatcgagatcatgatgacggcaactactccccccgccgtcgccgtcgccggcgagagcccgccgccgctcgtgcacctcgcatttaacctctactccaccggcttcatcgccgcgacggccaccggcttgcgcgtcttctcctgcttcagctcgccgctcaacaaggtgttcgccagggacgtcgaggtgtgcccggaggacgacggcggctgcggtggcggcggatggaaggtggcgatcgccgagatgttcaacgaggcgttcgccgccgtcgtgttccggcgggagaagggcggtggcggcggcaccgtcgacaagatctgcttctggagcatcccgaacgggcggatgtactgcatgcacaagacgctgccgttcgacggcgccgtgcgcggggtccggctggtgggggagttcctgctcgtcgccggcgacgagagggcggcgctgtacgagctgccgcacgccagcgcgccgccgaagaaggtgaaggtggtggagacggcggcgaacccgctggggctgggcgcggtggtgcagcccgacgggaacgcgcggttcgtggccgccgcgccgcagaggatgaaggggatggtgcaggtgcaccgcctcgccgaggaccacgtctacgtgcgcgcgcactactcctccctcgccgccatcgcgctctccgccgacggccgcctgctcgccaccgccggctccaagggcacgctcgtccgcatcttcagcaccagcgacggcaagctcctccaagcggtatgtgcatatatatggccctgtgctctgcttcgttttcaactttggaatatactcccccgttccagatcattagtccttccttttttattttggtcatagttaaactgctttaaatttataaaaaaataataatatttttaacctaaaataaatatattataaaattatatttaattatatatttaataaaataaatttggtgttgtaaatattgctatatttatttatttattataaatttgattaaatttgaagtagtttgattttaatcaaagtcgaaacgactaataatatggaatagtgggaatatatcgtatatctttatttttttccccttagattgtttattttttcaagtttcatattacagtattgaaatatggtttgcgaataactttacaagaccgttttgtcctttatttttgttagttttttaagtatgtgaaattaatatggcgtttgcgaatatgaaaactttttgggttaaatttgctttagttaactgatatttagttttaatgagtatacttactaaatatgccttgtttgcgaatattttggtttagttttcgctagttagttgatcggtatgaaaatgggatactaacgatctctgtgatcgttacatttaataaccaatataaaatcttaaccggccacccacaactaactaaatacaaacaaccacgcgcggcggcggcgcacgtcgctctgctatggcgtcccaaaacccaggcgacggcggcgacgagcaatcgccaccgccggctcctccgtttccggcgcgccccacctacctatccttcagccacgacgcttcttgcttgatcgccgccgacgaagcctccgtccaatggcgctgctgcgagaccttcaagctgcgcgggctctacgaggagagcggggccaccgccgccgccggtgacatgcgcgaccggaatcagtcgacgtgcgccgtcgtccgccgcgccggcgcggggtttgaggtcaggcgtttcaggccgggctccctcaactacagctcgcgctacgacagcgtgcggatcggc

SEQ ID NO: 51162 - DNA, 6104 bp, Oryza sativa
  unsure (1)..(6104): unsure at all n locations
ttgtattatatgcgcaatatcgtttaatttagctatattaggattgcatttttttatgatacggaggggtatgttactgtgtttaatgtaaacacctctttgtttagtccatttcttgtattactatactataattttttacattttattgttcaccaagtttttcttattgtttatatattacatgcacaatatcattttatttggtaacaaatatcataatgttaaaagatgcttttcatccatttctagatgaaaagaggcttcgatagagctgatatctacagtattgtcttctcccccgattcagagtggcttgctgtctcgagtgataaaggaaccgtacatgtttttcatatcaatgtttgttcgccatcttcctccaaaactggttgccaagatacaactcaatcatatgaatcatatggtgcaaaagcaatgaaaaaatatgtttcttctataaaaggtaattttaattttgaaacttgtttgttagctttacttatcgtaaaaggtaaattgtattttgaaatttttgtgtattattttatttctgactcattgatgattttaatatgctttcagatttacttacattaggatatttcgatccagaaaggtcggtagctcaattccatctatgtgataatgtaaaataccttgtcgcatttggtacaagaccaaataaaaatattgttcttataactcgtatggatggaacgtgaatgcaattatgatcatattttctcaactctaccatnnnngtaaagatgaaaaaaaatctgacctctaatgtttgtgcagtttttaccggtgtcagtttgatccagtaaacggtggagaaatgaaacagcttgagtacacgaattttttaaatatgtagggatgatgatctgttcaaaatcagaatatgtattgatattatcatagttgacagagaagttatcatttttttcacttgtcttatttcgatttgtagttaaaagatatttttgccttcatagatttgatttatttgtgtatatagtgtcatcgtattattctctttatagtgtagtgacacgataatatacaataatacttagcacacttgaatcaaacttaattctcttaaactgattgatttaattttagtatatataagttctatttaagttaaaaaaatgatattttgagaatagaagaatactgggataactatgaaacatgtaacatgtagcttgaactatgatgttcttattattaccactctcttcctcgggcttgtttgtttggatattattagtgtatggcgtcgtgatagcgggctattaaaacgttgacacatgtcaaatctagctccgaaagacaagcaaacagtcgattcgcgacggttgccgagaaagcgacgatctatcaagcgcaacgccacgcctatcaatcctaaatggctacgaaacacaaatatcccctttgatgtgtgcttgtgtacgtatatgtatgcacaataatgttaaacgtgaaaaacgtaaataaatgtttgtgttgtactatgtatcttcctaacaaccagtcgagtgcaagtgtgcaacaaccaaggggtcattattactgtagattaataataaccgttcctataacaagattcgacacgaaagtgttcctctaaaaaaatcgacacgaaagagatctataataaccaaaaaaaaatagtaatattaattggcgcccgcctcctaattttgctggtaaaaaaaatataaaaatgtttttttcgattacatggcagacgcagatgcgtgcgcaccattatgcacgtgacaccacactcggatcctaccgattaaatatgtggttttatgatactccatcttaaatatgtagttctgggataaatttagtggttaatttgtagttttatgaaacatcaccttaaatctatagttttgtgataatttagctaaaatattatgaaatttaatcaaaactttaacacggccaatcaaataactaaaaattttgttcatcaacaacaataagcatgtgctcttaaaaatataggcgtaccaatagatacactgattttctggtaggataaaagggatgggagatgattttctggtaggataaaagggatgggagattgagatataggaaaatggatgaagggttaagatgtactacaccgaggttagaagaatgagtaagattaaaagataccctttagccttgggatttggaatattttaatcctatagataaaattcctagaaacctggagaatttcaatactacaggagaaattcataaggtctttgaacaaacatttgaattaaatcatttcctttataagtattcctataaaatagataattccatatagattacggagaaaaaaatatctcatgtttttttttcttcctgcaaactttaaatcatttttttgaacattcaatatattgaacattaaaagcacaaaacgtgcactggagatacatgattgtttttccaaagagcagcttgtaagagttcctttgtagataagtattgccattacaagtatgactaatattttgataattcagcattcagattcaactttaaatcgttgcgttcctcatttgtgtcaagtagaagtttcctttctttttttttaatttcgttaggaattcaataagcatgttattccatttctatattttcttctattttatgttttttacatgcgttttacagggttgcttagtgggtgggatgttaacgattccgatatggcactaccgttccgaaacttggcggtacgacgtatttcacgtaatccggtggaaaaccaatatattcctaacaaatttcgtgaactaaaatttaaacacaaatccctaaacttactgatacattaaaaaatcgatcagcttcaacgaaatttcggttgaatccatcgaaatcagatcgaaatagacagactctgatcgactgccattatccaaacaaagtctgatctagggctgtcaacgagccgagcttgagtgagctcgtctgcctaagctcgagctcgacacaagctcgagccgagctcgagcctattccacattcgagcttttaggcaagctcggttcgagctcgttcgagctcgagctcggctaccgagctcggtcataagtagtataatatatattttaatgataatcttttgataagtataattattttctagttaatcacactaataaaagagtagaaaatgattaaaataaatatattatgctaacacatgctaatttattgtgtaaatagatactaatatatatatttacctattagtttattatattaataaggtgagctcgagctcgtcttgttaaagctcgcgagctttgctcaggctcgggttcggctcgtttgaagctcgagccgagctcgaatcaagcctagaacgagcccaagctcgagctgctcgcaagccgcgagctttttttttgacagccgatcgattgccatgccatcccacccaccgttcgttggtttgatgatgatccaacggccaccaattaaaaaccttgtagccaaaaaagaaaaaaaattataaaaccaagaggtcgcgcacccaaagccctagtcctcctccatccccaaactccgccgccgccgccgtaccgccgctcgccaccgccgcggccgccatgagggcgctcgacgagaaggagacgaagatggtgttcgagaagctgttcaagttcacggggccgaacctgaagcacctcctggagcggccggcggtggaggggcccgacccgcaggccgggcgctactgcctccgcctccacaagaaccgcgtctactacgcctccgaggcgctcgtccgccgcgccaccgccgtcgccgcccgcgcctcgccggggtcggcacgcccatcggcaagttcacccacggcggcgcgttccacctcaccgtccacgccctcgacctcctcgccgcccacgcccgccgccgcgtctggctcaagcccgacaccgagcgctcctttctcttcggcaactccgtgcccaagtcctccctcgcccgcatcacagagaacaccaaggccaacgacggcgtcgtcgtcatgtccatggccgacgtcccgctcggcttcggcatcgccgccaggtcggcgcaggactgcaggaaggccgacaccaacgccgtcgttgtgctgcaccagtctgacgcaggcgagtacctccgccgggaggaggagctcatgtgaggtgagggctgaggcttcattttactcttgtgggctgattgtatcgtaggacttagctaaccttacatattatgccttcttttgtgtgcaacaattttgtcatttgcttagcatgcgcctaattggttgagatgagaggattgtagatgccaagtttattcaattgcaatgctaattggttgctaaatgaggggtgcttgccccagaatttgtgaaatcaatcttgccaaattccgaggtcgaatcgatgttttgatttcagagttagctaaatgagggagtgtttggaccagactatgtgctaaattgtgtgaaatcaagcatgctgaattctgatatcgaactgatgtttcattggatacttcatcgttttgactgtattttgtgtattagtattgattacatttgtcgataaaccttgtgagttacagctgagttgcattgcacagacattgtcttgaatttggtaatccaaagatcatccttatgcggttatgtctgtctttgtaatgtgttcacctgccttcattgataacttggaacaggaaggattcactctcctcctgtagcatgcattcttcagattagatatatgaagtgggttagaaagacatgttttcagttttccatataggacattgggtgagcttggctgtaggcagcctttgggcgatactgtttctgttatatacctctttttttgttcatccatagtggatcgatgtagaagttagactgatcatgtctaatctatgttcaacatgattggttggatcactattttcttggttcagaatgaatcaaaaggtttcttttttactattcagtgctgatacgagctgtgcatagcattggagtccctacaggcctacactgggattgtgattgtaggtttatggtttgaatatttttttgggtccacgattttattttagttgtagcatgtgcagactatttggttggcctgaattgctgtaactacataaaacagttgtcacccaccatgatactctgcttcttttgttcccaatagccaccaaaaaaaaaaagaaagatatggtggtacaaccaaacgaccctatgacctgactgtgcagtaaactattctttgacgccacataacttctttgcttgattacatggtctgtagaacagtttttcgtacaagaatgaagacacttgtagccatgtacattcggcttaaaagcgattccgattgtgaatgcaattctgattttccagctatccttcttgcaggtgttgaggtttgacacattggcgtgactgcaggactgaaggatgcgcttcctcttcatgcgataattcgaagtttttctaccaccagtaaatgtgcgatttttacctagttttaagatagtggaggtctgttgtatcatctatctagtagaaaaattttgttcccaggctgttctatgggcctaaaagtgttctgttaagctgtaacttatcggtaagctactgcatgactgaatgctgcaggcctgcagtaacatttgatcgtgatcaatgatatacttgtcttatggaccctacggataaaccctgtctgtccaatcttcatcagtttacgttaaaacctctggatttgtacgcattttggctttgataagcagataaaacttacaaataagatatgtatttcctttataggaataatgtgcattgaaagagagacacaatgactgaagggtaaatactgatcgatcagccacagaaaaaaaaaatcagaacgtcacttggcgacacaatcgtaagttcgtaacgcagcgtccgggcggttgaaacttgagaggcaaaagggaaactggagttgcgatgtcataaaccgagtgaaaatcgtcgtcttcttgttcactgc

SEQ ID NO: 51163 - DNA, 2278 bp, Oryza sativa
tgggagggtactatgataccactacaccagatgcgcttatttgaactgatagattaatcgtttacattttaacaaagactgacaagcttttgaaaaaaatgaactaagccatcacaaatgatttataggtaaaagttttcttactttgtgttatttgccgtttaaaatctgatgttaaaaatagaatataatgaaaaaacttcaaagtgacttaaattttaaaatttaggataatagctcgcttcatggcagaatttctccccttttaatcgtctcatttcccaaacctcgccgcaggtaagggagggaagggagctgaaccggcggcgaagacggcgtcgctgagcccggagaagcgcctcgcctcgccgcctacggcgagcgtgctcaggtgtcgcagcggaaaaggtctggctcaatccctcccctctgtcgctcgcccgctatctcgttgtacgcgttcttctgccggccgcgcctatgatgcgccatggttttgttgcgtagatctgtgtttttaggtgctgatctgcccagtttactttggtatcgagtggattgagctgtgatttacccaaaacagaagggatgccactctggatatggagtatttagttgagtaaaatgatcaagcctataaatgtgtaccttaacatgtacttcctccgtttcatattataagactttctagtattacccacattcatatatatatgtgtgtctagattcattaacatctatatgaatatgggcaatgctagaaagtcttataacctacggaggtagtactagccaatcataggggttccagggagggtggactcccaccaagattctgtggatgaggaggatgtaaaaagcgtcctgaggcgcctgctgcacaggtgccgggaggccaagaagattgacaagcatactatgtattataccatgacatgtaaatgaaggtcaagggtaacatgctcaacaacaagaggggaccttatggagagtatccacaagtgcaagctgagaaagctaggaagagaactctttccgaccagtttgaagccaagcttgccaagagcatggcaagccaagaaaggaagatttccaggaggtaggagaggttggctcaggtaagatattcataaggttctatgtgccacttggaaaattattgtttaaaaaaatgttcctcttgttgaccactcactagagccattttattctaggaaagatctgataagtggatgcttgtcgtcaattatgttgagatctgcagctatcatatgtatggcatttcgtactcagcagcagcctatgcatttgattgttgaaagtgcatgcttgccagctgtcttttattcaaactacagccttgtttgcatttttgtttagatattactgattttttcttctctgaagctagttacatagctcaattttgtttataaaactatattataaccttttgttaaatatttgcaattttcatcaaatagggaccggtaacctgcaccagctgctgcagctccagcatatgtaccttgaaactgcttttttctctttcacggctattagttctttgtttgcttattatctgccagtttccattgttttagggtaccaaaaaaagtggaggagccaagagttgctaagaagctttagcttgctggtcagttggtaccattgaggattagcctaattttgcagctctgaactgttttgctctaaatcaaatgtcctgtttcagatactttggatatcatatcgtgttcgttctgttggatgtagtagactagtagagatgtttacgcagtctcttaaacacacttgtgctcgtaattctgctgatgtttatgaatctagttttgcaatactaaacaataaacagtttgtggttgtttgggcgccttcacacggttggtatcttccagctccgctacctgttctatcaaacgtcatcttatatgctttgttgatcagaggtatttttcacttgtaggtattacttgattatctccctttaaaaggtgaaagccgtcatgttcgtgaatttagaatttaacaatattcgattccaaaacaactaataacccatcctataacagttaaaaaaaattaatattaaagacttgaggtaatacttgagaagcttctgcgttccaggataaacgggaagggaattatactgggaatgaagggaatcggacctggtaagtggtaaataccgagtgggagggtatactaggataccacccacaacaccagatgctcagcacaaaattttccatca

SEQ ID NO: 51164 - DNA, 6360 bp, Oryza sativa
  unsure (1)..(6360): unsure at all n locations
cgcggagcccgcgccccacgtgacggccctcgtctgacagcgccgccgcgggttccctgtccccccgcacctcgctcgatcgactcatcgccattgctctctcccgccggcgatcgagaccgcccaccacagcttttcatgcgtgggcgcgcccccacaatattcgttagtccatgtcgcgccgaccgcctgttgccggccggtgataacgcggaatattatgtatccggcccgttcaaacgggatgatatcttagaaatatcgggtattaggtgatacctactaccatcctgtctaaacgagatatcagccgatacctagtaagtatcagggcaggtgatctctctgagagttatcatctcgcctaaacgggataccgttatatagacatttcaaaagtttattacttttttataggagagaactacaaatcgtgcgtccaattcccaccaaaagttttttttgctatcaaatgttttagttaaccactaggtgaagcattaatttatacatggtgaaagaaaagcaattgaaacatttaaaaaaattgtgaaatacagtgaaaatacaagttgaaacaatgttgctgtcacttatgaaacaataagttctaacactctgaaatatatatatatcggaatataattacgggatatcttgttgtaaagatttaattataacaaatacaacattgtgatcggatcatatattggataaataatttaggagaaaatttattttgaagattgctatatgcatgcatggatgaagtggagagagagagagcaagtagtatgttcgaagagagagtaggggtagataattgcgtaaattttatgaaacttaatgaaaacatatgctacaacatttcgctatcacacatgtaacattaaatttttacaactgaaacatatatttttctttcatcaaaatataatcatataacatctcacttctcactgtaaagatctaattaaactaatataacggtgtgattggttcataaattggattaataatttaagacaaaataatttaaagcttaacaatgagataattaatatacatgggagaaagagaaaaaaaagtacaatatagtactgaagtacaaggcaacacatgcatacgcaagagtagcggagggagtaaagggcgtttgatttttattttgctggatcggtcacccgacctagatcattctctctttattcacgtttagctaactaagtgttagaggaatcataataattcactaaattcgaaataaaattaattatgtgttgtaattgttgtaatgtgttttttctataaacttagttaaaatcaaataattgatctaaaacaaactcaaaacaccttacaatatggaatatggaagtgcagagagtaaggccctggttgtttcagactaatattattgtaatctagattattaaatcagattactgtaagctggattgtaataagttaatatagaataagttgcgtgttgtttatttctctggattattggatgtatctaagggtagtgggtatttagctactcaataatctggaaaaaaagctcctctagagaagattattagattatactaatctggcttatagattataataatctacttgtttgttttagcttacttctaataatctaaattataataattctaagctgaatcagggcattaaatatacactctacatgagtttgcatctggccggtgcgacatggctaacgacgccactacgatcatcctcgtccatgagcgcctggttccacccgtttttgtatattctctgttgtcctacctacaggaattgatgcatagatttccctttttcccatctaagttcaaaggttgcaggatataaagatcttgattcctgatcatttatccaccaattacgaggagttggcattctcatatgtaattataatacaatcgtaatgtaattacatgtaacttgcatgtatctacaatgttacttccaaaaatccctccgtaacatcctattttcgtgaaaacggagatcgtgagaacgaatcctctcacatgtgcgcaccctatgactttttccttcctcacttgcacaaatcttgaagtaaatctaacggttcaaaattatgtgaaagttacatgcaagttacaataattacattgcgattgtaatataattacatctatcaaatttttaggagaaaatttctcgacaaatatatagcaaaattgttctgaattattgtgcttttgaaagatcctcttgattattattggactcgttttatttcatgtgagatctttccgcaccaatttttatgcgacttcaatagtaggtttaatttacaaaaccgaataaactggttccatggttcttagttgcatctattttcacatgaaaaaaattaaatgcatttaataagaatatgttatcggaaagataattaataaattaaactaggcataactaagatgttgaactcaatggagaataacagaatagccggttccttaaagttgctgatgtagtaaagctaacgtacaaatgttgtcttccattggcaaaagtagattgatgccatgaaagcttggtgtagcaccgaatctgcaggacaagctagcgttactgtcaaatagaagaaacgcaaagttaccaagttacctactatcttccgttcatccgtgggagaagtatacatgacaacttcatatatgtaaggaacatggtcaggaaatatcataggaccagacgaccaattcttctcttcaagctggacatttccaaagcttttgactcagtctggtgggactacctcctcactctcctgcaaaatagaggattcccaccaaaatagagagaatggataacgggtctcctctcagcatccacctcaaagatcatcctgaatggaatgcctggggaggcaatcaagcacggaaaagggcttcggcaggggaccccctatcccctctcctcttcatcctagcgatcgaccccctacaacgtctgctagacaaggccactgagcttggggcgataagcaaattacgagggaaagcggtacgtttccgcatatccttgtatgctgatgatgcagctatcttcataaacccgaacaaagaagatatgcaagccttcactgatctccttggtcgctttgggcacgcaactggcttatggacgaacctccaaaaatcacatgtggccccaatcaggtgtaataacttggacctcgatgacaccctaatggacacgccagcaaccagagcaaacttgcctatgaaatatctaggtctacccctgaccacaagctggctacggaagacagacctccaaccgctatatgacaagtcgatgagtcgcattgttggctggcgaggaagacacatcggtctagcgggacgctctaccctggtaaaggcggtgcttacctcacaacctgtcttcctactcacaggactcaaagcttccaaggagtccctcaaggtcttagataaacaaaggagaaaattcctttgggcgggaggagaggctttgacaggggggaaatgtaaaatcaattggacgcgaacctgcctccccactgcttccggaggcctgggcatcctaaatcttgagaaatttgcaagagccttatggttacgttggctttggcacgagtggaaatcacccggaaaaacttgggtgggctctggcacgccatgtgacgacactgataagctcctctttgcggccgcacaaccataacgattggaaatggtgccaaaataagcttctgggaatcggcctggacgcaggggaggagattgaaggatttgcgccgcttgtatacgcagcctccaagaaaaagaacagaacgcttcaacaggcttcgcaagcgaaccaatggcttcttgacttggacttgccagggactgcgagctggacgacagacctgattgatcaacttgtcggggtttggatcgccgttcaggctatacacctggtagagcacgaggaggacaatataacatggaagcttactaaccatggcgagtacacgacagcatcagcatataacgcacaacttcttggaaccaccgctactaacttcaataggctaatctggaaagcctgggcgccgtgtaagtgcaagaccttcgcctggctaatcatccaaaatagagtcaggacctctgacaggctggcgacaagaggttggccaaacggttccatttgccccttatgtcgtcggacccaggaaacaactctgcacctcctcgcagcatgtagatacacaaggagagtctgggcggcactagcggagtgggcgacgtgcgagcaactaaatcctagccaatggaggcaaacttcaacggtgctagattggtgggaggctaccgcaaacatacaagagacacctaagaaggcactccgcactttgatgttgttggtcgccttgagatatggaacgaaaggaatcgcagaaccttccaacagaaggagctttcagctacctcccttttagccaagatcaaggaagaggccaaaacttgggccttagcaggagcgagaagtcttaatagctgctttcttttagttagctcggaccaaaggtcctagctcctttcttttttcctttcgctttgtaaagttctccttctctattcaatgaaattggcgctcgtcgattcgttcaaaaaaaatagactaagctgattctaagaattcaaactttgtttcaaaacaagttgattcttacagtttacaaaaattatccaaaaataagttgatttatatatatcctcttatctattcttggtctgtaaatcgacaagttttattctcctatattagccgttatacatatatatagcagcatgatgtttttcatatctcatttctcttcttaaatattttaattcaggtgctgtaaaaaaattgccatgcatccttagttgatgtagaggccgaatcttcactttgtttaaaaagaaaagatgaatacatgttgccacaaaaatcctagggaacctatatatattaccacgaggtacacgctgttgaaatgtccccgtagaaattgttgtcatgcatgtgaagaaagcacaattatcatggttggcatgaaagtgaaaccggtcgatatagaaggatgagaagaatagattcattttttttttgaagaaaaagcggcaagagaattgccgattatattaggaggtagaataaagtcttacagcatagttcttagaaagattaatacatcttgggaagaaaagataggtagaaaagtagagctagtaataaattagcgcggtttgaaaacaaaatcccgatctctaatgtcttccattatagcagttatagtctgcgggatgtctggtgattggttcctgaagatttttgcatttctcattaaccaaatacgccaccatggtgttaattagaaggagaagaatagattcattcacgggtaaaaccccatcagtcgacgtcgtcgcgcgctgtactacgtggtaatcgattccatcgtcgcatctgatctcaacaccactctacatacagtatcttttagccaagccaggtgtactaccacacactggcagtatgtacagtactgcatccagctatagcccccccnnnnatatacggtgatatgcagacgcaggtagcagcatcatatcagcaacgagcagatcgatcgaagaggatagataggtagatagaaataatggcgggaggaggggtgtgggtgttcaggaacaacggggtgatggagctggaggagcaggcgacgagcaggaaggcgctggtgcatgtggcgacgagcgaggtgatccggtcgacggaggcgctggagcggaggctgggggcgctggggtgggagcgctactacgaggaccgcgccaccctgcagctccacaggcgcgacggcagcgccgacctcatctccatcccccgcgacttctcccgcttccgctccacccacatgtacgacgtcgtcgtcaagaaccgcgaccacttcaaggtcgtcgacctccacacctagatttatcacttattacatattaatgcaaaaaccatatatatatatatatatatatatatatatatatatatatatatatatatatatatatatatatatatatatatatatatatatatattgctttgcttaatttggtgtggtgtggtttggtttggtttggtttaatctctgcatacatacataatcatgcagatggcgtaatgcatgcatgtacgatcactggtaatgtaatgtatataagtgtgtaatgtgcactgtgtgattgatatatatgtatatgattgtaaaatcaaatgttcaatatatatctatactagaaaaaaaat

SEQ ID NO: 51165 - DNA, 2878 bp, Oryza sativa
acccagaaattccaaaaatttaacagaaatattccacaggagtaaaacacatcttcaaaagtaaataagaccaaataaaattccaaaaatttaacagaaatattccacaggagtaaagcacatcttgaaaagtacataagaccaaatattatgtgttgttctgaaggtatattcagatataaaggattggagcttttccaatatctaaaatagttttaattaaatagatgattaaaatagttactctgttaaccaagggtaggcatgataaatagctatagcctcgagcttcacaagttcaaaccacattcgaagacaaataataagactattatgcatgaaggcataccgtgagtgttttgccatcaggggcaatatccctgtcatggaagcaccacctgtcaactccaagcttctccatgaactcaaagtgagctctcactgcaataacaattcagacagaagttgttgattaagcaaacgtgcaaattcataatgaactgaacctaaacatgaaaccaggtaatagccatacttcttctcttagccatgtccaacgaatttgtgccatcctcccaaggccaagactttgtaggggcaccaaaaggatctcctccagtaccacggaacgtatgccaaaaggccacgctgaaccgcatccaatcctaaacgcaagcagataaaatacaaaactcagatgtattccatgacgcaaaagggaataaaaggatctgttcaacaagacataattcataaaccctaccttcatcttcttcccaagaatcacttcctcagcattgtaccacttgtaagcaagcgggttcttgctgcttggaccctgcagtgcaattgtgcaacaaagtcttagctcacaagtcacagcagttttagtccaatatataacaatctaaaaatttctaagctttatcaagtaatctaatcaaagagtcacagcagttatagtccaatacaataatataaatttccaagctttatccaataatctaatcaaagctgtaagctttcatggcctccctcacctcatacttgatcttggggatgccagggaagaactccccttcccaatcccctgaagcagcatcaccacacttgctatcgaggtcggccggacaggtttgctgcgtagcgatctgcaaccacaacacagaactgaattacaaccacaaccagaccacatttccaccgtagaaatcaaacatcactaactagtcaggatcacttaccgcagcagatagacatagagatgaggccaccagtaagagcaaaagctttgcccccatcatggcagcagcaggaccagcagcggagcggcgggcctgaagagcagcaaacaaatcagtaaccacagtgaattgacgagtgagagagaaataaataaaagaccagccagaaagtttccgatttgattgcgcacagtaaataaataaaagatcaaagattgaagaactcccaaactaatccaaaccaggtggagtcagtccatcgcccacacaaaaatcaatcgaaatccacaagaaatctccaatctgcgaggagaggatacctgcagcggcggcggcggagggggacgatgaatgggggaggagaggagaggagaggtaatcgcgagggggatgaggaggaggaggagaggaggagggcttaaggagggcgatgtggctggtggtagttgtcgtccctactccggcggtgggtgacgtcactttatttggatttatcctatccatggaccaatgatatactggtatatagtactattatttcattatctttttcgttagattaggacgagactatcgcgcgtgaaaccattatataggccgaagggcaagagattctcgtgaaatcacttgacgcaccgacgaaacgaaacggcagcgactccatatctaatctgtttttgttctgttctggtgtatctaatctgctagtaagaaaattttaatacgtgtagcattgctcccggtaatgtatttcggcgaggctaagcatggcgccatagcgtggtgtactggactctctctctctcttgataagaatcacaactgaaacgtactcctacctttcaactttcatccctcccagataaagcagataaacttctcttcagataaagatttactaccgtgtcaaatttcactaaaactgaattttaaattttaaaacttaaatttaggatttttatgttgcagtttgtttttcttttaacattagcctttgaactgtgaattatacgtatataaaagtttaatctaatttatttttggttgctcatgtgtcgttttatggcttattgtaaaccaaacgatgattctgcaattaatttctagtactatcaatttggattttttttctcaccgtaccattattgttgctacaggtgtcagtcgacacaagaagaacggaactctcaagctgatgacgcatcgcctgccgcacgatctggaaatggacggtccagatcgcacgccactcatcttatccgctcggctcaaggagaaccaaaaaagaaaaaaaaaaagaaaaatctcgctcagctcaaacagccacgaaatggcgccggccgtcgccgtcgtcgccgccgccgccgccttccccttccgcctcttctccgccgaggctcgccgaaacaccaagggctcccggagcaagcgaggctcagccaggcccctcaagccatcccctcctccccgcccatccgcgtcgtcgtccgccgctggcggcggcggcgccaccaccttcaccaggctgccgctccgcaacgcccccgcgtccgtggaggtgacgctggaccgcttccccacccccaatcccgagcccagagcttccactcttactcgccggaatggcgagcggt

SEQ ID NO: 51166 - DNA, 15650 bp, Oryza sativa
aggccggagccaagggcgacgacgtcgtcgtgaaggtgccgccggggacggtggtgcggtccgccgccggcgacgtggagctgctcgagctgatgaggcccgggcagcgcgcgctgcttctccccgcggccgcggcggccgcggcaatgccgcattcaagtccggcacaaataaggcgccaaggattgcagagaaaggggagaaaggtccagaaatgtatgctctcttcttcactccattgaaaagattgttcatgctttttttttttagttagctatggagtgagcttttgacatgatttcccatgttaaattagccatttagcttacacaaatgttagttcaggtttagattgtattgcttgatatacaagttttctttctttgacttacattagctgcatttgggatgattggtggttgttaggtggatagatttggagctgaagctggttgctgatgtggggattgtaggcgccccaaatgctggaaagagcacccttctgactgctattagtgcagcaaagccaactatagccaattacccttttacgacattattaccaaatcttggagtggtctcattggattttgatgctacaatggtagtcgcagaccttcctggattgctggaaggtgctcaccgtggatatggcttggggcatgagtttttaaggcatagtgagagatgttcagtgttggtatgttccttctctctttctctcctttctttaggatctactatgttttaagtccacatctcttatgtcatggttatcttatttctcctcgaatatatgatattagaaatgtatgtgcgatttattggttattgtttatttttctggtttgggtcttaggttcatgttgtcgacggctcaggagaacaacctgaatatgagtttgaggctgttcgtttagaactggagctatttagcccatcattggttgacaaaccttatatagtggtgtacaataagatggatcttccagaggcatcggaaagatggaataagtttcaggagaagctacaggctgaaggaattgagccctattgcatcagtgcaatgaataggcaaggaacagaggatgttgttcttgctgcatacaaggttctacagaaagataggcaaagaatgaaagatgacgaaggtatttctatagcctaaatttttctgtcaaattatagtgtactagtagctaataactgcctaactggtgctcaagcatggaagtgcactttaactgactatagctgttcgcaattttagattaaatgcatatgtgctactttcaccatctatgctaaagtagtgttcttactagcattcgttttacattatcgtggttaacacttacgcataacatttttgcgttttaagatgtttatcttactactgcatgtttctgcagaatggaatggccctgaaaatctgaatcatgtggctgatgcaataaaaagggaaaggagagctcccatgaacgaatttgagatttttcatgataagggcacgaatacatggaacgttgttggagctggaattgaacgttttgttcagatgactaattggcagtaagtagtttctttgtacagtgctcactcgttacactttggaagatcagtctcagaaagcgattttaagactgcattactggtcgtttatctaaattgacctcttttaagattactaattaagtaattgtaatatctgatctctttccaaatgcaggtattcagaatccttgaaacgatttcagcatgctttagaggcatgtggtgtcaacaaaactctaatcaaacgtggagttaaagagggagacacggtagttgttggtgaggtatatattcctatgtcataaacaaaacattggacagtcatcacacaaataaaattatcagatttctaagttaataatttctgcagatggaaatggtttggacagatgagcctagtaagaccaggtcatcaaagacaatgaactcaaaagatgactctgtcagatggcctgaatttggctagatcaaggctcaagcaatggttctgtgtcgcagcagaggcgattttcactgaaatgtttgcacatgcttacaataaaatgctgcactatgacaacaaaaaaactactagtcatcacaacagctagttacacccagcccaaataaaaggaatactattttgtgttaccttcagaatagtgatgtatcacacagcttcgcctacatgctttgaaagttggattatgcaggagtgctatgtactaccttttgtgatagtagatatttgtagatgagatttaggtattctaaaatgatgtacgaaatagtttcttcagcaagattgtataaatgttcacattgattattaatggcttatacgaccgaagaaagacaattgccgttgcatcgaaatctccaaaaagatttgatgtttgagtgaaccttgttcaacactttatactagcattacgaattcaaagattatgcatcaactatctctctcttacgatgcaaaagtaatttgttcccctcaattttctagtggagatagttttcgtccgtttctgatatgttttatttgctagctatgtgggtgtcccctatgcagttgtgctagcatgccatatagggccttaatttgagcttgcttgagtgtgttgagagagtgaatgagctcctccttttatagggctggtataacggttatcctaatgcgtaatgtcagttttgcccttgtaaccgtcgttgagaagtgatcctggatgtccacgtggagcgccgagctgagccgtagcagccagggtacctaggccggcccagcaggcctccagcatcggcagggtcactcacatgtgggtcctctaggcggttgtggcagttaatgtggtttccggacagttacacctgacttgtgggccctcttattcataagcttgctatgtgggtcctttaggcggttgtggcagttaaagcggtttacagacggttacacttgacttgtgggccctcttatccataaaattgcttaggagtgagtttttcttcattttctccttattttatttgataaattcctacaacatattattctccaagtacaagtggaattatattattctggaataaatatgcattgcaagcatagctaattctctattattttagttatattgacaatcgaagtttgtctgtaacgactgtcaacagtcaacaggagggattgacgacgtaggaaaggtggttcagttcgaaagtggattgaactagttagagttgttttaggtttagttttggaaataataattgttatatttaggccggtgcgtaattttcgttttctttttaggagataaatctctgggcggtcgaatcatgtttgaatcggactcagctagattagggatatatattacacggaccttataaggtatcttttgtatacaatttttcacgtgttgccacccttttcggcgagttcttagttttcgaacgaggctagatcggtttaatctccggtgaggaagtaagtttcttcaacttcgcttgtatcaacttaattaggattttctcagtctagtccaatattctaattaagttgctacaatcgtagcccatctaatatatcgactttttattggattgcatttcgaattatttaaattttttgagcaaatataaaaagaattaagtcatgcttaaaaaatatttgatgatacatcaagccacaataaaacaaataataattatatatttttttaaataagatgaattgtcaaatttataaaaaaattacggagggagtattatatttgcccggtagttagaagcgacacaacgaccgcacgaaatgcatgttattgcgatgtacaggatggattttgttgcgcctcacgcgtacgtacgtacgtatgtgcatgtgtcggataggatcacaagctagcggcgattcggactatttcagcaagcagcgttggaacgataaatccgattccaaaaagaactccggccgactggacataaactactaatccgagtcggatatatctggctagatgagttataataaatagcttactatcagtcactaactctctgagtctgcaattgcaacagtacattgtttcgatagtggccgacaagctacttgatcgccactctctgcaattggaacagtacattgttctcgatcgtgtccaacaatctgctcgatcgccatggccaccacgctgcagagctgtctcttttcgtgttcgccggtgacggcattgtcgatcaggaggagtccgcttacctcgccggccatctcgccggcggcgagccaacgtaattgctgcctcccaagactgaagacgacgacgcagtcctgcaggataagacggccgcccgaccgcctctcacggcggtgcagtgccagaaaggcgacggcggcggcgcaccgccggcgccaccgcgacgaccatccgattatctgcaagaggagaaggagaaagtcttgaagcactaccccgaaatcatctccatagatgatggttgtatggtaagtacatgtacacgtgcaataaatagttcaccattttaaatttctatgtgttatgagcaataaattaattgtgcagtaattttgatgatcttttggtgggaattaattaaatgcagtacgctgaggccacggagaagtcggcgggggtatgcctggcagcaaaggatgctctcgtcatggcttctcgtgtcatggtaactagtatggtggttcgtacagattgcgcggctagcatcattatattttctctcatataataacatatatgtcttctcaacatattatttaaatatattaaaatgacaacataattttaaattttgtactaactttacgaaactactaatgtgtaatattcatattgtattttatatacgtgttagttactaattatttttaatatcaaattttagttatttgtaaattatattcctatatgaactctagactcgtctttcaatatatttattttaattccgaattttcgttatctgtatttgtatatagactctaggctcttcttccaatattatttatttttaactttgaagttttattatttctaattgtttttttatgtagactctaaactcatctttcgatattctttaatttttaatttcgaatttcagttacttataaattatattcctgtattgactttagattcttcttctcatgtttttttttaaattccgaattttattatttgtaaattgtatttttatacgaaccctaaactctacttttaattttattatatttattctgaattttagttagttttaaattttaaattcctatatggactctatactctacttctaatattccttatttttaattccgaatttctatcgtttctcaattgtatttctatatggactctagtctcctcttccaatattccttattttttaattccgaatttctattgtttctcaattgtatttctatatggactctagtctcctcttccaatattccttattttttaattccgaatttctattgtttcttaattgtatttctatatggactctatactctacttctaatattccttatttttaattccgaatttctattctttcttaattgtatttctatatggaatctatactctacttctaatattccttattttaaattccgaatttctattgtttctccattgtatttctatatggactctagtctcctcttctaatatttcctatttttttaattccgaattttacctatttctaaattgtatttctatgtgggctatgtttttatttttctccgattaatatgggaatttctaggccgtgagtgcgaacgtggagatttctttttctattcctttaataagttaatagagtaaccatctaattaaatattctactgtacctctcactaattactagtactagtattcttcttgattatgcaacacaactcttactctaattaacgtattgctttttccgaaaatttcagcatactgcggagctcaatctcgctgcgccaaacgaaacatctacagaaacagtccacagggtacgtaacgctcctactctagaattttttttttgttttgttgctacttccaccatttcttaatagattacattgttaacttttaaacataagaattaccatccattcaaaacaattatgtagatataaaaagtatatataaattatgtttaaattccctttaatcatgaaacaaattacaacaaaataattgataattatcttttttaaaagaataataaaatacatctaaaagtcaacgactttaattatatcttaaaatgatcgcaaaagcaggattaatatagctagcaaggtttagtcatgatcaattgactaggtggtgttcttttcttctgaagatgaagattaagtttttatgcaaaacgaggtggtattaacatataattgattgagttttaattattacaaacttgaaaaatagactaatatgatattttagagcaactttcatatagaaaattttagcacgaaacgcaccgtttagcagtttaaaaaacgtgccacgaaaatcttcatctaactcttagtttgagaaaagaacgggacctaagattctttttaactcttgtatataatgaacagactgtgaggatgtacgtgaacatcgtgatggcggccgcggacgactcgtacgatcggaaggtgagcaagaagacggtggagtcgtacctgcgagcgctgcgaggcctcgcggcggtgacccacgtcttgctggacgacgccctggaagccgtcagccacagggcgcccatggatagcctcgccgagtacgccttcaactccgacgtcaagcccttgtacgacgacttccaggccgagatgaacacgctcgtccacaagatcgacaaggccttggatccacacatatgcagggtatgtatatatgtaatgtacaacttggatttgttattatcgttgtgttttttttcgtcgataggttaacaattaattaacattttattattgttggtgctttggcagattgcagtgtgggtaatggcgagggcaacgcagattactgggacaattattggactcatggtgtctcgtcggaagagggcactagagaacgcacggagcaaaatggttgcagattcggcgacaatttgagatagctgatagtcatgggggattaagatagtagcctgaaatttttgttattttagtgcagatagtacggactattggcccatggcacaacagtcatcaaatgttttagtgttcgttttgtaattaaggcatgatgaaatctccgccttcaccaccgggttatgtgggctgtacgtgcctaattgtattcatcaaatgcatgatgttcctctatctagctcctttctagtgttgttgtgctaatcctgctgcccttcacctgatcaatgcagcatatttttatactaattagggcctttgaataccgtgaatagaataacagagaagtagaataaacacatgattatgttagaaatgcaatccagctaacaacagccctaacctaaccgatccgtttttctcttttttgaaatttttttatcctcgaaaaaaattgtacgtggttagctttttgtaaaaagctcctcacgtttacaccaaatattgtatacgtcctcaaaccgacagacatccggttatcacttatccataaaacatctcgtcttccaaaaaaaataaaacgtgaataagagaaaattttgcttctaggggtagcgttgtaaaaaaacataggggtttttctaaaaatacatcctaatctcaccccacaatactcaaaccctaccccattccctccccgtctccttcacctcagcgccattgccgcgctaccccgccatccgccatcccccgttgccgtcagtcgttcccccattgctgccgccacctccacctatcgtcacactactaggcgccgccgtcctcgccggcaaatccaaccacctgggggaaggagagggtcgcaagccattccctcatcctccgggagctccctagagcgctcctaggcacccatccgcgtgtacctccacgcgccgttgggcgccctctgctcgccaccgcacatggccccgtccccgcccaccacgcatgcgccatcgctaggagccatcatcgcctcctgcccaaggaggtgctgttgctcgatgcggttcagagcaaggcctacaggggcaggctcgccacggccgagtccgtgatgggtgtaagttcaagtgtcttaatttggttttggtgattaatgacaaatctaactatatgagactaatcatttttatgagcctttctttgactagtctcatttggatatgaaagtaaaaatgatgagcggtatgtattaaacttcaccatattctaacttggtctctcttgtggatccaaaatatagcgtgagcttcctatttgatctttattgattatgtgcatatgcgttccttcatatccatatgtatgcacatcttgagggggagtttattctatattttgtttattataagatttctatcttgatttgaaatcatttttcatctcatatctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcccgataataagatgtggaagacatgcattcttttgtgatggaccttaatcatgacaaggatgaaatgcatggagataaaacgatatgtaccacttcttatctcctactttttgataggttcatatatatgatttccatgctattgatatataagtgtgagactaatgtttactcgaatgttatcttatttagtctcatttacattgagaacatggagatcatgaaggtatatgttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatattggatatttgcacttgagcttgcatacgagtatatgacacttgtgatgttaatgaatactcaacaaacatatccatatctttcatatgcaaccggttggtcatcaagtgaaggatggcaaccgatttgttgagactaatgttctcctttgatgtgtgaaaaggaataggtcccactacgatgaggctaatgaatgacaccatgggttagtggtcaccaagccaaggacatcgtcatgttggcaataatgaagtcaagcttgtgatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagataggcgccgtactatcaaaaggagtctatgaagcgagcttgtgaatgatcttgtgccatattagttcatatgcatgtaggtgtatttggtgggcttgtctagccaagtgtgatgagttttctcaagtcctaaaccaagagagaagtgggcatgtccaataggagtgagtgacatcttgtgggtatgtccggtggatgtcctttggagtgtgagccctttatccttgacttaagttgtgtttcttggatggtttttttcatgggttggatggccctttgaataatctttccatagagtccaagaacgccaaattccgagacccgagtcaagagatatcaccgttttactaacggtcggttaagctgaaaagtgacctgcggtctgaccatgggccttaggccggtctgaccgggcctgttagccggtctgaccggcatgataaggcttgtctgaccggccccactggtctgttgtactggtctggtttttggtggcgatacagagtcgccagagccacaaccggtcagaccgagccgatggcggtctgaccggctactacactgcggtcagaccagccaggttgagtgggctcaatgattgccctgtaacggctagttttctagccgttacaaagtagtccggtctgaccggccactctatggcggtctgaccggcagagcacagagttggggatttcgactccaacggctagttttggtggttgggggtatatatacccactccccagcagcaagggcaaggttttggcactccattgcattatcttgaacccttgcaagagctctcacacccttgtgcacttagcttatctagtgaggtgttagagagtgagttaagccaatccaagtgcattgctttattgttttagctagtatggcacttgatcatcctcggcaagcatcctagacttgttactcttggaggttgccgcctcctagacagcttgtataggtgttgcccggtgacctctccgaggagattgtggaggaggcctggcgccgtttgtgagtggtttggagttcaccaccttcagagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgttgcatttacatttttgctatttacattcatagagacatatttgagcccatatcacctaggtttgcaaaacttaacttagttgcttagttaaccttgcactttaccttgcctagcaacttaggttagttttgtttaagtgccattaagttttaaaatcgcctattcaccccccctctagtcggcctccttgatcctacaatgggtaggatcgggagagaaaagatgagcaagggtggatgcggcgttcgagtcgtcattctcggtggcggcagcgtccaagttatcgttcccgatggtggcggagttgatgtccaggaggtgacggcggagttgacgtccaggcagcggcggcgttgatggcgtcgatccaggcggcggttggcggaggaccacgaagttgtgccacaatcgatctcgccggaggaggaacacggcggcgccggggggaggggggagagaaacgcggcggcagcgcagaaaaggatggaaagtgtgagaaattccacctgtggcccgtatattcctcccatctattacacttgaaggtatatttttgccctcccacctctcgtctacgcgaggtactgcaacatggacatatttgatacctcgcggtaccaaacactaccagctattggatcgggccagatccaacggccaggatttggtaccgcacggtaccgttagaccataaaaaatctccttatattatgggacgaggaaggaaagtaccaaaaggaaaacaaagagcaggagtaccttgaagcgatgatcatggccgcacacgttgcggcggcggctcctcgactgcttgcttgtagatggaaccgtgtggctcctctacccacttcgccgtcgcgacggcctctccaggcgcaggcggcggcgcgcatggaccgcccgcgccacgccgtcgtcgttcgctgcaagaagaagaagaagggcgccgccgatgagccagccggcgagcccggcctagaggagggtggtgatccccatcaggtatatatatcaaaactaaccgcttccttaatctgtcattagtaattagattagatctaaattgacagcacattaagggcccctttgaatcttagggcccctttgaataaatgatttatttaggaatttcgtaggattcaaatcctatacgaaattttcctatttggccctttgattcaaaggattgaagttttccaaatcctataaaattcctatggaatggcacattgcatgtggattttggaggaaatttggcaagagctccaacctcttggaaaatttcctttgagtctatctctctcatccgattcctgcgtttttcctgcgctctaatcaaacgaccattcctatatttttcctgtgtttttcaatcctttgtttgtcaaaatcctgtgttttcctatcctctgttttttctaccctgcgattcaaaagggcccttagtaatgagaaaacataggaataggaaaaacgcgggattttgataggaatgtaagtgtaaaacagaggattgcaaaacataggaaaaacacagtaatgatcatttgattggaccgcaggaaaaacacaggaattagaggagagataaagactcaaaggaaagtttctaagaggttttaccgatgttagaattcctccaaaacttgcatggcattagacaatctataggaattttataggattccataagatccatttctttgattcaaatggctacgtaggaaaaatttctataggaataaaatcctttaaaattcctataaatttcctttaaatcacagggggcctaattgttttttcttctattttagtctccatcgtaccagcaatatcgtaagtttcaagacgtaattgaccagctccagcagtgtgcggccgaattaagagctcgtcgatcactcaaaaaggacaatatggtttgttctaagggatgtgcttctgtgctcagcaaaaaaaaaacttgcacgaaagttaaagctaatcagcggctgtgattaaaagggagattagcacttaattatcattagcgaggggtaatttcgtccaaagatttttgagcccatatccagcccagtccatctgaagcgatccctacattctaccagtccaccacggcgccgctcctcaaccgcaccgccgcgccgattttcgccttgccgtcattgctctgccctcttcttcagttaaaaggatacctgagcaggtatggcctgagtgacagtaaattcagtttcagacttaacttgtctcctcaaagatttgccttcaagttacagaacagagtcaatgccttattgctgcaactcgacttgcaaatttggttgtacatatacacatctggcacaagcttcatatttacaagcaccatgaaaacctgatatgcagtctcagcgctgccacttttcaatagaatcgagagaatggcattcgcaataggtgacaatggttgggcggcgccgccgacgcgcgggttgtggaggagcgatggcagtgccgacggtggcggagggaggcaggaagcggcgtggggagggaaccgggcggcaaggcggagttgcaaggggaagaagaaggcagagcagcggcggcaaggcgaaaatcggcgcggcggtgcggttgaggagcggcaccgtggtggactggtgggggtggggatcggactgggctggatatgggctcgaaaatatttggacgaaattacccctcgctaatggtaattaagtgctaatctcccttttaatcacagccactgattagctttaactttcgtgcaagtttttttttttcggagtacagaagcacatctctctattgttctaatcattgtcaccactcaccatctgcctattgctttatctccaatagagaacagcaaccagtcactcacatcgggattgtagttaatgttgactaatcgaaattttgtatatttgtatatagagtatttgtcccaaatagaaacgcctagcacgtacagtacatcatctaagttcaattaacgacaagtgaattatttaaacaaagacaatttagtgaaagacatcttctgaatttagtgcaaatggtaaacaaacacaacgacgaaagcatgcattagtaatgtcaggaatcaagaaacctaagtgatgaaagagaaaatttcaccagattgttcaacaacggaagcagtagtaatgtcaagaaaccaaattgaaaggagcaagctagctaaatattatatagctaatgcaaggcttgcctcgcttgctattgatataatgtaacgtcaaaactgttgcactgttgatttcattgtttctgatgccccttttgttttgcaagcaggacgatacaccattcaattatgagataaacaaaattagagggtactggacggagatacattcagcgaagataagttatttggtcagtactgttcataatatgctggggtttttattttgtttagcactaaaacaggtgaacagtgtccacctattattttgattagaccattggtttttgtagcggcaatcagcaaaaggaagaatcattatatagtcaaaggatacatgtttgttgattctagcaattcctaagtgtgtgttctgtagcgtgggttaggaactaatccccacgcatgggaaatagagtgatagactagcgtataattatttaagtattagctaaaaacttttaaaatatgaattaatgtgattttttaaagcaatttttctatataatttttttcgtaaaagccatattgttttacagttttagaagcgcgcgcacggaaaatgagtgtgtagagggttcggaacctcaacaaacgaaatcagtgtaaggagatgtataggggcttcgaataaacacatcatggttcaataaaaaatgctaatagtagtaatacaaaggaattatgagatggttatgaattgaagctgtttcagtaacactacaatcagaattaaacatgcatttaattatcagcgcatatctaatacaacattggaagtggcatttccactccaagacaaaattctaatcttcagaaatatgctgcaataagcaatttcgtagcggttatataatttaatttagcgcctcaaccttcaactttaggacttgtgaatatgaacgtaaaagttagttgcgttagtgcaaaatcaaaagttttagatcgagataaacaagttcaataataatactacgaactttctttcaaaataaaatatcatatataagacattggagatggatgtgtgagctcttgacattgtggctatgtgctataacttcaaatgtactccctccgtcctaaaaaaaaacccaatcctaggtttgaacttggacaggattgggttttttttatggagggagttaatataaatataaattagtttgttgcaaacttcatccatatataataagcaccgtgaattttactgaaatttaaaattgtaggattatgtcgtaatgttactatgaactttttgtcttgcctgttgcaaaagctgatcatgttttatttggtgagtactgtaggatggacaaggcaggatgttaacaatgactcttctcttaagagctaaagatgctatcgagttggcttctagaattatggtaaatatgctatcttttaatatataatatgttagctgttagatttaattgggtaattgatccatttaaatcaattaaattaaataaattccaaggctcgttatgctaggaatttatgtgaattcatt

SEQ ID NO: 51167 - DNA, 1448 bp, Oryza sativa
cactggatcaaatcccattgtaaatatcatgtttattatcttgttattttggattaaaatataccgaattattaccaaatttccaacattagcaattttactgaactttgtttaaccaacttctccactcttgtgaaaacagactgaagctcatttgagagctcaaacgccaagtgaaatttcgctgcatacggtagatcaggtaactcggttatgcttttatttggatgctcttctttgaccgaatcttgaaatcacataattttggaacgtactataaatttctctgaacatgcagaccgtcaggatgtatgtatcgacctttgttaagactgccgaggacacttaccataggaaggttgatagagcaaccattctttcattcctctgtgctcttcaaggtttggctgcagttagccatatcttgtttgaagatgctttggcttttgttcgtagcagtcaaccggattacagtccaaatcatgatgtcgaggtaattaaccgttactatcagcaggagataaaacgtttgataaataactttagggaggcttcaacaaccgaagcacttgaggtatgccactggacagagtctccccttcttttccgataatgttgatcaaattttgatcagatcagatgttgataaaattttgatcttgtatctgcttgacttgcagattcttttttttttgaacggaaaatagcactagagtgtcttttcattgaatagggcaggagaaaatacaacccctaggtgcaacaggaaaaaatcgaggagctgtagctatacactatacataatgcgggattaacttgcgcagccgcttagcccctgctaaagcccaaaggctagcctcttctttgatttttgacaagaggaaactcgttgccacctctttgtggtcaaagattcgccgatttctctccttccagatttcccatacaactagaaggatgagtgatcggagtcctttcttcggaacatttggcgtgtttgcgatgttctcccaccactgttgtactgattgtgcctcctcccattgagccggctcaatttgctgatatcccacccatccagcaacaaggccccacatccttttagtgtatctacaagtggcaacgaggtgcagcgccgtctcagcctcacagcggcacataggacaacatccgttgttttgccaacccctggtcgcaagtcgatctaaggtccaaactctattttggatgatgagccaagcatgaaatttacatttccctggtgcccagactttccagattaaggagttgaagcttgtgctcggcgttccttggcattgcgcatggtaggccgaggaggccgtgtagcgtccactacttgtgaatttccaggtaatctggtctggttctccagtgtctaagtgaacattccggaccgcttcccataagcgactagttgttcgacgagg

SEQ ID NO: 51168 - DNA, 8407 bp, Oryza sativa
  unsure (1)..(8407): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctatggcaatattggcattaattcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtgattttttgccacgaatgcacccaacacactccaatatttccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccggtgaaaaacatcgcaaccacctatgccaatattggtagtaattgacaaaagttcgccgcgcgaatcacgaagtgatattttgacacgaatgcactgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctatggcaatattggcattaattcacaaaagttcgccgcgcgaatcacgaagtgattttttgccacgaacgcacccaacacactccaatatgtccaaaaatcatgttttggtgctttttgaactttttcattccgttgaaaaacatcgcacccacgtgtgccaatatatggcaatattgacattaattgacaaaagttcgccgcgcgaatcacgaagtgattttttgccacgaatgcacccaacacactccaatatgtccaaaaatcatgttttggtgctttttgaactttttcattccggtgaaaaacatcacacccacctatgccaatattggtagtaattgacaaaagttcagcgcgcgaatcacgaagtgatattttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatggcaatattagcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatggcaatattggcattaattgacaaaagttcgccgcgcgaatcacgaagtgattttttgccacgaacgcacccaacacactccaatatgtcgagaaatcaagttttggtgctttttgaactttttcattccggtgaaaaacatcgcacccacctataccaatattggcagtaattgacaaaagttcgccgcgcgaatcatgaagtgattttttgccacgaacgcacccaacacagtccaatatgtccaaaaatcatgttttggtgctttttgaactttttcattccggtgaaaaacatcgcacccacgtgtgccaagatatggcaatattggcattaattgacaaaagttcgccgcgcgaatcacgaagtgattttttgccatgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccagtctaaaacatcgcacccacctatgccaatattggcagtaattgacaaaagttcgctgcgagaatcacgaagcgattttcattccggtgaaaaacatcgcacccacctatgccaatattggcagtaattgacaaaagttcgccgcacgaatcacgaagtgatattttgccacgaatgcacccaacacactccaatatgtccaaaaatcatgttttggtgcttgttgaactttttcattccggtgaaaaacatcgcacccacctatgccaatattggcagtaattgacaaaagttcgccgcgtgaatcacgaagtgattttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaactttttcattccggtctaaaacatcgcacccacctatggcaatattggcattaattgacaaaagttcgccgcgcgaatcacgaagtgattttttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatgccaatattggtagtaattgacaaaagttcgccgcgtgaatcacgaagcgatattttgccacgaatgcacccaacacactccaatatgtccaaaaatcatgttttggtgctttttcaactttttcattccagtctaaaacatcgcacccacctatggcaatattggcattacttcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtaattttttgccacgaacgcacccaacacactccaatatgtccaaaaatcatgttttggtgctttttgaactttttcattccggtgaaaaacatcgcacccacctatggcaatattggcagtaattgacaaaagtttgccgcgcgaatcacgaagtgattttttgccacgaacgcacccaacacactccaatatgtccagaaatcatgttttggtgctttttgaactttttcattccggtgaaaagcatcgcacacacgtgtgccaatatatggcaatattggcattaattgacaaaagttcgccacgcgaatcacgaagtgattttttgccacgaacgcacccaacacactccaatatgtccagaaatcatgttttggtgctttttgaactttttcattccggtgaaaaacatcgcacccacctatgccaatattggcagtgattgacaaaagttcgccgcgcgaatcacgaagtgatttttttccacgaatgcaccaaccacactccaatatgtccaaaaatcatgttttggtgctttttgaactttttcattccggtgaaaagcatcgccaacacgtgtgccaatatatggcaatattggcattaattgacaaaagttccccgcgcgaatcacgaagtgactttttgccacgaatgcacccaacacactccaatatgtccaaaaatcatgttttggtgcttgttgaactttttcattccggtgaaaaacatcgcacccacctatgccaatattggcagtaattgacaaaagcttgccgcgcgaatcacgaagtgatattttgccacgaatgcacccaacacactccaatatgtccaaaaatcatgttttggtgctttttgaactttttcattccggtctaaaacatcgcacccacctatggcaatattggcattaattcaaaaaagttcgccgcgcgaatcacgaagtgattttttgccacgaacgcacccaacacactccaatacgtccaaaaatcatgttttggtgcttttagaactttttcattccggtgaaaaacatcgcacccacgtgtgccaatatatggcaatattggcaataattgacaaaagttcgccgcgcgaatcacgaagtgattttttaccacgaatgcacccaacacactccaatatgttcaaaaatcatgttttggtgctttttgaaatttttcattccggtgaaaaacatcgcacccacctatgccaatattggcagtaattgacaaaagttcgccgcgcgaatcacgaagtgatttttttccacgaatgcaccaaccacactccaatatgtccaaaaatcatgttttggtgcttttcaaactttttcattccggtgaaaaacatcgcacccacgtgtgccaatatatggcagtattggcattaattgacaaaagttcgccgcgcgaatcacggagtgattttttaccacgaatgcacccaacacactccaatatgttcaaaaatcatgttttggtgctttttgaactttttcattccggtgaaaaacatcgcacccacctatgccaatattggcagtaatagacaaaagttcgccgcgcgaatcacgaagtgatattttgccacgaacgcacccaacacactccaatatgtccagaaatcatgttttggtgctttttgaactttttcattccggtgaaaaacatggcacccacctatgccaatattggcagtaattgacaaaagttcgccgcgcgaatcacgcagtgattttttaccacgaatgcaccaaccacactccaatatgtccaaaaatcatgttttggtgcttttcgaactttttcattccggtgaaaaacatcgcacccacgtgtgccaatatatggcaatattggcattaattgacaaaagttcgccgcgcgaatcacgaagtaattttttgccacgaacgcacccaacacactccaatatgtccaaaaatcatgttttggtgctttttgaactttttcattccggtgaaaaacatcgcacccacctatggcaatattggcagtgattgacaaaagttcgccgcgcgaatcacgaagtgatttttttccacgaatgcaccaaccacactccaatatgtccaaaaatcatgttttggtgctttttgaactttttcattccggtgaaaagcatcgccaacacgtgtgccaatatatggcaatattggcattaattgacaaaagttccccgcgcgaatcacgaagtgactttttgccacgaatgcacccaacacactccaatatgtccaaaaatcatgttttggtgcttgttgaactttttcattccggtgaaaaacatcgcacccacctatgccaatattggcagtaattgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51169 - DNA, 968 bp, Oryza sativa
aattactgccaatattggcataggtgggtgcgatgtttttcaccggaatgaaaaatttcaaaaagcaccaaaacatgatttttgaacatattggagtgtgttgggtgcattcgtggtaaaaaatcacttcgtgattcgcgcggcgaacttttgtcaattattgccaatattgccatatattggcacacgtgggtgcgatgtttttcaccggaatgaaaaagttctaaaagcaccaaaacatgatttttggacgtattggagtgtgttgggtgcgttcgtggcaaaaaatcacttcgtgattcgcgcggcgaacttttttgaattaatgccaatattgccataggtgggtgcgatgttttagaccggaatgaaaaagttcaaaaagcaccaaaacatgatttttggacatattggagtgtggttggtgcattcgtggaaaaaaatcacttcgtgattcgcgcggcgaacttttgtcaatcactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgtttttcaccggaatgaaaaagttcgaaaagcaccaaaacatgatttttggacatattggagtgtggttggtgcattcgtggtaaaaaatcactgcgtgattcgcgcggcgaacttttgtcaattactgccaatattggcataggtgggtgccatgtttttcaccggtatgaaaaagttcaaaaagcaccaaaacatgatttctggacatattggagtgtgttgggtgcgtttcgtggcaaaatatcacttcgtgattcgcgcggcgaacttttggctttactgccaatattgg

SEQ ID NO: 51170 - DNA, 1527 bp, Oryza sativa
gccatatattggcacacgtgtgtgcgatgcttttcaccggaatgaaaaagttcaaaaagcaccaaaacatgatttctggacatattggagtgtgttgggtgcgttcgtggcaaaaaatcacttcgtgattcgcgcggcaaacttttgtcaattactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcaaacttttgtcaattactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgtttttcaccggaatgaaaaagttcaaaaagcaccaaaacatgatttttggacgtattggagtgtgttgggtgcgttcgtggcaaaaaatcacttcgtgattcgcgcggcgaacttttgtgaattaatgccaatattgccataggtgggtgcgatgttttagactggaatgaaaaagttcaaaaagcaccaaaacatgatttttggacatattggagtgtgttgggtgcattcgtggcaaaatatcacttcgtgattcgcgcggcaaacttttgtcaattactgccaatattggcataggtgggtgcgatgtttttcaccggaatgaaaaagttcaacaagcaccaaaacatgatttttggacatattggagtgtgttgggtgcattcgtggcaaaaagtcacttcgtgattcgcgcggggaacttttgtcaattaatgccaatattgccatatattggcacacgtgttggcgatgcttttcaccggaatgaaaaagttcaaaacgcaccaaaacatgatttttggacgtattggagtgtgttgggtgcgttcgtggcaaaaaatcacttcgtgattcgcgcggcgaacttttgtgaattaatgccaatattgccataggtgggtgcgatgttttagaccggaatgaaaaagttcaaaaagcaccaaaacatgatttttggacatattggagtgtgttgggtgcattcgtggcaaaatatcacttcgtgattcgcgcggcaagcttttgtcaattactgccaatattggcataggtgggtgcgatgtttttcaccggaatgaaaaagttcaacaagcaccaaaacatgatttttggacatattggagtgtgttgggtgcattcgtggcaaaaatcacttcgtgattcgcgcggggaacttttgtcaattaatgccaatattgccatatattggcacacgtgttggcgatgcttttcaccggtatgaaaaagttcaaaaagcaccataacatgatttttggacatattggagtgtggttgggtgc

SEQ ID NO: 51171 - DNA, 1792 bp, Oryza sativa
tgaccaaaacggcggcggaagatcaacggacggcgacggcgtcgaggtcgaaggggcggagaagatcgggtcgacggcggcgacggtcctccggcagtcttcagcgacggcgaaggagcggacgaggatggcgacgacttggcgaccacgatggcgaccttcccgagcgacggcgacgactggaacggcggcggcgcacggctggagcggcggcgacgacggcggcgctaggttacacggcgctggggcgctaccggcgacgagaggcgaagacgagggtggcggcgggcgggtagaggagacaccggggatccttttaaaggggcaggaggcggcggcaaaggcccacggcaaccggcggcgagatggaaagctcgggctcggagagagagagaccgatccgaatcgacctcgaatcaaacactttccaagcgattttagccgatgattccaaaagagaaaaggtagaggagatccccaagatcattttcccttaattggtttcacccgaaaccggaaaggatcggccgattttgaaaggaaacggcggcccggttcggcttagggtttcgggcggcggcggctggaggttgacgacgaccccgacaggcgggccccacctgtcagcgacggaaacgcacgcgcgcgggcgggcgctgctggactgggcggacttgggccgagggagagagagagagggttttgggccgactttcggcccaaagccaaaagaagacttttaaaacctttttcaatttaaattattcatgaaatgcatttcctttattaaaaatactttcctaacctaaaataattcccaaaaaattctaggattattgaattaaaccaaagatttaatggaattttattttgcccccatttaatatggaatttaataattaaaaataaaatcttctttcctaaacttttaaaatcaattctaataattccaattaaacaacaatttatatatttgggatttttagggtgtgacagtaacatccaacgaaatactcagaattacaacgggggtcacttgaattatcattatcagcctccttcacctcagggtccaccaaggggggtcaccccagcctcagtttgctcccagtttaatcagtttgagccgatacagcagcagacgcaaggggcacctcagcagagacaatgggctgatatgatcgcagatgtaatgagggagcaatttgggcttaagccgaaggatactggaaacttatatcggcatccatatcctgagtggtttgagagggttccattgcctgctcgatacaaggttccaaacttctcaaaattttcagggcaagataatgtttcgacttatgagcatgcgagccgattcttagctcaatgtggtgaagcatcggctgttgacgccctgagagttaggttgtttcctttgtcctcatccggatcggcttttacttggttttcttctttgccatacaattctgtcaatggttgggccgatttggagaaataatttcacagctatttttacagtggaattcatgagatgaaactttctgacttgacagcaattcggcaaaggcatgttgaatctgtgcaggactacattcagagatttagggaaacaaggaataggtgctacagcttggctctaacagattctcagctagccgatttagcttttcagggtttgatagctccgattaaagagaaattctcatcccagtagtttgaaagcttatctcaccatgcacggaaggtaactctgcatgagcaaaggtttgcagaggccaagaagaatttc

SEQ ID NO: 51172 - DNA, 733 bp, Oryza sativa
tttaggcttttagaaaatatacaaaaatcctccaagcctcatttgacttttatctttgcacattttaattgttggaggctttctcatgaattttaattattctttgcacaatttcgaggatgaattttagagtcgatttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattactcggttcctggtcctgcgctccatggtgtccaggattttcactggcctctccacataggtcaagtcttcgcgaatttcaatttgctctgagtcggcctgctcggatggcactcgaagacatttcttgagttgcgacacatggaacacatcatgcacgttgcccaaggaggcgggcagctccagctggtaagcgacttctccgcgccgagcaatgatacggaaaggacccacataccgaggtgcgagcttcccttttgtctgaaacctgtgtacacctcgcaatggcgtgacccgaagatacacaaagtcatccactgcgaattccaggtcgcggcgacggttattgcataacttttctgccgggactgtgccacctttagattttcccgaatgaatctgacataagcttaagtttctctcagcatatcagtcc

SEQ ID NO: 51173 - DNA, 1501 bp, Oryza sativa
tcaaataaggcttggaggatttttgtatatttcctaaaagcctaaaatgcgtaaataaattttagtggaattttcagagcacaaataataattgagaagaaataaacaaagttgaaaaggttttataaaaagaaaaatccctaaaagaagtcttcttttcccccccttcccttcttgggccggctcggcccaattccctccctctctctcctctcccccgcggcccatcggcctcccccgcgcgagcgccgctgacaggcgggcccgcccgccaccctcgctgacgggtgggacccacctgtcatcgcctacctcgcgccgcgcccgccgcccgctcgtgccctagcgccgccgccgccgcgaatctcgccgtttcccgccgtccccgcgcgcaataaagagggggaaatcacccccgtgattccctctcccgtttccccctcttttccctctctccctccctcggattcgtccgatttgaaacccgcaatcgtcgccggcgtcttcaatggagccgagatctccgcggccgattcctctctctccggccgcgctttccccctcccggtgctatataatcgtcccccgcgcttcgctcttccgtttccgccgctcgccgctcgctctcgccgtcggattcgtgctcgcgccgtcctcctctctctccgacgtcgccgccgagctccggttcaccgccgtcgccgctccggacttcctcccgactcggcgtcacctccatcggcttcgccggcgtcgttcgtcgaccctcgcccgctccttcgtttcgcccgccgaccgccggagcaccgtcgccctcgtcatcccgaaccgcgccgccgcgttcctccgctccgttcgtcgtctccgccgtcctcgtgtctcggggtgagctgtggaccgtccctttagcttccctctcctctcggctctttcgggcgccgctccgccgcgccggtggtcgccggcggtgaccatcggggcgcggtcgtgccgcctcccgtcggccgtgccggcgaggccgccttcgggcgcgtcctcgcggctgccaagtgggcccggccgttagccgcccgcgcccgcgggtgcggctgacgcgtgggacccacggcgccgaccgccgccagctgcgtgctcccggtccaccgtggaccgagaggctgacgcgtgggccccactcccgtggacccggtccgcgcgccctctccctcggctgacgcaataaatgggtttttaattaaaatttaaatgaagaaattcgtaaatatccatttaaagagcatataaacttcaaatggccataacttggccatttgaactcggaattggcccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctctttgtggaagttgaagccgacgtttgggaaa

SEQ ID NO: 51174 - DNA, 1095 bp, Oryza sativa
aggaccggtcttcgggcctctgttgcaaagactaccgtacttccacatgtctagtggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggcgggattgggtcggtactcttgtctatggctaggatgggttggaaactatgtcacgtcttccgtctgtataccgtggtggtatgtggcactgtggcacgtggttacacgtgaggaagaggtgtcttgtgggtaaagatgtacacctctgatcagagtataatctattcgaatagccgcgccctcggttatgggcaagccgagcaatgtacccaagttagtgttttaattcttaaaacttgcttaacaactaaaatgtggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaacccctttttggtataattcccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgttaaactctgaattgtatcaactttggtgtaccttgcctcctgggacaaggataatgcacgcacgtcaggaacgcccgtcgggttatttccggtcgtgaca

SEQ ID NO: 51175 - DNA, 774 bp, Oryza sativa
actttctagttttctcaaaaacttttctcaaatcggctatgtgattctcaatttcttttgacttaaccaccacgtcatctatataaacttcaaccaaccagccgatcagatcatggaatatataattcatggccctttgatatgtagccccagcactcttcaagccaaaagtcattacaacccactcaaacaagccgattgcaccaggacatctaaaagctgtcatatgaatatcttcctctgccataaagatttgattgtaaccagcattaccatccataaaactcaatatctcatgtcctgaggcagcattaaccaactgatcggcaaccggcattgggtactcatcctttcgagtagccttgtttaagtctcggaaatcaatgcacactctgactttgccatttttcttgataaccggaactatgttggaaacccactcagcatatcggtatggatgaataaacccagcatcatacaaacgtttaacctctgccttgacaggttcgagcatataggctttgcatctcctcggcggctgctgatatggtctaacccccggtttgacagggagccgacattcaacaatcgatcggctgagtcctggcatctcgtaatactcctaagcgaagcaatctccaaattcttttaacaactctaacatggttctaaattccggagataaattcttactgatgaatgtcggtcttggtctatcgcctggacctatatcaatttcttccaaatcatcaatcgacataaaaccttgtcctt

SEQ ID NO: 51176 - DNA, 978 bp, Oryza sativa
ccgtcgccgctgctcttggtggtggcgtctttggacgatgccgtcttcccaccggcgcgggcagcctcgtcggcgcgtgtggcggcttccttcctggccgtgcacttgctgcattcctgcttgcacgccgccgccgtcgctggcgacttgttgcctttgccgtccttgccttcgtctttgcgcgcgctcttctcgtccgccggcgaggtcggcttctcgccgccattgctgttgctcttcttgccttcttccgaaggcgcagccggtgacggcggcggcggcgccatcacctcggcgatcttgccgaccttcgagagcttctggacgagcaccctgctgtccacgtcaccgacgacggtcaccttgtcgagcgacgggttgatctcagtcctcagcacgcctgcaaaatccatgcacacaaacacaaaattcagcatctctgacgaagcacaagattcatgcacacaaacacaaattcagcatctctgacgaaacaacaaatttcagcgtctcagatgaataacaagaacacaggagaagtgaatgatctcgatacctttcaggcttatggctttcatcaccttcctcccgcaagcatgagcaaggagacggggagtaaggggaggagaccgctggtgagaagacggaggcgagagagaggggattggaatcggtgagctcgagcttgccatcctgccctccatcttcctcccttgatgcctgcttgctccccaccatcggctcatggtggcgtcaccggagcagcgtcttccccgggagtgaggtccgccgccggctcccgctcgcagccgttcccctcgtcctcccactaggggatccggcccctcgcctgcccgccctcccgtcgccaccgtcggctcccacccgctgccgccgccgccgccgctggcccctgtcccatggccaccgcttgctgaacggaagagagagagagaggggggagggggggggggggag

SEQ ID NO: 51177 - DNA, 3481 bp, Oryza sativa
ccgccgccgcagagtacatgaaaccctagcggatctcctctccgtcgtggccatggcggagcaggggtggttgttctgttcctgcctctagtttctcctatcttcatctacttgattctctcgcatcttagtgattttggtgattttgattttctagtttttgaatttgtgattttggtggtgtgttcttgatcgcctttgagagaaccgggtggatttattgctggtgccgcgtcggttccgttgcgggcgtagatgaatccttgtgcttcagattcatccgacgagctccatccatgtcgtctcctcgtgatgctgggtggcagggtgattttggaacattttctttttttttacttctctcccgcgagatctatgtttgtttgtttgcgtttgtgcaatggtgtttttgctgggttgatggccttcataatcccggattaactcgcttagctgttcttctgattcatgggaggccgagatcgatgctggcagtttcgctgatagccccttcctcttactggaggtgcttcattagtaactggccacacaatacacaaatgatttcaaaacttgttttctccgtttgtttttttgttttgtttttgcgaaaagtttcgcttgggatgcgttgcgcagaacgaacaaaccatcttctgaaatccaccgagatcaatagacagggtgatgtttatattggtagaaatacaagtaatcataaaagcagtaaatttggatatgccaaatttaacagaggcatcgaacgattgaacatataagaatatcatccaaagatgttcaactgttaccgcaagaacacggcaataaccttctttttagtgttgtgcggaaatatgttgaacggttaattgacaagcaaggattaaccttacttataggcctgttaatttgccattatgaaacgtgataaagacctagtaaaccaaagagaattacccctacattacgaacttacgattggtggcgtgcgtatgactcgaaatggtcgagcagcttttgttggagctctgaaacaaaggcaggacaacttgtggatagtacacgtcaaaattggaagtttggttgaaattgaaattggaatgaatcggaagtttggttgaaattgaaattggaatgatgtgatgtaaaagttggaagtttgtatgtgtgtggaaagttttgatatgatggaaaaagttgaaagttgaagaaaaaatttgaaattaaacaaggggcctgatgagaggtctgcttagctcatgcctgcgtcagtggaccatccctgacgaccttccaatcttcgccactactcgctccatggtgcagatcaaggtgacaagaaaccagaaacaaaaacagtggtaggaatctgcgagtcttgtgccaatggttcacattatcaatgtacaccgacagcagcgcacacagcctcaagtttaagaatggcagcgtgtttaaacagatgtaaaaataataatttctttatgaaactttttcacaacaaaattctgcttctatcattttctctcttctttttctcgtatggaacgatgtgatgagatatacatgtgtttctgactacaaacatatgaacaaacagacccacccttctcccctacaaactcactcccacctctgcctaataacacatcgatacagattatatcagttaaccacaatgaaaagaaaaaaaaaactgccattagctgcatcactggaggtaccaaaacttgctggcagtgaccatctgaattcagactagcccatgcagtgttccaccttcatgagcttgtattgtcaggccatcaaggattcattcatttgccaattgctaaactttgagcgagatccgagtcttgatgggcttcagcttcactcccatgctctccggtgacagaagttcaggcgatatacagaatgggttcagtgtgctccgggggctgctatccagctgggaaggtctgtagagcccatatcccatgaggaagtactccatggggatcaacatcgcgtgcggttgctcctcggtgacgagtgacccgcatgcctgaacctgcgatttagaggcgaaatgcacattcagaacttgccttactctgcgtatggatcatcaatttgctatgtcagctgttaaattgtgatatggtctttatacctcgactagggcgcaatatctccggtctagctttgtggtcatatggactgcgtcgtcgtggaactgtgagttctctcccacaaaaatcagtgtccgacactgaagcttcttcaacgcttccgtcaggtcatgtctcctgatggatggaaaaattcacttgagtatgttcaaatcctgtttctttgcatgttcaggcaatgcacagaagataatttgtccacttactcgtttatcgcctgaaggaatcgccatacattagatccctgtcgctcatgaagtaactgcataaaaggaaacctattgcttcagactaactttctataagtagacagctaccaatcttgtcaaaatcatatcagaaagctgacgaggagatgaactacttacacttctacaggcttgcacaatctctgattcagggtcttgtccattcccacgaacttcctgcacatagcatcagaaaactgttgagcgaagctgatatacataaaaggatgcaaattaaaagcagctaaccgaagacccagttttccgtgcttaaataccgctgaagcaagcattccttgactagcccacgacttccattatagtaaagcaagtttaataatacctggtacataagagtttgagggtaattcacagaacacattaccaatactgcagtaccgacagatttaaatgtatgttagtaccttattgtacaaccactcgctccaagaaggggctttgcatagcggcgaaactagcataaggccaatcactctatcccggtattttgtctgtgacaatgtatacatacattcttaagaaaaagaaaaagaaaagacaaggcaagctttgaaataactgctcagagtaatacttactgcaaagagggtgagaatgtaggcaccggcagtgacacccaaacacatcacagatcctaatctgtatgagcaaagccagaagcacagcattagaggcgtcgatcaagcaccagccgattataaggcgcaatttggccagtgtcgtgatacagtacccgaagaaatcaagaacatccgcgacttgatccacaagctcatcaacagatggcacgggcacatcggatgaaattggagccgctcccaactgtaggacaaaataacacatgtaagtatcagagcaaatacgggcaaacagtgaatgcttacataatattgggtaagaaagagccatcatgactgacctcatgaccttgaggagtgatgtggtaaatacaaaaattgtgaagcaacagcgacgcggcctctgggcagaagaacaatccttgaaagcaagacatatctaccaaacaaaaaaaaatag

SEQ ID NO: 51178 - DNA, 2056 bp, Oryza sativa
agaggtattgcttcccctcggtgaaacctccaccgacattgcttaacaaatagaagcaacataagagagattctcgttgtcattgcgttgataagcactaattggaagctgaagcgtaggggcttccgttcttaattaacattaaaagcaaacaaagatgctacatttttgcgtgtatttttgtttttcctctcttcctgctcctacggctcgagtaacattgcaaccataacaaaacgaggagctgcaagaactagctattactgaccaaaatcataggcatctaatctaatgctcctaatttgtgcaatgtccctgaacaagtgaacagtaacgaaaaggagctccatggcacccccaaaaatttgaagcatttgctgctctaatcaagaacagcaagaaaccaaaatcagggagcaggaatatccccgctcctaccttaaccaccatgaaaccaaaacacaaatccccaccaaaccaagcttgaaggaggggaatcaagcaagaaacgggagagaccgaaagcagagcgcacggaccttgccgccgaaggagatccgctccacgtcgatggacaccgaccggctcgagtcccccatgccgccccgctccccttttaaaagcttctcctcctcctcctcctcctcctcctctgccaccaacctctcctcttctctctctctctctctcctcgctgcctaaattcctcgcatatatttgctcgcgtatatatacaaccgcgagaggagagagagagagagaggagagggtggcttggcttggcttgcccagaatgagcgcaaaccaccgacggcggtgagctcaccggaggtgaccagaatatggcgggagagagaggagaggagagggagggtggattgcctgtttcatgggatccacccgttgaaggtgggccccacctgtcaatgaccttcctcctcacgcgtttgaccggtggtgtgtggggttagcgttttcgcgcttgtgacagcttgggccgatcgtcgcttgctacgggcaccaaacgggttgaccccccgtggaaggcattaaacattttttccccttctttttcatgccaattttgacgtatttgtcgttcaagctaaatcttttatttagataatcgttcaagctaaatctagcacacgagatatttgtggccattatgaataaaaagtcgtttttcgaaactgtttttcataccatcatttttggggttttatttggaatcattttggtagacattatatatatttattctgtgaggagcctacgtgcaccttccatataagaataagttcattttttgttcctcctatttatctcgaaataagtttattttattaatcatatcagagtttgtgcaagtagactacaaatgcatttgagtagactagcaaactactcatgctttatatgggtaaaagaatatactagtatattataatatgttatagacaaaatacattttttatcacaaatgttagtatcacttgtttgcttattaaaatatatgatattcacttgtttgaaacaaatattggactctattccataatatcaaaaaatatcaatggctaatttgaactacaaaagaaatggtgggatagcggtgacagattcactgccagcaccactaatgttttttaaatgagtatagataaaagagaaaaataattatattgaggtttgataaaatagggtagtatagtctcttttttaatgtattggcatatgtggtttggtttgaaagttgtatttattttcgaatgaagggattatagttttgtaaagtgtgactgtgtgaattgtttgagggacctaaggaatggatatatatatatatatataatgaaatttagaaaaatcatttttatttgaaattggacacgggaaggcagacactatgagttcgtgtagtaaaacagggtgtgccttttgtgtgcgccagctcaggctggtggcggcccatcagatgctgagctggatgggggcccacacatcagtctaacaaaaggtgcggacgtggtacactcgagcgcgtcatgggttt

SEQ ID NO: 51179 - DNA, 6722 bp, Oryza sativa
tcaacacgttgacccggagaagtatttttagccggcaaaataattatattccaatattatttccggaaaccaaaataaggaaaaatttttagatcctttaattgtcaagttagtattgttttaaagcctaacaggtggtcggtttggttgacttgccagctgaacaacgtttctcatacttcttttttttttctccctgccctaatttttaaacgcctcccctttcacacacaaacaaagcaagcttaattagattcttaatctttagctttctttcagtttgtttggtcgtctttgtcaaaccttttggatggatggtaaaggggagctcaagctaaaccaggacaccctaatttcattttcggccaatgctttttcattgctacgaaaggtggtcaatatttttttttaaaaatgtttttttatcaacttctaatcacatatgcatgtggagatgatctcacaatgccatactataataaaagatcttaatttttttattccgaatgtgagatcataagatggaagctagctagggtgcgttcggacgtaggtttcaacttctattcccttgttttccacgtgtacgttttttaaacagttaaatgatgagtttttttttaaaaaaaaacattagttttaaaatcatattaatttatttaaaatatttttatagctaacacttaactaataacgcgttaataagccaccgtgttttacatgtataggagagaagttcacaatcttctcttccgagggcatcctaaggccccgtttggtagagctcctaactccaactcccaactccaaactccaactccagtgagagctagctcctctaggagctgaggtaggtaaaaaagtgtttggctagattactcagctccatatttctacatcctttgtcgccatttcatcgaacaccttctaggcgtcgccttgacgttgccgccgtagccagtcagcccacgagccaccgccgccgagaagcccacgcatctccgccgcctcccaagccgctgcgcaagcgccgccgcacaggccgccgccgtcgcccaggctgcctcctgccgacgcccccgcacgcgagtcgcctgccgacgccgccgccgcgtgctgcccgtcgtggccaccgcaacaccgcccgcagccgccgccgccgcctgccgccgccgatgcgccgcggcctgctgcccccgtatgctgccaacgcagacgccgccacaaccggttgtggccgtcgtcggaggatggggaagaagatgggccgccgccacctgctggccccgccgccgcgccgcccgtcctcgtcccccaacagccgctctccgccgctgccgcagccccccgccgccagcctccggccgcgcgtgcgtgccgcccgtcgtcatcccgcagccgccgccgccgccgctgtcgctgcccgtcgccgtcaacgctgccgcagcccgccgatgccgccgcactagctcgggattgagaggaagattgggggaggagagagaacgggaggaaagaaggggtgaaagggtagttgagtggcattttcgtgtaaataccactaaaatattagaaggtagtgggttttttggggtggagtggagctgtggagcagcaaaaaaccaggttcacccccgtagtttattttttaggagtagctctgccaactccactccaaaaaaaggtgaatctggaccgtttggcacagctcccggttcaggtaagttggagttgggagctagagttgtgccaaacggggcctaagacagtgatgagctcctcctagtaattagcaagtgcccataagccggtcataaatgtgatccacgtgaaacaacctacagatgcacagatctcaccaccgcacgctccattgaatcatttgcaaggtcgcaattaatcatcgcagatgcatctgaagctgagaggcagcagctagctagcagctgggacctgcaggtgatggattcaggattcgcatatcgatcgtgaatgaatgaatgattccctaattaacccaaagtgttagtgtcagtgtcagtgtttaatttgttgctccgaagaaaagctagctcagccttttgggagctcaattcgacttgctagctactaatgacggattactgttgattaattaatcttcaactgcagtaatgcttgctagctagctagtagtagtactgtactcaactggtaaattaattaactggttacactttgtaggcttgtggatggatctgacgaggttgattaattagtaatttttctgcagaaattgcaaagctagatcgatcgattgatcgatctatcgagcacgagtggcacaggggatcagtcggtcggtccaaggtcgccatcagagttcgtcggttggtctaattacccaactgacctagtagcaaaatactactccctatcattttttaatagacgacgccgttaacttcttacatgtttgaccattcgtcttattcaaaaaatttacataattataatttgttttgttatgagttgttttattactcatagtactttaagtgtgatttatatcttatacatttgcataatttttttaataagacgaatggttaaacatgtgagaaaaagtcgacggcgtcatctatttaaaaaacggagatagtactaatctatagttatttgattttaattgcagctgagatcgatcgagtggtgctccatgtctcctccgtgagagatcgaaagcttcttctttattaatccttaattctgctcggccatcacgtcgtgcgtgtgtgtacgtgcagtaatggccggcgatcgatctccctgtccatgggtggattaattactctctttaatcttcttcttcctcctcacgtcgttgctcagatgataataattcgtggatactacgataggaaggcttagaaattagcttgaatttttatctttagaaagttagcttaattttcactgttgcgattcagacgatcagtgatatgatatgatgcaggtgttgtgccgcagtaagcggtaaccagcaattggttagttatcagttgacttgcaattaagtaggcagacaccggttaaactttttcgtgtcaggattattgttaggtccaatgccaacaaaatactactccgttagttttgtccatatacatcatttcgatctcgcatgctgtttattcggtcaaacctgtcaaaattttgcctaaacatcgcgacaatgaagccaatcaaatcgagcaatagtcgccttgattggctcttctgtcaatggacagatggagagagagagagagagagagagagagtttcagtacgtgacagatgcagatcgaattcgatcactttcatggaaaaagtttttgctgtgaatcaaacagatcatgcaggaaccaaaggattggaaagaaaaaggatatttgagcacaaggaacagcgaccccaaccttatagcacaaataaagaaagatgcaagaacatggataatggcaggcgcaaggcgacttgaagaattccttctaagttaaccacaacgtttatgtaattttgtatagctcttttttgcctctaggagatgtatttttttacgcctatatctaatgaaatagcacaatctcgtgctgattccttaaaaaaaaacagatcatgcagattaatcttgagagttgagagctactcttactgttcatgcatgcacggatgcatacatggacaaaataaaagggactgacgatgcaaatctacaccactcaatcaattctaatccgagatctaccaaatgtgcatatgcagaacaatttgccatcgagaaaccttgaataattacagcgaaacagtttattcaggaaggacgcccaaaatgcatggcaaaacacaagtagttctgatgttttttttcatacattatctatgacactaacatatcatctgtaaataaagcagaatgagattatagtcatgcgtgtaatgtgtatgtgcatacctgtgtatgacaggctgacagcatataccttctgaattacgtacactgctgaatttcttctttgattaatctattgccttagagtccagattttgttcttttttgtattatctgttggcttcggcctgttagttatcaattgactacacttcattggtcatttggaaaaggaattacaataaacaatcatcaattaagctggctgctagctgcatgacaggccagcagttgcaggtagttccagaagtagtggcacacagacgagtagggaccatataccgtttagtttcagcaacattttgtctataatcaatcggaacaagcaacctgattaaaataagtgcagggctacacaaccaattaaaacaacaagaagacatgagactttggccatctctttgaacccacaaattacacgtgaaacaattcagtagattcagttcataaaactggataagttacaagcaagtttctgacactttgacctgaaacttgttagctgggcaagttcagaacctctcaaaaattacagtactaaactgatccacgtgataaacattatcaccaagaactcctttaaataatctccttgggctgtcggtgagcaaggttagcatcagcagcatggcactgatcttcatcgtccacacaagcatatcatggcccattattcagtacagtactcggcactgtgccagtggcttcatcgtccattgatggagcaatgcaggtgaacgatggtgatgatgttcaatcgctgtaccggcctgtgcatgcatgcgaatcattgaaggcgaaagaacccatcggtaagtagattgcctgtccattcttgacgaccagtagtaaatagcagccgtgcgatcctgcaaataattcaagcaagagcactggtgagttgcagagatcggaacaggaggcgcccacgcggctctcgtcagaggaagaatctggaggagaggagacatggcgctaattaggagtccagtagcagtgatggtactgcgagattagggttctaattagggtctggttaggccattgttgcagcaagttaaggtactagtttgtagtttgcagagatagtagcttgaatgcatgaaggattgggtttttcagaacttgaaactgtgcagacaagttagaaaacgtgtgagatgtttggaactgaatatggcccgagagatttttgtctgaaattcttctagggtggtttggtttgacgaagtttgtggaactagcagcttcaatgcatgaagaattggtttttcagaacttggacaagtttgaaaaatcatgtgagatgtttggagcttgaatacggcctaacattatttgtccgaaatccttccaaagtgtctgaaaatttttccaagatacagcctaggttgtacgtagattcttcctatgtgtggatggttgcgaccttcaaattatcaacagcagcggcgtgtagcgtactattggttgcaagctaccgggcgttgcaacagtcttaacctatgattgattggcacatggaagaacaatcttgggatctcatatctgagtatatatatattactgcaaattagttaacccattactaatccatggctagaattgggctatatgttcttctcggactctcccgacaaacgattcaggctccgcgttgaaatgattagacacaccagcttagctagctcctaattttagtatttaaaatgaagatgaattctgcatgcggccacctttgctggttaatcatttgataggctgtttgtcaatctgttttgcacttctgccttttctttttttggcagctccattatttgcatgttgtcttatcaaccgcattcagaatttaaattttagaattaaattttaagttgatttttatgtttttttcatcgtagtttgttttataatattggcttttcaattggtaaaaaacaccgatatgaaagttttattataaattatttatattactactagtaatatttttttttttatggcttatcaactatagagcaaactatattttttgtgggggagaaaataagaagcagccaagactggttgttgattagcaagggccgaacgtaagggcacaaaaagattaagcccatgaatgcaagatgagctaatattgtcgggttaaatatatttgggccttttctagaaaaagaaaaggtatatgtggacctcaacgcgcaggcacattgaatagtgggccaaagataattggaccgaaaggcccatgggcttcccttaggcaaaaggtaattggagctgacgattgccttgattgtcctttagccatatttatgtggttttacttttatataagttaaccacctccaaaaaattttctagatagaaaacatcaattttaaccgtcaacagatatctacatcacaagtatcacaaaatactattacatcataggggtagaatgtacgtgtgtgtttacatagataagtgtgtggatgttatgagcgtatgtgtttctacgtgtttcttaaaaaaaaaagaagaagaaaaaagcttgcatcatgggtgcatgttggtgagccaacagccaagtagcacaactgcaaaagattccccttttagatggacaaatgacaaacatcaacaggttgaatgaagttcagtggatatgatttcattttcgtctcaaccttcaaccaaagttatattgtccatacatccatgagccgtctgttgcagcgtcgaaaaggcataaaaatcggagcct

SEQ ID NO: 51180 - DNA, 8539 bp, Oryza sativa
gtcaattctaaaactgcaaagtcaaaacctttcaattatatttcgaccagagaaaggaggacacatgaagctgcaagtgagatcgatgcaattttttttgaaaaaaatctcaagattgacttaagaagatggccatctcaagattgggctaaaataacatatagcccaattcggtcgtctgcattataggagtattatctgtgccaatgtcaatgcacctcttgtcaaaaacactaattttcttatcccaaaaagattgtcaaaagcattacgtatacatggagtgataatgacaccatggtaataaactagtttacttgtggagtgttgatttgcatgtatactatatactccctccatctcaaaatgtttgacgccgttgacttttttaaaaaatatttgatcgtttgtcttatttagaaaatttaagtaattattaattcttttcctatcatttgatttattgttaaatatacttatatatataatacatatagttttacatatttcataaaagtttttaataaaacgaatggtcaaacatattttaaatagtcaacgccgttaaacatttagagaaagagggagtaatataattgcacacaagagagatactcttgcatgcatgcgtacaaggagatcaggagatcccattggaagatcgatactcctcgttatttctaatttgactggttccaatgcatcatcatcgattcatcgatccaatattgtggcgtcatttagctagcaaggggatcgatgtatttaattagtagtcaatgagcaagatataattagtactctactattattttgtctcctaaactttggggttaagtgcattttgcatctttgaactcttcaacgatatattccaggaagatttttcttataaaatatgctttgtttataagcaaatcgatcatcagcatattcgagtcgctagaagctagcatttgcagaattgcaggactgcatatatttacactgctgccccgtatgtttctgcaggataaaggtcattttggtcttccaaactattttgccagagcacttaacccctgaacatttttccagtctatttaatttacacctcgaattattgaaaacggttcaccattactgatagagctattactttatgatgtctctctgtataagtcaccatttgcacaatatttcgttaggactgataaagacgcgtggtaccttacctctaaacattactagatgctgttttcacttttacatatggcggaaacatgaacacgggtgacaacatccatgcttgaaatactacgcacatacttataaaaaaattgaaattatttccaaattttgatgatggcatcatctatggatctaaaaagttttagcttaaaatatgacttgtataaaaaaatagaagaaaaatgctattgaacagtaaagtaaaacaattataatagtttagaggataaaataagccaaaaatagtttagagtggtaagtactccaataaaatagcccacgggagtaaaatgtacttttttttattattagtttgtgtaaacaactaaacacgattaagcttctctactactccctctatactcataaaggaagtcgtttaggacaatgtttaagtcaaatcttgggaatataaatcattaataattctcaagttgttgagtttgaaaatgtaaaaattatatgaatagatttgtcttgaaaaatactttcataaaagtatacatatatcatttttcaataaatatttttatagaaaaaagaagtcaaagttatgttttggagaccgtgtcgctgtccaaaacgatttccattacgagtacggagggagtacctcttaattagaaaaatacactacctccaactttccaagtctctgaaagtgtgcaagtaatgtgcatagactcttgcctgtagaaagaaaaaatgcctagtggcagctggtgttgaactgttgcaattaattgccacaatggatggaccttatgctgttgcgaagagtcctcgtcaaccagattaccagcgctttgcacaatcatggtcagcactagccaagttgctgttgttttgatcattcttgttaagatagccaaacattttttctagtggcaagttgccctttcagatatgttgtctgttgttcgcacacggcgacctcgcattccttcccaatctcttgcagaagaacacattaaactagtaaccaacttgtaattgcactgcagatccaatgcatgcagaatgaaaaaacaatgcacaactgtacaccctatgcagctagctgtgcattctcaagatatatcatgtatatgtatatatatagcagatataaatctgtaagcttcagccaagcatggaattatggagtagtactgtaagaaaatgacttagtgatgagtccattatttcagtaatttaagtattggttcttatccattatctaaaaaaaaagtattggttcttatgccatacacttatactacagagaagaaaaatcttctcactttgaaatacagctcagcgtgcaccatgacttatattgaatacagatatgttcattaagctccctccatctcaatttctcattgttttagcatttaaattttttatcaaaatacttgccattatcacatttaaaagcatttttagaaatgtctgtcccatcctacccttcattatctatgcagtcatacgtacgtactagttctcctcacaaaaaaataattgttaatatggaaaagatgattatgatgtaattaatgaggatagcaacgtaatttgtcgcacctcttagtttaatatgagattccctaaaacgataagtagatggaaatagatggaataggatttaccttgttatatgtttcatagcttatttctcactgatatatgaatcttacgggagagatgatctgaaaaaaatgtcctaacttcgaagtaagtcggtaacaaattcccagacgatgcctatatggtatgaaaggaatggtcggctaacatccaagctagtcactaacttcgtcaactagcttaatgtgagcatgacaaatcagaggctaggaaacaaaaggttatctcagatgatcaagaaccaattggctggtcaagtcatcctatcttttccatgatattgtacacatctggttaatgcgtattgaattcatgacttgaaggaataggagctatttgtgcaaatctagctacctgccatttgtttaacatgtgtttttgttgatttgaacatgataagaaataattatatatggagataatccaaaatataccattgacaagagtctaattaatttcacgttttaccctcgactattgcaagtttctgggaatacaaccatacaaacgtcattaaacgtcattgtttaaggagtgctattgtcgtcactgttccattcatgggctttcgttagccacagtggaaagacccgtttgtccttgtgaaggctgtacacaatgtattgtcctacttattttgataccgttaaaattatctttcagagttcctctccacgcaggcaacccctacgtgtgtgccgtcaccgtgactttcaagcgggttgtatgccgcgccaacacccgtcggccactccgccagacagcaccactgctgccgggggaaggaaagatctacttttctttggcccaccaaagtctttcccaaatttgctttggtaaggtttgtgaccttggtctatgacaatgagggcaatttggttattaatttggataaaattaacatttgctaacagaaacccatgaacggaagggtgacggtgatgacatttcttatataaagatacctgtactaccgtattttcttatacttacactcgctgatggcaaaacgtaaaagagaatcccttatatgccactagaatttgaccagttcccttatatgccacttaaaattggcttctctcttatatgccactagttcaatttttttcacacttttatgccactcccaccactatagttttagttgactgttagtcaaatgttagttttttttcttaaatgaccaatataccctctcaactaaaaaatgtgtaaacttcaaaaaatcataactaatttattttaaatcctttttgagtaaacaaaattttgttagaactagtgaaaaatgctatttatattaaaaatattattggaaaactgcatatttcatgcttatattgaaaatttatttgtgatggtaatggctaaaattgcatgtgatgcagaaaaaatcaattttcatatgttgtatcaagaagctatattagtactaaaatacatattattggttgtatactaattctcaagggcaaatgtgtccttttacaataaagttaacggtcaactggcggtggattgacgggaatggcataaaagggaggagaaacttgaatcggtggcataaaagggagaagccaagttgaagtggcatatacgggagctggttaatttggagtggcatataagggattctctcaaacgtaaaatcagatgcatgtcgatggcatttcttggattttctattatgcatgactcttgttcttcgtatcctcttgtattagactagcacactagcataaagccgtcagagttgagttcctaagcataaaccatttgggatgaccacaattctcaccataggttccgttgttttgagctaatggacgagaaacgcccaggggtcttccggctagctccacaaggtggtggactagacgatctaggttcgaagcctcaccccttttaattatttgatattaggtctttccctaatattcgcgtttttgttttgagctaatggacgtaaaaactatatacattactatttcttagacaaccatttctaatttatttgttaactttatactccctcattccctaaatgtttgacgccgttgacttttttaaacatgtttgaccgttcgtcgtcttattcaaaaacttttgtgaaatatgtaaaactatatatatacataaaagtatatttaacaatgaatcaaatgataggaaaagaattaataattacttaaattttttgaataagacaaacggtcaaacatatttaaaaagtcaacgacattaaacatttagagatggaaggagtaatatattttatcagctagacagcttattcgaatagccttaagcaaaaccttttttgacgtgactacttttgtggaaaagttagacaaaaacttcagaccattgaaatgttttgcatccccatcatcttagcttttggatgcacaaccagtaacctaaattctagagacagaggttgacaactgtattgttattggagatgtgagcccgtgattaagacagtacaaaaatcctctccggccgccgcaaaaagcccctgaaacttgcagattctccagtcaataatgtcttgtctgcacatcggccgggtcagatcgatcgatcgaaaagtctctcagcaaattctccaagaacatatgctcgatcgaagtgtcgaacacctgtgcgctcgatcgaattattattccttcacacgcggagaagacgaagcaatggaggagtacaacgtcgtggaatcgatcgatcgatcgacggcgacctgacctgtcctgcgcatcgatcgatcgatcgctgcacgcggctcgcgatcagccaagtggacttacgccgtcagttcgtctccaatgccaaattgccaatcaaaatgcagttggatcgatcgatcagttcgtaactcaaagcattccagttaatggggcataataagccaaccaatcatcaatcaatcaatcatgcatatgccgtgctgacgctttacacgaccgtgcataatcgatgattagtgtacggttaagtactcaagggagcagccatctctacttaattggttaattatagttagcagcagctgaagctgcgctgtactgaagtttcccttgccgatgtttctcccaacaagatctcccaatgcgaacagaccccaggtattaaggtatccatggaaggcatgggtagatgtctaatacgcaatgcaacaaattaaactcgagatctgctgctactgatcggtaaggtttgcagtggttggggaggaacagcaaatatcaggccaacctggcaattcatattcaggcaaattggcgagacgagacaggggaatatatttgccgggttcctgcgttgcctgggtgtgcctacgtgtaactaacgtgttggtgctagtgtggttgctgcttgctgctgactggtcgggcgagagatctcttttggttcccgtgctattcttgtcgcgccatggtaggctggcatgggaaattctgtcgtctcgctgctgcaagctaggccgtgtcagcagaggttgagccggaacagatccaaacatactggagaaacacaagtggtgtggtgtggtggtggagttatggtgcatatgacttcacccatcaaagtttaaatcatggtgtccacagatattacgtgcatataatatgtacgtgtgcgtctgtactctatcgtataattttgtttaaaaaaattcaaacatactccccgtccaaaataaaaaggcttatctcttaaaaaaaattagtaagaaagaaagaaagtgtccagtattaataagaaattaagtagagtatcgatgggtactaagtagataacatatactcctattaaatagacaaaacttatccatttatatgtttcttctatccaaaagtattaggcatatttttagtttttagtttttctaaaagagatgattatatttatagactatagtttctatatgctagatcataacctaaggaatcatctggcaatattcatttgttgtatgcatgtataaagttctttgattttgttacatgaggttgagttaattcctccttgattttggtgacaaagaatatatgtcttgcatttttgtcgggagtactaattatgattaagagtgtaatcaacctgttttgagataaattttgaactctaaaaattaatttattttacgaaaaagagagtagagcggaactaccatattcattaggctaaactccaaaatttacatataatttcctactagcaattgacatcggaagtgaagtgttaagtgggtttattcggttgaatacggaatacccatgttttagaaaatagctctctatttaaacttaaaactagcgagatatatcttattttcatcactgatatattatagtataaagtttgaatagccaccatcaaaatctaccacacgcctctagccaagccgccaaggtaaggatggactcaacattcaggggttcataaatacagccacgcaagtcaccggagatgggaggggagatgccatggcagaaacattgttgggtaataggtgctcaaatttgtccctttttagtgtgtagatcaagtttgaacttgagtttttgtggagtgaagaatatcactctgcattgtcaaatttatttttgaaaattttcacagccattcattctatttaatttaagaaaaaagaggtatatgagggacatgcactcaagtgactaaaatccattttatatccaatagtaaaattcattgacatggtcatactgatttaatatgatcattgccaggacactcggatttgacgttgtacatacatgatgcgcttccaaaattaagttacatcgaaatgatgatctcaaccaaataatttttcttatcctaacatgggtggttccttatagaagtgctatttattcgacgagggtgaccgattaacgtagggttgggttgacatttatatttggggctttattttccattcaaccatggacctttctggaaaggattcagaattgattgtagttttgataattacagttcaaccatacggtatataaatgaaaagaagtcaaagcaaaactgaaccacaaaagtcaatcaactaaaaaaatgtccagagtgatatgcagttaggatatcacttgaacaaccagatggggagcatggcaagtttgttttttctttttcgagggaatggcagtttgttgctgcaaaatatttttcaatttagaaatactgaacccctgttggatcctagtccttactgttactgtaacagtaatattttagagttttaaatttttttaaagcaataataaaagtaccaagtgtactcatgcgtagggaaaaaaatcacagcaagaaaaagtatccattattaacaaaggagttatgtaatttttttgtaggaattttacatgaattccctaggagctgagagacgatttgatctcatgatcatctaactggagcataaggagagaattaaccttgaatgagctagaccagtcttatctgtattaatttgtcgtctctccaacatgtgagagagacaaattgggttacaaaactaatggtacaatagataaatgaaacaagtgtatgtcaccacttaatccccataatataactacctttgcaactgataaatatgttttttttaataatttaccaaaaaaattacttatacttcctttaatcaatt

SEQ ID NO: 51181 - DNA, 5210 bp, Oryza sativa
gtgacctggaacccgtttgcgctggcgcaccggaccggcacgatgttcacccccgtcctccacctcaagtccctgtcaaactctgcacgccatggatgtcagctcagcctgccactctgttcgatcgatcccaagctagctagatgcatggcaatggcaatggcaatggaacagtggcttacccggggtagtaaggggtagggatgagcagggcgtcgccggggttggcgaggatgaaggtgaggagctcgttggcggcggtggcgccggcggtgagcacgatgtggtcggggtcaaacctcgccttgccgccgcgtatcttccccatgaagctcgccatcgcctgcaagcaacaatggtggccaagcaagccgccgccatctcgatcagtccaccatgcatggcgttcgagccaagcaaagcaagaattgcaaactctctctctctctctctctctctctcacgtaccttcctgaagctcttgaggccatggtaatcctggaacagcgcgttgtccctgaagctaccggcgccggcgccgccggtgctccagccggcggcctccgggtggtcacggaggtaggcctcgaggaggtcgaaggagacctggttctcggcgaggcccatctgtatgacgccgtcggggttatcgacggcgtggtaggggtcctcgtcgtaggccttccacccggcgaagtacggcgagtcctcgccgtgcgccgccgacgttgccacctgcgacagcggcggcgccgacccggcgaacgccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtgggaggggtatatataggcaaatggaagtatatatacctatgtgaaaaccactcatgatcatgtgattgagatgtcagaggctgctcatagctgtatgcatataggagggttcactgttgagagatgaccggacttttttagctttcagaggattaaagaattggagctcgagcttgaccaacctatactaactactaagcttgatgattctttttgcccaatgattgattgctcactctctctctctttctccctgactgacctttcagtaaaggaggaagttagcaatacagacagtgtagcgtagtacagctgtaatcagaaattcagatcgtcgtctgcaaattaaggcagcttccgttgtcgccattctccggctgatcgaagaaattcaacagatgcagcagcagcagcagctcaagccgtcaagcccgtgcgatcgtgtctacaggtgttacgccttatcttctcctttaacccaaccctttgtttaatccaggctaatgcccacgtcgtcatcgtcctcttcatcgtcttaacaaaaccagctaagaaaaaaatttatgactatagctctgttaccatattaagttttaatttatcgtctgcaggtttgatggttatgaatgtcactcggagtaaaggtaacgaaggcatttaaatattttataatgtgtttgacctccaaatgccagcgattaaacaaggttattcaaccctgtaaccatggacgacttgtctagctagctatctcgagctgtacgcggggctaaggattgcactgaaattaatctcatatttaaacaaaccgatcagcaatactctgttgagatgccaatcaaccatctctccctcgaattaagaatcaacatatataaggatggcctctgctcaccgattacgagaccagccatttgattatgcacctcatgatccacgaaagtactatgatagtacatccgttgccgaatcattgcatgttgcaccgcgatatatattcacaatcttttttcagtccaaaatcctgtttgctatatatattttgaattatttaggaccattattagttatgtattacaaggtgttttagttttatcgtaagttaaacttcttcaactttatcataggtcaagtaatatcgacaacactaaattaatttatttaaaaccaatcatcaactatatcttgatgatgtatttatttggattatcaatgtcctgggtaaaccttccattcataaatataacgtggtttacacataatgtcaataaccaaattttaacttaaacatcaaatacttatgactgaaagaaaagaaaaaaaatctctttaataaaatttatgtctcgtgcagaatacaatacgatttcatctttcgtttcatcagaaaaaatctgggacggaaggattcgaacctccgagtaacgggaccaaaacccgctgccttaccattggccacccccatttcgggttttatgcgacactaataaacagtattatgtttatttcttattcgtcaatcctacttcaattacataaaaatggggggtattctcttggtaggattctagacatgcgaataatatagaatccaaaaaatacattgatcattacatggaattctattaagatattatatgaaagtcgaatttcttccactctcatttgagagtacgaatacaaggaggtattttgtgtttgggaaagtccgtttgagaactctatccatagagtagtataggccatactttctttcttcctattttgattctcgtgaagtgtcctttcttcctacagctgatagggtaaaatcgttgttttgacgatccctatgtagaaagcacccttttctagtaaatattagaaaatttgatcctttcttatttttctttctatagtggagatagtcgcacgtaatgacagatcacggccatattattaaaagcttgtggtaagaaggggtttcgttctagtgcccggaaataatattccaaagcctttgtgtgctctccattgtttgtgtgtataaggcctatgttatagagtatataacttcgatcatagggatcaatttctagtcgcgtagcttcataataattttgcaaagcttccgcataatttccttcggattgagccaacacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcagagaaaaagaggtatttttgttcatggaatattgatagagaaaaaagccgactatcggatttgaaccgatgaccctcgcattacatttatagtgtaatgtgatgcctccggtactacttcaacctaatttctcactgaaattgttgctcggaatgcacttactctccttcattcaaatgcttgaattatgcttattctttatcgaaattcctatagtttaatatcataaaattcatgtttttagattcactaaaagaaatatatttcatgttgttaactatacgaatttataataattggtcaaagatatatcgtttgacttaggataaaattaaaatgataattaatttaaaatcgatggagtagcttacttggaccaaacctgtcattaaggagtacgaaactttattacaacactgaacctaattgaaaaccagaaaagcttcaaaacctagcagctggaattggcacaagaatggaaacaccgcggtggttttgcaaatcagctttggcagaagaaaagagaaaaccacggaacctcttcgacggttttgggaaattgacatgttgtatatttaaatattccgccgtgcctgattgaaaagcaacagcaaataatcgacaaaaattaagtggctaaccccacgtcagcaacataagcatcaccggcgttggtagcactagaaaatggatggcagatttcggcaatgtttgatgtctccttgttgccatatatggttgcacttttgggggggtaattaaacataacaaattgtagttaggtgctctggttagtttaattcatgttgccgtttaaaatgtccatatgcaacatgcatggtttccttagttagactttgagaaaaaaaattcttgagcattatattaattagcaaaattattgttttcttaagtaagctaaattttgtgcatgcgtgtggcccttgaaaatgtaaaggtaatcttaatcgtccttgaagatcttgtttatttaaagacaaaaaaaactctttttttgcagtgtttttggtgggctctgaagggagaaatgtggattagtctaatgtcagacaacaattcttcaattaatccctgcagggagcatttcctaccttataagcagaatcaaatcaaacatgacatctctgttaggtgagtttccagctgatccctgctaattccctatggatccaattgctagcttgcagaatcagatcatgataaaaagtttcttgattacaatctcatcttcttggcattacctaagatacattacagattgtcagttaggtgccggaggagtctacgcataattttaagcaagaaatgcattattattgtacattatgtcatgaagagattggctcaaacacaagctgtgatgtactaacaaagctgagtcttggagacacttggcagagtgcatatacgtacgaaatacgtatgtaaagaaaccatcgtataaacatatatacgtcgtacgttttgagttccagtcaatgtgcaaagatgtccatcagatctctgcatgtccattaaattggagctttgacatgtacacttatttagcttgatgccatgctaattaatctacagatagataacattaggtttaagataatgccataagcatcatcctctctctgattgatcagaccagtgtatactccaacagaattgtatatgtgctcatgtgcaccacttttgagaacactagctagctgtctggtgtgccgtgtgctacccaaaaggcaactacgacagagaaccagctatgctacaactttatgtatgcataatgaaatttgacaattaattagcacacgttggtggagtagttgtttacatttgattgtgtgattcagctggatcttacacactacagtacaagtgcagcacaccacttcaaagtccagcaggcatttgatgttcctgcaaaaggagagacacccaccaaccagagatgatct

SEQ ID NO: 51182 - DNA, 5133 bp, Oryza sativa
taggagctacaagcaccggacataaaagatccctcatccaaccaattaaccaattaacccacccgatgaaatggctttgcctgaattgaaaagggcttatttggctgatcagcctaagaatacaacttaccgatgaggacacacggtgtccttgtgcaatgtctatacgtcgcactccatcttaccgtgatttcagcacgaagtttttcccccaccttctgcagaaatggcacatccatcctaggtgttgtttatttcactgaagaggtagataaagttaggccatgtaaacaagaaaattattagcgtataattaattgatttttaattattcaaatttaaaaaataaatttatgtaatatttcaaaatgacttctatataaaagtttttgcatacaatgcaccattttacagttaaaatacgtgctaataaaaatcgaggtaaaatctgtgttttaatcagaacaactcactagactaaaaacagctatagagaggaggaaaaagaaaaaaaaaagaagaaatctatccaccacaaaagcatcacaagttgtctcctgtctttgtacaagaggggtttgcgatatatttcgcgggacaaagagacattggagactttatgttctctttccccaacttggccaagtggggttcaacatgtcggcgtaggataggaaatgcgatgtagtcctgtgtggcgactctccccggagacggtgatcgatggatggatacagcgatgaaagctgagtagttttggagacagatcgagaggctgattcccgtacattggaccgtggcagtgcaaggcagagcagatacatgaatctgattacgatttacgagttgccgatttcgtagctctaatttgcagccagccactacagtgaaatatagagaggaccaatagatgatagcagctgcagcctgcaggctcaactcctccaattggtcagataattatctcgacagaatgaacatggccagattcaacctgaccctctcccgcgacaccgcgaggccacaaaccgatcgaattggagggatattggaggaaggtggagcgagattcattcatcgccggtgacctcctagagggccttgaggaggaataggcattagggcgtggaggtggatggacgtacattaccattacccctgtcgatggccacaaaggccaagattagcttcatgtatgaaacttgatgattcatagatgagggacgttaaatgtactctttccatctttcaatgagtgtggaatgggtgggccgtaatgggcttttaggtcaatctgctagcaaattattacggtttcagcccaatacatataaatgacttagggctggttttgtttgaagctaaaacttatcacaccaaaatattggtatttttaacggtaattttggcaatgtttggtttgctgccaatactacacaaaatgttgtcaaaatggtgatgctagcaaaaacttgtctatgttttgtattgccaatattttagcatggttataaccaagcaagcctttgtagattttgagctcctcggatcgtattgtatgtgctagtagcccaccaccaccactactactaccacttatacagtagtcataagagtatgtaggccccatttgtttctgattatgatgcacattttagctcggtttttattagcatattttttaaaccgctaaactttacatttcatatgaaaatgttctaattgctataaaataccaaataagtcattttttaatttttatagcaattaaaacttaattaattatacgctcttacgtgaccctacttaattctcatcttgaactgttttatcaatttagccatagtgcaatactcagtactcaatcatttctattataatcgtagttgtgagtttatgtagttcactcctagtactctccgtcctaaaaaaacaaaccatgggttttcgtgtccaacgtttgactgtccgtattatatgaatttttttataattagtatttttatttttgttagatgataaatcataattaatactttatgtgtgacttgtctttttaaattttttttcatgattttttaaaataaaacggacggttaaacgttggacacggaaactcacttttttttttcgacggagggagtactctctaagccgagtccatgtgcgcgttcgctgacacacgtctccaacgcaaaaaatggagtactcctaccggtagaaatgtacagtactcgcagctactcctgcgatactgcgaggtagcgaaacgccatcgtacgcacgcgccggtcgggcggccgatcaggaggaggcgcgacaggatgggacgcgacgcgacgctcgcgcacctcggcacctgtatatccggtggtcggcccgtgcagccaccgcgagcgtcctgggaattcttaaacgttgccacgtctctcggacaagatgggaataaaatttttttagtctctatcatattcagaatatttcgacactaattataaatattaaacgtaaactattaataaaacatattctatatcttgaactaattcgcgagacgaatctattaagcctaattaatccatgagtagcctatgtagtgctacagtaaacatgcgctaattatagattaactaggcttaaaaaaatttgtcacgtgaattagctctcgtttatgtaattagttttataagtagtacttcctccattcctaaatgtttgacgtcgttgacttttttaaaaatgtttgatcgttcgtcttatttaaaaaatttaagtaattattaattctttcctatcatttgatttatttgatttattgttagatataattttatgtttacatatagtttacatatttcacaaaagtttttgaataagacgacggtcaaatatgtttaaaaaattcaacggcgtcgaacatttaggaaaggagggagttatatttttttataaaattgatcaaactttttttaaaaaatgattagaaacaaatgaaaacaaattctaatatgaatgagagaaggtatattccaacggagagagctaaacaaacgcacgtacacatcgcgttaagtttgtgcagtagatggcgatttgttttctgtttattttggcatctgcaggtcattgttgatttgttggcaattattggcatgaaccggtaaaatactaaaatcaacggggagggttggattgacctggcctggctgcctgcctgcctgcataatatatcccagctggcccattataccatgtggtcactgttacaaatctacaatataccagttaaatttagatagtctagttggcatgcacgcgacgggacaccatactgctgctccatgttggcaataactataattgaccatttagaaagtgcagcacatttcataaaccaacttaatatacaatagtcattttgtaaaatgcaacattatcaatttcaacaacttttagtactactccgcactactctcatctaaaccaagtggcagtagacgggggtgaaaatggtcggaaactataggaatcggtagcatctcttcgaaaacaacgctcggttgtccaataattgatcatatttatcatttaaactattcattgtcaacatcaatacgatacgaaaagaaattacgaaaaataaattttcaccccattgctaatgggcccctaggcgagcgtccatacattatattcctctatcttattgttttgaactgaaacaacaaaagaactgtcaagtatattttaataattaggaataaaaacccaggtgtgttacatcaaaagaaaacaaaagtcgatgagaaaatccaacgtcaaacatgacttgctgaacaagcatgccgcacacgtaacaacacttcacactagcccaccgacgcagcatgcacgcctaatctctctaccttattctctctctccaacgcacatgagatggcaactcatcccatccgtgcacaacgaagagaaaagatgcgggagagtggcttccctttggagaaccccctcccctccctctccctcctttggtgagcttcctccaatgaataagagaacactcaacgagtcccctcctccacctccttcccacgagcttctcccagcaagatctggaaactagctcagctcatttctttgtccgccaccactcattgcgccgccacccccctcgctgccgcggccaaaagtggtcaaagtgctagagtgcccaagcttggccggcctacttcccctcctcttttcccaactttgacccaccaccatcacttgtccatcccggccttcatggcaactgagcccgatccgctcacttccctcctctcctccctgcccataaaaaaccctgacctattggaaagctttcgcgcacgttatgggagcggttgtttgcgaattgggatttctagttgttgctcgctagctaactcccacacatacacgtatatacgcgcgtaagcacgcgcaaaaaaaaaagtgtttctacaacgaatcgacttgttgtcgtgtgcatttggcatgttgccgcacactagctaactatgaaaaaaaatatgtagttgcaaattatatatatagtgaaaatctgtaaactaccgttggatctataaatggacgtttgagatttgtccatgttatccagagtgtaagttttactcccggattcaatcatgagtaaaaattttaccaggagtaattttttttacttttgatgacgtgaataaatctcagtcatctatttttgaattcaatgataatttttagatttgcactacatatatttaggggtgaaaacggtcacggaaattcctgatcgaccaggcgccgtttccgtttaagtggtactgtttccgaccatacccttttttgctatttttaaattttgttttttctaatttctttctgcatactgagcagtttaaataataaatatggtctattaccggcgagcatcgtttccaaagagataccaccgattccgaccgtttccgatcgttttcacccctacatatattacatatatgctttgcgcattgcgctgcgtattttcccagctgactcggcttgccaactcgatctaccggccaatctcgcgttcctcgtggcggagatgagatgagttgagatgagatc

SEQ ID NO: 51183 - DNA, 2743 bp, Oryza sativa
atcgattaacacatatatgatgtagcttttgcttcttcctccctccgttccaaaatatttgacaccgttgactttttaagtacgtgtttgaccattcgtcttatccaaaaaatttaagtaattatttattttttcatatcatttaatttattgttaaatatactttcatgtacacgtatagttttacatatttcataaatttttttaataagacgaatgatcaaacatgtgctaaaatatcaacggtgtcaaatattttgaaacggagggattaattaatttcctagtcttgccacaggcacaaattacctgcacgtgctgatgtcgttaattcgtacgtccatctatatatcgatcgagaagcaagcatcatcgccagcgagatgatcgagctagctagctcatggctggccttgcccaatgctcatattgctggaattaatgcgccaccatcagccgaaattatgatccagatcgattgatcaatcaacggacaactacaagatagctagggtgttacgctgtttcgatctcttcatgtactatgttgtccatctgcctatttatatactctctccgtcccaaaatatttgacaccgttgacttttttaaaaatatttgaccgttcgtcttattcaaaaaatttaagtaattatttattcttttttatcatttgatttattgttaaatatactttcatgtatacatatagttttgcacatttcataaaagtttttgaataagacgaacgtgtcaaacatatttaaaaaagtcaacggtgtcaaacatttagagaaggagggagtatatcaacctgattgaccatcgatcgatccatatcgaaattaaggatgaacaggtcagatagatctagattgtactattcatttccataatgtacgatgctattgactttttacacaacatttaatcatttgtcttatttatttttttagaattatacagtacaacgtagatactcacagcacgcgcactcacccctatgaacgcatgcatataaacagtataagttaagtttatattttatagcatgataaaacaaatcacaataaaattaatgatatttatatatttttaaaatttatatttatatattttaaaattgagggggtatatagctagctagcgacataacccatcgatccattcgctgcctctaattaactaacgaccggtggtcatgcgttctggcgacttatgtacgcagttacgcacggcccggccgtcgttctggaagatagctatatgatcgtacaacattatggaacaggtcaattcttccattttgacaaggcctatcccggctcagtccacggtaatacacccacttgattaatcacccagtaattaactaatcattaacaaagccacaactacacgaatcaaagatcaacttaatttgacctaaattagaactaataatcatttagatcgaggattaagaccctcatatgaactctctttgctataagaacctatacatgtcacagtgactttaaattaatcacctaatctcaatcctcagatcgatggacgagttcagtactgtgctgttggccgttggttccgttgcggcgtacgtacgaccgacggtcagagttcagtacggtgtcatggccgttgttggttggtttgcagaaaaaaatcagaatatatatatatacgtgcaaaatacggagtgagtacgagcgcccgtagatgcagcagagaggtacagcatctagggtcgaatcgaatcaacccgtcaaccacccggaccccgaccaaccacctaaccgaccgaccgactcacttgacttggctctactactcaccatttctctcgttagattctctcactgacaggtgggccccaccgtctggctgtacagagaggctcttgccacctgtacacatagcgccgcgcctacagctcacggaccccaaatacaccattaacaccatggccaccggtgcttcgttggattggaggaatgaatggatccggtggccaaagtgccaaactaccaagtcaccaactgtgcataagcttgtgttttgtgttcatgctctaacctggcaagatctcatgcccaaaccatcaaattttatcaaaaaaaaagggcaaataatagttgtagtaatagtgatggtaatagtactgacctgacggcgacgacttgagcagaatcagcctgaggagataccccgtataagtggccgtatccccaagatcacacgcgggagagggagaggttttaatcatgccgtgcatgcgccatgtgattcgcgcgccaaaaaatacacacgcaataatgacgtgagaaacaaatcaaattatatttactccatttctttaaacgcggggacgaaaaagaaaagaaagaaagaaaaacagaaaaaaaaaacgtgcatgtgcgattggttcccgccgcgtttgggtttggtgatgtggcgcgtggccaccgtcggtgacttgccactgggccccacccgcgcgggcgcccaccgtgtgggtcactgacgagtgggccccaccccccgcggtatattcgggatcccgtgtggccgagctatattagaggcgcgcgcgtccgcaaggagaggcggaggccgcggcgaagccagcccgagtcgtcgtcgtcgtcgttcgtccacgcgacaccgcgtcgtcggcggcggcgagaggagaaagctcaacgaaggtgatcgatcgatcgattgtttgcgaggtggaggaggg

SEQ ID NO: 51184 - DNA, 1796 bp, Oryza sativa
tgtgttcatctgtgttgttgttgttgttgtttcaggaaggatggtgtgatagccagggaacattggaggatgtgagagtgaagcttcacaagcgtcaggaaggggcgatcaagcgtgaacgagctatcgcgtatgcgtattcgcagcagatcgaaggcgctacgaaatgcaatgtatgactgaattcttgcagaaattctgtggcagtagatgtgatctgaatttttgctttgaactgcattctattgcagcagttgtgtactgaatttttgttttgaactgcattctattgcagtagttatgatctgaatctgtgttatttcaactgcagttttggactgaatgtgtaatctttcttgtctttgctcagcagcaaccgaagcctacttcttatggtcggctgaaccagtctggaatgttgcttaagcaccaacatttcgacaagagcaatggcaactggagctggctggagaggtggatggcggcgaggccttgggagaacaggctgatggaggagcacaaccagaccaactccagctcgccggacctcctgtcctccaagaactgcgaggattcattcggcattcttggggacttctccgaaccaaattcagtgaaagtgcgcaagaacaatgtcagcaagagggtctgcgcgaaaccgccggtagtatcacaccaccagcgcatcaaagctcagtcgatctcgtctctgagcactgaattgcacaatgatgagagctcggcatcgtcatcgtcgtgctttgcttcgacaccaatatcgttctccacctttgtcacgacggagaagaccgaggacagcatcagggcaaggccaaactacatgaacatgacggagtcgatcaaggcgaagcgaaaggcgtgtaatgctcaaagaacgacagcagggaaactgatggaggataggaaggcctcaggtgtcgagttgaaggtcgctcaagtttgaatttgcaatgttcttggagctgtaagctgagatgaagccaacttctacctctctagggtgtttgttaggtggattgctccatccacaggtttttcgatgtcttgctgctgcattcttgagttgtgtctgtgtcgccaatctcatgttcaacatcttgttgtcgagtcatcccatttttggggatgtcctcattgtcagtggcagtgtctttgtaagatagctctttgattgggaaaaaaatggtgtggatttgttgcagattgtgaatttcagagaaagggtgtcattacccatctcacatgatcctttagcacttctaccatactgtactactcctatactgtggtctcaagcaagtttccaacttccaaagctgaaaaccaatgtgctattacaatgcagtggttcttaatcattgaccattaggcatggagttttcttgttatttagggtccattctctaaaatgaccaattaggttgtgagaaactatgtttatattttctcttgccgacagacacacctagctgaacatgtaggcttacatgcctactacagcttagggtcaaatgactagagacaaatgattctaaacttgaacacctgatgctaaacttaagtactagtatagacaacagaaatcccagatcacttaaacaatggtcgaaaggcattacatttcagcttagcgattgccaagaccaagaacggggcagcatgagactgcagcagatgctcggtaacaacgtgcagatcgcacgctttgagaactaatctatgtcctgtgtgcacttttaacaggtataaactaatggttgggcatttaatggcct

SEQ ID NO: 51185 - DNA, 7293 bp, Oryza sativa
gcgcattttgtctaaaggagtaatgcgaggtttgaaattgaggagaggttgatgtggccacgtggcacgctccgattggcccaggaggttttgacttcagttattcttggtaattaattttaaggggcaagaactatttcatgatattaaagtttgaggggtaaatttgaaccagaccctttgcttttatttccttaaaagtgcctttcattaatgcctctcttctgaatttttggtttcataataacggtgaaattgggaacaatgaatagggggttttttgggggggggggtaatgggttttcgcccattcttcacccaccaaatcttttggtaataagttcttttaaaagtaaattagaaaacttccggaactggtttactattaccccccctggaagagaacccaaattggaataagaacctattttaggttcctttgtaaaacaacaccctttaggaagtctacaagctagtacttactacatgacagggaattgttgttccttggtgatcaaccattgccgatttcaggaaaaatcttgaaagttacagaggaatcagtgtagcaatcaagcatcttttcttaggctttttcgccaagtgaggctggcaataagaattgctttgtgatgcagggattccaagaacaaggaagaggcaaggacgtggtgaagcttgaggagattgggacagccatgataagcctggaggaatgctgctgggagatgcaactgcagcagcagcagaaaaggggggcaactcagcagcagctggtggttgtccccatcagggtgaggaaagatggatgggcaagtgatgccatgctttatgtaagcaaatatcttctccattttatttgcctcccaattactatatttctagtgaaaatgtttggtgtgcatttttttaatgagttgtatgggtgatgattgatttcaggtgaatgtggagcttgtggacgcgaacacgccttctgagaacatcggaaggactgtttcattcagggagagcagggcgaggacgacgactccggcaccgacaatgcgggacaataggaagagcttggaggcagggacgtaccatgaggtccttgacctgaagcagctgcttgatctggctgacagggagcacaaggtggctgtgtacagcaggagcaagaggaattcggacagcagcagcgtcagcagcatgagcagtgtcagcagcagcagcaccatcagcatcagcagcgccagctcgagcggcggcgccagcccggagcccggcctgtcgtcgaaacgccggcttctaccgtggaggaggaagagccgggacttcgacaagaggagcagcgagtcgctctcccaagaattgcccatgaaatacatggtgagaattggattagcattttttttctgatcatggaatcatgtttgcattggcaatggtgaattggtgattgatcgagatggtgatctgtgtcttacaggatgatgatctggcgggaagctgggagactcgggagttcacgagcagggactcggagacgaagctgaggacgccggtgttcttcgcgtccatcgaccagcgcgacgacagcgccggggggagagcgcgtgcacggcgctggtggccgtgctggcggcggcgctgcacgccaaccacccgacgatgccgacgcggccggagctggacgcgctcatcagggacggctcgtcggagtggaggcggctctgcgacgacgaggcgcacatggcggcgttcccgaacaggcacttcgacctggagacggtgctcgcggcgagggcgaggcccatcgccgtgcagcacgacagggccttcgtcggcttcttccagcccgagagcttcgcctccctctccggcgccatgtcgttcgacgacatctggcgagagatcgccgccgccgccggcggcgagccggggcgcgccgacgtgtacatcgtgagctggaacgaccacttcttcgtgctcaaggtggaaggcgactgctaccacgtcgtggacacgctcggcgagaggctcttcgagggctgcgacaaggcgtacatgctccggttcgacgccacgtcggagatgcgctcggtgtcgccgccgccgtcgtcgccgtcgccggaggaggaggtgatcgtcaccgggaaggagtgctgcagggagttcatcaagaggttcttggcggccatcccgctgagggaggagctggagatggagaggaagggctgcgccgacgcgccgcccgccggctgcagatcgagttccacttcaccgtcctgaaagaagaagaacaagaccaagcaagaagatgatgatgatcagtggttgtagctctgcaagctgactcaaagctgtagtctgtactaacaaacattcatgtacatttctatacatatacagtacaagaggaacaggaaatcacagcattgatacatacggatactacagggatttttggatagtaaatattattgtaggcagacacaggaaatttttacagaaaaaaaaaacagagttcatggtttgtcttacctttttttgtttggaggcaggaatagggtccatttcatctcacctgtcaaagccattttgtaagcatgcccaggactcactgcacattatttacatatagtaaaatctaggggcttatttgaccccgtttatcaagatggtgttcttctctgtgacacatggtttccttctgtgacacatggttttttcatttaagtaaaatctattaactatcaagatggtgttctctgtgaatcaactggacaatgtattcatgactgtaggaatcgttattattaactacaactggaatgtcgattcctccattcctaaaaccatattgagaaatctatgaaactaaaaactgtaagagcttattcctctaaagagtttatacacagtttagaagagagctggacagtcaacgatgacccgccgtcttctgatgctgtagatccaagctcatacattttcaaacctcccccagacgctatggattcatcaattcttctcgacatcaagcaaccaggcaccgcctcttcgtctgctggaagcctggaagtatttacatgtacatgggtagcctggcattgcttgatgccgatggcacaagagctagtatctggttctttatgacagcgataaaattctctatttcgttatagatgggcaggttctctgcacagcttggtcgcagcattaagcaagcacgctccaggacgcctgctatgttaggaggtggatgtcggccctcgctaaaatgctgcataattgaaaaggaagatgtactgaattggaataattctagtaaccatggaggattagtgctagtgaagcaggtgaatgttttaccttgattgcaagaagcgtggcaatgcagttgaatatcaggttgcgcggaagttcagaattagcagcagattccggttctgggcctgtacaatccgtcgcttcatttgatatgcctgtttcttctagagaacttttaccattctcagagatttcctggcaaaacatcaaataacatattgagtgagaaatgcaaaattagataccttgagggaattgatcagctaaactttaacctaccttcatggcttcgtcaaccatctgcttggcttgtgccaatgacatttggacaaaggaagtaatataagaatctagctcatcattgtgaccattcctgtgctctgacaaacctctactccgtacattgtcatcaacagactggagcggctgtaatggtccacaattaccagatgtactcttgttggatagtctttcaatatccacagcaatttcaacctgtgatagtaaatatattaatcagcattagaacatttcacaaacgtgagcagttggccggttgcatttcatggagcagtcaaggaacaggcagcatttgctgcatggccataactcgtaacctgcccatggatagatagactatgatcgtaatgcttcttaaaaatagatttggacagcaaaacctcaacctgttcatctgaagttatgtgcatggttttggatggctcggcctctccgctgatatgatcccagttctcttttgaagtaaactttggaatttgctcaacctctactctgttgtgtgaattatttgaaaggaagctcctctttttgaggtcatcaggcagattatccaaccagtttacaggcatacaatcagtgtcctgaaaaagaaacaattacatgtcttgacataatcatataactaccataacagtatatctttatgctaaaatatcatctcaagattcttgaatataaattatatgaatatgaaatgaataagttgtgaattgttgttaaacaaatggttaccaagtgaaaaataaaaacgtgaggagtctcataaatttatttccatgatataaataactgaagtacctgacagctttgtgttgggccatattttttttgtttgtttaaaaaagatggataactcaaattcgaagcatgactgatggtgatgaactcctggcaactatgcatggatgattcagcatactgtgtgggatgtgattagttatccttaggaagactacaattttatgaacactactggaactaaaagggcagatcctctactcaagtgtggtggttgtggtactgggatgtaaaatttactcgtagttcaaaagcttgataacatattttgatatgaattactaactaaaaaatcacagaattcaattgcaaggtcagtgtttagtatactagaaagttttttccctgcctatagttaaaaataatggttgaaatcttttgcagtggctgaattcattgattatcctagatgttgggaaatttggaaacaccgaaatgactgcatattcaactgagtgaatccaaacgtaatggagatgttgcaggcagagtcaacagaagttagtctttagtgcctagctggagctcttgcgctccaagttttcctttgtactaggctgtcgtagggtggttttggtcatgtgtcgccttgtgggtgtgttttgggtgtagggcttgtgagcccttgtttgtatgggtagtagtttccttcttatgaaatgaacaaaaaaaatctgttccaacagatatatgaagaaacaattatgagaaaggacctaatatcctacatagtataacaattggcaatcatgaaatgcaactgatattgaaaaggtgtacctttacttcatcaacaccaaggtcaggcctatcaaactggacattataacgatcctgttccatcatcaccactttaccatcacaaagttcccgcgtacttgggtgacgaacgattacctgctgaccaattgaaaatggtcgagctaggtctggtggtagagaatcccacgaatcttcacttagtagagcatagtattgcctaacttttttgcgataattttcaagtttatctttttctgctgccagaaaatgatcagaaaaacgtcggggtttgccaagtgagctgcagataaaaatacttagtatagcgaaaacaaaaagaagtgaggacaaagaaaaacaatgatatagcttccagagtttgctagtcaatacctccttattgtgctccactcggaccgagtgagccttgacagatggctcaaattcgcaaaattcaagtagttcacaaactcattatccataaaccatggataatcactgcgctgtaaaaccactcatatgtacaccatctacgaagtgactcagatgacaagcaatgctgcaatctcctagcctgaaagtaagccagaattaagactacagttgaactcaatctgtggcatactagcattgatgaatggtgggtgtacctgtaaattatctgctccattgcaaacgacatacttagaaccacaaggacttttggattttcttttgctccttctcgacatatttatctcaggttttaattgtgatggcaaatcagggattttggtagaaatatttgcagttgattcaggtaaatcaactgttcccctttccagatcagaattcaaggcgcactcagtggcatcaacttgacgctcttctggcaaatctaaatgattagaagtgactccttcagtaggcacctgcaaaaagaagtgtgaaaatagaagtgccatcagactaattgaagagagcaatacgggaaagaacacaaatgctgtctgatttaaggtgcacttcgatctcagaagggataaattataatcacactgacaaaatgcaccctattaaaataaagtgaaggatggctttccattgacaccaaacccagaattttatgattttaagggatgcgacggcaatactaattttaaatgcaagaatgaaagcatctaattaaaggataaaatgtaccctataaaaatgaaacgggattgactttccatcgacaccaagccgagaactttatgagtttatggggatgcaatgatatactaaatgttagatgcaatggaagcatctaattgacagtacagtagactcagatataggcgtcaattcatcaaatttggtttgttccccatgagcaagaaagggttcctttaaaaaatatatatattcatgctgtacatacaacataagctcactatttacgatatcttacctcttcagctattaacttctttctccttttattccttgtcttggaggcactgcattcaccaacttgcttcccttgtttggatctcttaactgaaggaccttcctcccttctgtgagacaatgcagaatcatcccttccaagtgtacctgatcaatatacatcagaaaagacacatgcgcaacatgcatgagataacgtatgttatgaaaaaaagatataccaggagtctgaaataatattaccaacctgaaggaatattaatcttaggctctgatattttactgggtacagtcactaaactctccaagacatctaagaccaacatctcatctgcaaaacagtggttgtcagtatttaacattacgattaagcttagcagctccaagaatgactactgaaaactattataagataaaaagtagttgctctagcaccaatcaaaactgacaaggaaaatgttctgacttctgaacaataataagatagcagaggaaatggactcaatgagtaatcaaacactatgaacatgttctcattagtttcatacaggctacattgttggccacctaatgcgttaactaggcttgaggtaatattttctcctttctcactgatagagggcaggagcagatattgctcgctgtcaaggtgaaaatacatgtgaaccaaaggctttgggtctcctt

SEQ ID NO: 51186 - DNA, 8764 bp, Oryza sativa
  unsure (1)..(8764): unsure at all n locations
aaataatgtgtagttcatataaaatatattgtctagttttgtgaacagaaaatggaaccaaaaactcgtatatttacatgaactcaacgaaacaatgagttagacatcaatgatggggagaaatgtctcaaagtacctggggaaaatagattggtaagtctctgatattcagtaaggtcattcccttctttagccaccattgcggttttatgctcatctttaattgtctgaccttgttccatactctgctcaattcttctctttttcaagcttccagttcctttagcttccaggaaagtctgcccttgaacaaacttggctgattctgagattccaggacttccatgagatgagcattcaagctcattattggtagctccactagcctttttggtacagttgatggcattttctgtttctggtatgccagcatgagcaacattcatgtctgcaggaaaaataactggtacacgaggagtacgtttccctgaaggatgtcttggaatgttcttgacaagttctggaaaagcatacaaattagtaaaacaatgcaggccagtagagtaagttattatccaatagaaatgttctcttgcattcaactagctcttgcttctttctttggtaatttcattttgaggaggccaagagaagattaagggataaataaatatatatatatatttgctttacaatacttacctccatagtatcttttcttgaaagaagataatccagaagttcttctttcatgataggagcggtgagcatgaggtgcttccttctctttctgccctgtagcttcacgtttccgtaccttcccagatgctctaactgtttgatcacttcctttatgactcttggattcatcctgctattttaagaatttcaagtgatttaaggaaaaagtagggcaatttgtatgtcgattcagataattcagaccttgcagtaaataggttaattcagaatcgaacataagaagaacaaagcattggtactcatcattcttcagagactgtgatgtaggaaatgcaaaacaatcaccactatcaatagtcaacgcactctagattggctgttagcttgttctttcaatgttagtaacgtccatcatcatgatatagttattcttatgtcacaatatactaattgcatcatcatatggcaaaaactgttataataaaaattataactaaatccaaaagaaccacaatgatcaggagtgctcacacttggccttttgctataacgaaactgacctatgcatggtagcttcaaatagtacaaatattcgcacatgattgaaaactctcaaaaagaaacaactgaaatttggcatatccagaaaccagaagcatactcaataaaacattcaacaagtaaacccatcataagcttaccgaaacattgtgatgaccagttaccaatgcaacaaatcccatggcagtaccttcacgttctggaagagataagaaagtctacagcaagaaatggcaatgtgtaaatactttaggttctattatcaaatttaacctattacatttatctaggcatggctgcaaggtgaattatatattataactaaatattcttgaacttctgcataaataatatatcatcaatatactgtcctgttctagtcttctagatgagcaaattatcaactttagttcacaaaaccaagtaaactgtagaggatgcaaggtggtaaagttcgcaaatagctagggcatattaattatagaacacaaactcacccggtgcacactgtaaagggcttctactgtatctgctgattttccacccacagatgcactgacctgcagagtcaacaaacaactttcttactttggcaccaaagacaccaatgaaacatgaacacaaaaaatggtggtcggaaaattgaatagcaaacctttttccagttttttccatgtcgacggtaggcttcataaaagcgcataagctcatccttgctccattgaggacctaaatctgacattttctcttctgcaaaatcaaaacattttagtgaaacggaaaaagatcatgtctacacattgttgctgagttggatgatattttaagagactacaattactgggtgtcatctaaaaagtatcaattcatcttacttttagtttaaccttgcttgaactatttggatcctcgtcatgctgtcgatcgtcatacccctttattgtgatcttggtaattgtgcgagaaccttttgctggacccatggaaattttccttggcttgttttagagagaaaaagacttccttgacttgaggcccaacaaatattgctgcaagtgagagagaaagctcactaacactatgtttcccaaaaaaaacaaaaaaacaaagaaagctcactaacacaataattagtgtagcatatatacattggactatagactacaacgaaaactaaaacatgaactatattactcctagtaagttatattaatctagcttctaagtttcacatcctaactctaataatgcaaaataagactttgcaaactaaactaatgccaggctgcaaagagaatgtcaattgtccaagtacgaaatttaaacaagggtcagattaaaacaaaactcatgatgcggcccatttagtaatcagattaagcaagtcatcaactgtgacaaggacttcataaagaaaaagattccgggcagccagtagaaaagcaagaaactttggtaaaatcttcacataaactctgagtagaacattataaatatagccaaaaatcatcgaaatttacacataagctatatttgacatgccaacaaatccaaacatcaagaaatataaaattgccgctcagtccacatccaagtaaatagacctttccaggggacaagtcatagcgaaagcctggactttgcagaaccaacaataaccaaacaaacactcgtgttggttcaaagcattgcatggaacaagttagacaagccagtgagtagataacggaattacggatccccaaccacgagatgagaaatatggtgggaaatgaaaattctctgcagcagatacctaattagagacccgattagcgaggtaaaggtggtgtatgacgccaaccggagaagctacagtgaagaacccccaaaagtcccacgccgccgcagcacaagtcaaggaggaggaggggaaggccaagcaaaatcgaagccacgatcttaagggatactaccagagatgaaatccggtaagcgtcgcatcggggatcacggcgcaccaaaaaaaaaacagacagattcgcagcagaagaacgccttgcgcgatgaacttggggagggaaaccaaatcgtcttccagaaatcctgaaatccaagcagacgaagcaagcatctgctcggggggagaaggagaaaacaaaccacccacccaaagccgcacctcgcagttctcaattccccccatccacatccactactcttctctcgaggactaacactagaggaaaaattttcgaaaccccccaacgcgagcaaaccatggagagagagagagagaggggaaagccgcacgagatcaagcatacatctgctcgtaaaaaccacgggaacaccacgagcagccgcgaaatccgcgaattcccagccgaaaaaccacccaccgcccccaaatccccgcgacatcccaaaccccgaaaagccttcttcatccccccgcaccggatctcacccccacagattgcaccaaacccccaccccgacgaagaattcccctcaccttcctcggatcagggctgaatctcgcccgcccgcggaagagcaccaccgcgacgcagctcggcccggctcggccaccggtgcgacgcgcgcgctcccgctccgnctctccctttaccgcgcggtgccgtcngtccctccgcccccgccgccacnnccgcgcgcgtgcaccaggtggagggcgtcgtcgacggggcgctagggtttcccccggcgtggttgaatcgaaggtgaaggtggtggtggtcggttgcgtttgcctttgtggtggcttggcgttggcgggcgctggatacaagtagagggaggaggacgacgagggggatgggggacggatttgcgaggtgggtggtgttctaggggtctacgtgtaaatgtgctttttgaaaattaggttgagcaaaggaaggagtaggatggtaatcccggacgcggcgtggcgtgggccttgctgggctgatgtgcgggccgtgggtcttcggaggtttcagtgcgcaggtaataggcaggtttcttttttacgaaaaccgaatttcgaatttcgtcgttcaatcggaaaaacggatacagcgggtttctcaactgttaaaatataaaataggtgcaaaataagagcaaggtcaataatatagctagctattggctccaaaaaatcccatgtcatctacagccataattagagacgtattatacaaaagtaagctgcagtaaacacatttctgaatattacttttcattttatttattgcattgcacgttcttcatttgcatatagcaaggccaactgctgctcacctatttgctagccaatcactgaagctttgcactgtcttggagctcgtgaggagttgacgataatttagtcgtcggctgaatctctctctctcttcatcttttgcttttaactcagttttttaagccacggtggacagctatcaccggcttgaagcatctattgtacctgctctaacaagtcttaagacggcttgaagggcggtttcagctgacgtggtatctacatggctaatttgactcggtcttcatctgacattgcatttacgtggcacatgaagtaaaatttaacaatttaaaaaataaaacaaaatatctggacccacatgtcaggcaaatactaataaggttaaaaaatagttagtgagtcccacttcctccacatctcccctctctacctccatttcctccggctcttcatcggcgaggggacagggcgcgtcacgcaggcggccgacgggagaagaggtagcggcgcacggtgacctgtggaagaggagcgacgtgcggtggcccacgggaaaggagcagcggccaatctcccggtctcttccttctccgccgcagcatggatccttcgctgagctgccggatttgcacagccgcgaggacggtccgctccagcccacaccttgacacataagcagcacatggtgagcaggtagagcggccactgccgtcgtcctcccctttctccacgatgtcaaatccgagcagcgacatcgcctcaggatacgagccaacgtgtcggcgatggtgagctactgcaagtaggacgtggctattgtggccgtccaagaatcgctacgacaacgccattgcagaccaaccaaccgtcacggggaagaagcaaagggaaaggtcggcgccgaaggtgtgcacaaacaatagctccggagcagcacacgaaggtgcaggagggagtgtagaccgtctccatggcggcatcagtgaggtggtcatcgagggaaaccgctagcagcatggcggtggcgacgcaggatgagacaacgaggacaccgcagcagagtgtgcgacatgggcgtttgatgtcgacgaaggtgacgagcgtggctgcgacgccatggtggttgacaagccgccaccacaccctcccgctccaccctctccgcctctgccaccacctctcccgttcggttgtcgtcgctggcgtgcatgcgtatgggaagggagggagagaattatttttaataaacggtgtagcatattacaatagtttatttagtgataaatctagtaacatcattctcacatgatcgatagtgagaaatctaagaagttttacgatagtttatttagtgataaatctactgcgttcggcccaaggagattgtgagaaagtttgtttgtttttctgcgcgcacgcttcccgaactactaaacggtgtattttttgcaaaaaaaaatctatacgaaagttacttaaaaaaacatattaatctaattttgaagtttaattaatcatacgctaatagctcatctcgttttgcgtatcttctcaatcttctcttttcctctcctctcaaactcacttactccatccgtcccaaaatataagaagttttagaattggataccgttattaagaaagtagatagaagtgaatggtgtagggttgtgattaaatgagtagtggaggtaggtgggaactgggaaaaatgaatggtggagggttgcgattggttgggaagataatgttggtggataaattgttatatttttgggataaattctagagttaaaaattattatattttgagatggagggagcagaggtttctagaaagcgtgaccaaaacttgagcaagtaacttcatggaatcttcacgttaaacaatccaaattggagtatttgaaaagattccccatttcaaaaggtagtactccgagtagtaatgattttgctaaacagcagggttcatggccataatgtgacttctgtgattctgtcaagtgggccctcttggacagagcaccttaccaccggtgacaccagcatcatcgtcggttttctctccctccgcgccatctccaccgtccattctccatccgaaccgcgccaccacccgccgccctcatggccacggccgccgccgccgccgccgccgcctttttcccggtccgccgccgccttccggttcaccaccgcgggcgccgccttatcgccgtcgcggccgccctctccccggaaccccccgcgcctacccccaccaccttgccgcctcccccgccccgcaagggctacttcccgaagcgcaacgaggtgctcgagctgacatgcgaggggctcgcgttcaaggggaagggcgtctgcagggtggacggctccaccttcgtcctgctctgcgacggcgcgctccccggggagcgcctcctcgcccgcgtccgccgcatccgccggggcgccttcgccgaggccgccaagctccggacgctcgagccccaccgcgacgccgtcgacgcgccatgcccgctcgccgccgactgcggcggctgcaaggcccagtccctcgcgtacgccgcgcagatccgccacaagcacctccaggtccgcgagctgctcgtgaactttggcaagttcgatccccggaagatggagagctcggagcccgatgctatcttgaaacccatcgtgccgtgcgacgagatatttcggtacaggaacaaggtgaatttctggtgtgggggtttaggagggtttaggagggggtttttggcgcaaaagatgagttgttttttctcttgtttccagatggagttctcttttggaacaaagagatggatgcaaagagagtggaaggaggagaaggatgatgaggtggtgaaggaggaaaaagttgaaggtgatggctattcgcttggattgcacgcgccagggttcttcgacaaggtgctgcatgtcgagaaatgcttgctgcagagcgagccggcagataaggtaaaaaagaaaaggtcaataatgatgtattggattatgtccattttgttgtagatttaaaatttagattttgttgaattgtgttacttggtggttgcagcatcaccactatttaacatttatagttagatttggttggctagcttgaagttgcattggcaacacatcctttgtataacttcccaacaagagcagcttaggcagcatgctgttgacaccaattaacgagattgtgcattggaataacatactttggacaaacaaacactattcacttgtgttgctaggatggtattgtttatgattgtcacaaaatgatataagtagaactgtgtaacatgataattatttaaaagctaaattgcttgtgtcatgccgcataaagctacacatattgagagtcagtttaagtacgtacacagatacattgcctggaccatcgtgctaattatttggagttggaagcaattgtcaaactagtgagcagagtggttctgaggactttccttttgatgtttaatttattatctgctaatttttacaggttcttgccattgttcaagaaacatggttggatccagctcttggtctcacaccttatgatgtgcacaagcatgttggatttctcaaacatcttatgataagaactggaaggtatggtgtcctatctgattgtgagttccacctatgaatgtatgatgccctcctgcatttttaccatgtagcagtatatctataaagactatagtgcatgcagatgttattcggtttacagtcatgggcactatatttctagcactaggatattgatgaacttcttttacaacagagcaaatctttcgatcattggtacagcatcattttggtatttaaacatgttactgaagttagtgcatttggcttcattagctgctgccaaatatctcggtctacaaacacattctctataattgttcagttaaaagtaaatttatttgataggacagggatgaccaaacaagtcatgttgtttccctccccaaacaaataaatttttaaccttttgttaccaattgaacatttcttttcttaccttttttttttgcatgatgaacacttttgaacattggttttttgttaattttccatcaatatcgccaatgtagttccagcagtcatggttaattttgtcacttcatgtagtaagccaaagctaatggagcctcttgtttacaatatcccataaataccagaagtggtatgtaattggtgcct

SEQ ID NO: 51187 - DNA, 2906 bp, Oryza sativa
gtactgcaggctgatgttctgtacaagcttattggggaatctgctgggcttaagggagatgggtctaggattatccttgacttgttctgtggaaccggaaccattggtcttacccttgctagaaggtaaattttctcactattatcatgctgttggagagcagttgctactatgtgaggccattttttttcatttgtttcaagtcttagcacaaaactttgagcattcgtcattcggttacccatttattgaaaagcatgattagtagatgttcttctgatttgaccagggcaaagcatgtctatggatatgaagtagttcctgaagccattgcagatgctaaaaagaacgctaagctgaatggtatcagcaatgctacatttgttcagggagaccttaataaaatcaatgaaacatttgggaaggaatttccgaaacctgacataatcatatcaggtttgtcttggcacatatctgttagtacatattttttgtagcaattcgagttatccctgatgagtagaatctacaatgctttcactgctttgctagatcctaatagacatcattaaatttgcagatcctaatcggccagggatgcatatgaagctaatcaagtggctactagaagttaaagcccctcgaatagtgtacgtttcatgtaatccagctacctgtgcacgggatttggattacttatgtcatggtgtggtatgtttttgtcctattattgaagatacccattacttcatattattttagttggtaggcatagcacttcaattaaatacttaatttgtgtacaggaggaaaaagatttgaaaggatggtacgaggtgaagactgtaatacctgtagatatgttcccccacactcctcatatcgaatgtatctgcgtgctggagctgtgttgattgtcagttctgttcatccaaaagaaaccgcaaggatttcaaatgcttcatcttgccctcatttcctgacaagtaggtgattagttagccttttgctctatatggacggttgtcctttgtcctttgattgcagagattttcatatactggaaaaggacattcttttcacctttgtgactataaagcacgaagttgcatactgatgtatttgttgtggcatttccaatactagccaaatgccctttgatcgcaacggattattaaaaatagcaaaattaagtccttgttgaaaatatttttaattggttgaaacaagaactttcatcttaaagaacaaacaaaaatgctatgcttagaaaattaaagagctgcagttcgactatactcacccaaatcccaatatcttgtcccacatgtcagtgatggttgaagactcagcaccaccactactttcttttaatagtagtatagatgatgaacacttgcgtgatgcacacctgattgagaaacctgtttttatttctcttttatggtagacttgcaggtcggaaattggatcgcagtctgcaaagccatgttgttggtgtttttacaagatatagagtattcatttactgaaactcccacattgggttttatagttgtggaggacgcagcttagctgaatgagttcttcaattgacatatctcatgcggaagagaagagaggttctcttaaagaacaagcagatgggaagaggcaaccaaactaccaaagttgatgtagttcctcatcctcaattgggattggagctacccatgcgtcaatgaaatgttgtcagatcttttcttgtgtgaaaatttgtagctaatgctaaattctcaaactatcactgatggctataccgaaagagtttttgaaacttttgtagggagcaaaattagaagcaaaatgcaggatagtttgagaaagtatgcattttttttttgtcgaatcccctaaatttccagattgataaattagtgaagctttaaggtacaaactcattatacagaagatacacgaatcactgtgtcattgataaattgattgatactacgaaagtactcaggattgttttttttgtttgaggaagtaatgctagcaccgctcaatatgataaatttctatgtcagagtatccttttatcactatatggatgattttataatttaattgttggtacggagtaaattggtgtagtagactatttactgagtaaaagtaacaagtttaatagatgtacgttttatcgcaaacctttttcttcctgaagtgtgaataactgaatatatgaactaaaaaagaaaaggagatttggatactatatattttctcgtattcaatcttgagtccatatagtgttggataacagttctatacggaaataactagaaaaaaattagagatgcgattatgtatatattttgcatacctgttcaaaactctacaatccataagaggacataaaaagagtgaacatatgcacataaaaatattaacaaacggatgtttccattccaaaatacaccaacttttatctggacaagaatttatccatattcattaccaaatatttctattttttgagacatatgtagtatttaccagctcttttggatatgacaattgaccattcatgccccttcatcttattaaaagactatatgtacatgttcaaaattctggaaaggttctattcgaaaccccacccccccctccccatatgatataatttcggtcaatatttttaattttttttcatttactgtgaatgtggtaatattttgattaaatttgactaaattttgtttaaaatttcggaccaaaacttccgaaaggtgtatcggcaccttccaatagaaacgctgaaaacgaaaaattgaaccctgtatatatatcacttctcatgttgtatttttattaaattttaaataggacaatcaataaaagtcatataaaaaattaataat

SEQ ID NO: 51188 - DNA, 4559 bp, Oryza sativa
gcatttttttactgcttgtttcatgttccttgttgtgatgatatcattgctctgtttgtttgaaaatctcgtggtagagttagcttctcacataagcaaatgcttgcacaaaggaaatttatggttaaacctgttgctcttatattagattttagtttgtgtgtgcaattgtatttcacttgtgcataatgcttaagaaagtgtggcttattatcctccgaaaatttagcttattcttgctgctcgccaatcaccagcccactttggaagtttgaataaaaagatggccatgaacgatgagaaacaagtagtagaatctattgtactcataacattatcatgtgaaaacttgatcttgcttacctgatgctggaatgcatagtaaatgtgcatacactttatatgtcatccagttcttgatatttcaacagtcaatttggtccaccttggtatggtctcagattgaaacttcggctatacatgcaggtcatagtcttttgaaattgcgtctgaagaacgcatggctatccgttgacgggctaaagataatgcctaatctgactcatctgacacttgagttcattagattagatgatgaggatctcaacaaattgaatgagtgcttcccttgccttcagatcctcaatcttattggagttggagggctcaaggaccctaagattcaccttcatcaactaaagacttgccactgggaggtatcaaatgttccacggtcattaacaatccgtgcgcctaacttggttcgtcttgagctgaaatgtgttcgaccagatatgctcattttggataccccatccatgtttactctgaagttaacagttgataaacttggaccaaatgtccaagccgatggccttgtgagtttgaaaaatctgcggatagagtcattggatctaaagtccctcttgcaagtatttgcagagaatcatgatatcactacattagagcttgagctgcccacttctacaaacaaatatgaactttttgaaacagtgaagcccgagtatcttcttcagctgtttgccggcatcagcgaagtcaagttggcccctcggttttcatgtgaaatgacgcattgcctgatgttatgcaccagcaaccagtttagaagctgtttgaggagactcctgtttcatctaccgccattgaaggatgttcctcatcttgcacccttgtttaataactgtgctccatcttgcaggtgaccattcttttccatgccgactccagcgatgatatccgccaagccgcgacatcagtttggacgctaaggtatccggggatcagatggcagtggggtacctggaactaatccctgcatatgtgcatcaacatgaagataaaggatcacatgtgacaggactaacactacatctcgcaccttttgttaacatagtagcctcttctaaagtattgcaagctgttattctgttaggcttgctattgctagtagtactgattaatgttggtgagcagatggatgctcaatttgctcatagggctttgtttgcccatagcaactgtgcgcaaatgtgccaagataactaacttttggtttgtttctgtgcttgtacatcctacttaatgttggaattatatactcctacattagaatatgtacttttctcttggataccaggatattgtttgttacctcagcccatctgcaggttagcataacatttccttggcaacagtgaacaatatcatcatcatctttttacccatctgcacatgcatacatatgatatgatcctctcatgcagtgatgcctaatctggtagcaataattaatttaactatggctgtatcaggattagccgagttggtctcggttttttcccttcatcttttcccgccaaaaatgtcttggtcaggagcagagaggcactagttgcggcggcagaaggttgggcagctgcagctgcagcggctgcaccaccgccaccggcagcagcagcagcacgacgaccacgagcaggcgaaccagcagcagccgcagcactcgccgcagcagcagcaccaccagctccgccgccgccgccgctcctcctccggcgtcatctcctcgaacgccgacgccggcgacgccgcctgctgctgctccgcctccttcttcagcggatggtacatcccgccgtagtccctcttcctcggcgacgtcgtcgtctccgccaatctgcaatggagatgaggggggttagttttctttctcgtgatgatgatgatgaagaggacgacaatggcgtcgtcggcggcgtacatggggaaggcgaaggagaagttgctcgagctgccggcggagccgctctcgtggcggcggaagtcgatggccgccttttgcttggccgcgccgccgccgccgtcggtggcgtccgaccgcgcgctgccaccaggcgacccttcggcgacggtggccagcttccagtccgacgtgtggtcgccggcggcgccggccatggcctcgtcgtagaagtagtcgaaatgcgacctgctctcgccggcgtagaagccgcagaggtcgccggacggccgggcgccgtggtggatgctgaacagcgactcgttcgacgccacgctccactccgcctgcgacgacgaccccgggggcttcgcctggaagatggacttggggatcctctccggatcgaaccccgccaccgccgccggctgcagcgacatcgtctggatctccggcgccgcctgcggcgtcgtcgtcgccgccgccgctacgtcgtcgacggtctgagccggctgctgcggccacgatgcccaatcgtccggtctgaccacggcctcatcgtcgtgtttgataacgtccccgccgtcaccggaagcgacggcggcggcctcatcgtccggcgaggcggcgaccaccgacgggacgacgacgctggtctctaccgcgacgtccttggacacctccttctcctcctccgacgacgacgacgaagacgatgaagatgattgcctatcaggcttaacgccggcctcctcctcctccgccgccgcctcatctgacggcggcggcggcggctctagcaccataggcgcgggcagctcggcggtctccggcgagccgggctggggctccatgaccacgcccttgccattaattgacacaccatgatcgatcacgcaagattacaacacgaaatcaatcgatcgatcacgaaatgtaagaatcgaattgtcggtggctcaccggaagaagaagaggccggccggagccccgagtcgaaatggagggaggagtcgagtcggtcggccgtttgcggctaaagtgcggtacgattcgagacccccaagctatttttggttgactcgtcacgctgcaacattgccacgctacgagcgcgggaaaccacccaactcgcgccaacaaagccactaaaatcatcgtgctgtttgaaccaaaccaagatagcgcagctcgtgctgttttttttttttttggaaggatttttagtccatatgcagtctgggccgcaatctatactagtgatccggcccagatttgaatcgcggtttttgccctgtacatcaaacaagtctaaccccaaacttaagaaaatcatccaaaaataatctagtggtaacaatattgaaaaagtcgtataggttgtccatattttctaataagccatttattagagagtataaattaattcatggtaaaacttttatatatttattcgtagcgatttaaaagtcaacaataaaaaaatacattgaaaatatcttaaaatcaaatttaaaatcaagttaaaaattcaaattttaatattttgacatcattttgatatttgctttggcttattaggccaactgatgggctcgaaggcctgaggcaatcagcattcaacgcaagcagtaaaccggaattccatggattcaaagatcgaaatgaactgcatgcatcatctcaaccacgacaaaaaaaaaaaagggacggcaattaattaaaaaccaccatggatcatgttcatagcccaagctctgaagctttgatacaagagacgacacggattgacatggctatcatgcatcaaccatcttaattcgagtaaaccctcctaattaaccctctttgattacttaacctaggcgattaacactatgctaatgacttcttctactgggccgaaacctctcaaaaaagataacttttggtgcaactacgaacacaccagatgaaacttgggagtgatggctagattagtggcgagttgttgccaatggtgatcagagctcgacgacgacgacgacgatcctagatggagaggtgcggccaccccatggcccagatgctgtccgacaccggcgggtgtgcggccggcgcgggagacggtgtagaagtggccggcggcggcggcggcgcggcgccgacgacatggtgcccagcaggaagccggtggtgaagtggccgttgtgcagctgggccggcgcgagcagcgaggtgaagctgccgccgaggtcgagcaggcggcggtcggggtccacggccgccagcggcagcggcggcggcggcggcagga

SEQ ID NO: 51189 - DNA, 1890 bp, Oryza sativa
tgcactataggacaaaggatacggatccttgtgtcagtgcctgattgccaatgcaatcaatgtcattagtttagtgctaactaagcccatcacaacaacatgatgggtgtattacaagtaataccacattatttttagtctcctactactctttctatagaattgtgggtttatctttttgcttatgcttatatttatcagctaaaatttgaatatttgatcgttaaatccagagttgatttcggggtttttttcatcgaaatttattttcagtttttgcttttagatcgctaagacacgtatataaaagttttattcacaaattattttcgtttacaagtacgccgaaatgatgggtctgatggtgctttttactattggtaatgaattgacgtacaaaccttttacgtgtttgagaagagaacatttttattcagttgctaaaatgcttatataaatatgctcatgggaaatattgcagaggaccgtgtaaaactcgttttgtattaatagagcagcagcgattagtacacggtgggtagggtgtagtatgcgattggaaggggtggcgggtcagaatcgaagtagtgatcaggggtcagtactcaaagtgatcgaatagacatacatcaaccatgaggagtggctattacgtgtaccgtgaatcgcgtgttttgcccacattcatcccgcgcgtactccgcaagcgtacgtttcgataaagataatagtagaattttagcgtgactaaaacgagataacttattaatgtatgattagactttaaaattttttattccatcttttatatagaatgtttttactaaaactcattgtatatataggagtctaaaaaacatatgctaaaatatcaagatgaaatctacgtctcaatcagaaaatattatggccttagtccgtggaagtaattgaactccattagatatgccacgattgatttagcagtgcatgtcgtttagtttccataggaaacattaggccagttaaccgggcaccagagcaggagaagacaaatgcagaatggtgaactggagtacatgagtaatactcctgtagtgtacgctgtgtattgttaaaagcggcgtatagaaggaacgttgatctatgattattagagcaggtacaattaatagcagactacaaaccagttataaatatattttaaaaagataaaagaagagagagaagagcagcgggctatagatttatagccagctgtagcatgggctccaagatacatgtgcgtatgataagaaaaactatgtattaattgtgtactatatgttataggtaactattgtatttattagctattaaattaactatagatgatttagagcatgtggctggatactattaaacttgctcttactcgagtggtaactgaaatgatctgaacgtgctgggccgggagacagacaagagggagggcagtactactactgtagagctagtctggagtcgcagggcacgccatgaaacacaaggaaggagaggcatcaactcgtacagatatgctcctgcccaactgacaaagtccgatacaaccaatctcacagctctctcttctctctctctgtctctggggtttgggtttggcaagtcgcagcagcagagagaaacggcaacagaagccaagccaagccaagcagcaggcacgtcgtggcgtggcatgcagatggagatgcagatgcagtgcaaagtgcaggggttggactgggcaacggctggctgatgctgtggatcagtggagtggagtgcaggaaattgtcagtttgcggctgcactcctgtggctgtggctgccaccggcagaggaggccaaccgcccagatccctgagtgcccggttttcaggtgcagcctttgca

SEQ ID NO: 51190 - DNA, 1778 bp, Oryza sativa
ggtttcagagacagtcaattcagctgtcaaacagtggctgctgcccggcaagtccaggtgtatcgaaagaaacgcgtagagaagcgacgagcctgatggtttgcatccattgaccattgtgaactagctgagctcgatcgagtttgaaaactttcataaaacctgttcagttgttttcatggcaaaggaattttttgtgatgtgattgtgaaccctgccgtgcatgtttggtgcctgtagatttcacagctggtccttggatgcatgccatacatgtgtttttgtcacctctcacctatggccttcttctagactgaatgatatgaacagtgttgtcgtagttactaaccaggtacttggttttaccaggtcatttgacctcacattttcttcgtgacaatatttagaagagaaaaaatgtagaaaaacaaggagacacgtttggtgtaagataatgctgcctccgttacagaatgcgagaggcttagttttgtctcctaaatcaaacttatctagttttgactaaatttgtagaaaaatatattaatatctacaatatctaataaaactaattttatgatgtacatgtcggtgcaaatttttttcaaagctagataactttgacttatgacaaaactaaaacctcttatattctggaacggagtagtattcaactatttaatttggagaccggagattcaattttcatggggcgatcttaacgagggagttaagatttttttgggggagttgagatcttaacattatgtctttgatgggtgatgagtcctgtgttgggcaaactgcggtttaataaattgatgatggtgcatgtgatgacttttgcgccgttcttggcagatcaaacatcacattccaacaaaaaaacattgaggagtaggagaattattaaggatggcgagttggtgacacaaacgttaatttggacgcgaccggatgcagttctctatcaattaatggatctcgagcttaaaatgaagtactgcattttttgtattgtgtttatatgtttcagacattcagtaaagtgtttcagccaaaaaggaaatatgggaataatttagaagacataaagtgcggctgaaatggacatgctccgtagtgttttgctatccaaattgatattccttaatgatttccaaacggattggattcttctccagaaaaagagatggattttcccaacggattggattcttctccgaaaaaagagttggatagaaggcatagatcttcttcagtacagcttcttgcaggagaaccacctaagatgcagcattctgttgtcgtatattcatctgcacctgctctggctttggttccttcgccattaattcaacaagcatagcatcccccagtcaacatgtggtttggatataaatacccgtcataccttgtcgcagcttccgtcttatgcctagatttgtcactctcaagggacataatcagtgtagaaagaaagacagcagtaagagcatctccaacagccttcttatcccactcttcaagttaaattttagcaattttggatcaaaaacacactccaacagcctagctaactggctggccaaacttctccccacgctggccaactttggccagccaaaagcgcctctccaatcgtgggccccacgcgttttccccaccctccgccagccaaccctccgcccccagtggccagtgccaaggccaccgtcgtcgtcgtcgggggcgccatcgtcgttgtcgccgaggtcgccgttgtcggggtcgttgtc

SEQ ID NO: 51191 - DNA, 5885 bp, Oryza sativa
agagtctgttggagtgagtgcctagtttgactagttaaatcagatggagagttggctatatgggtggttggagagttcgatttggagaggctggtggagatgctctaactttgcaagaaacaaggttggtgcaatggtgcttatgtgatggattgatggatggatcattgcacagagtatcatgctcttcactttaagatgatgaatttactgtacaaaaggacaagccgttgaagtttccttttcattttcagttgggcaatatcattttattccaaggagctagaagcactttgcaatgcatcaattaagcatatcattatcacgtagacctattaaaccagtagaatccaataataacaataataataatgcattgaaatccaaatggcatctcatctatcatgaacaggcacagatgatcaacacttcaacaggaaatgttttgttcactacagtagatcctctagcacctaacacagctataataagttcctttgaaggagtgtctcttgtgccacttcaaatcattggttcagtagggtattgtagcatttgcatgatgccattgagaagcttttttttttttacaatataaataaagaattcagaagtggtaggattttttccatgtgtttcacaacataagcctccaagaacacggaaataagggctttgccaggaaagcacaattgcgctgtgcttaattgactagtaaagttaagctgggatattgcccatttgtatatactaacaaaaaattttaaaatgcaattgaagtgataatttggatgtgccccccttcatttcgcaactttgttttatttactttcgtttggtgtggattacaactaactctaatgtggtggttgtccaaatctagtcatggaatttaaaaggctaaagagagaccttgctgttgataaggagaaagatgagttcatcaaaaactaagaatttcccatacctaagttgggtgcacaaagtacagatgtttctagtaaattaataatccaccaatttcagactgtaactcatccagttggatttatatacaaggagaagaacaaatagaacagttgcctgatttttttatttcatgaaactcaaaaaaaatagcacatagtttctaatgctatgcaggttcataaggtccaaagtaccggaatctctcccttttgtggttgttatagcgagaccttttcctaatttcgtccaatcctggatcttggcacctaaccttgataagtatgcttgcttgcattaataagggcttctctgctctgtgtttattttcttgttatttggccaatgccctttattcttgacatgggacaaattgaagaacaacacaagaaatcttcaccttaaccaactacttcatattctccctctttttttgtcacatccagtcacattaaaatctcatcctcaattttatactgtttcaatctgaatattcttagtcaaagcagagcaaactagtatctcaaatgaatcttgaattttctttttttaatcttgggaggttagctgaggttgcagtgtgtttcttatcgatttattatttgatctagacgagctgacaaaatagactttccacttcaaatcgctctcattacgtttctagaatttttttttgtgtggcaacaaacaaaataacataatattattccggacgttatgaaaggacatgtatggaccaaagtatgcttttcttaacgatgacgtcagcatacacctcggacactgaggtcttagtttcacatcacaaaatgaaagtttctctataaattgttctggtccaaactaagaaagcaattaatagctactcaatccaatctaatctcgaaacaatttcgataatatcgatgccatcattttgcttctagatcaaacaaaaaacattttttttacccaatttcttttgtggcatggcatacacgttcagcacaacattaaaaaaaaactcactctctgtctatttttaaaaacaatttcaggccatgaagaaaacaaattctcttttccaatcagttgaccttgccaggataaaaaggcaggtgcagtggcaaaaatgcacaagcaaaggtataagattcctgatatgaaccatacaaacatgattttcatatgcaacatgatgttgacatagataatattaaatatcactaatagcatccaaagaggagagactctctttcagattcctgtggattccaggtgcagttaaatagggcagcagcagcagcatctatagtagaatcaatgtatcatggtgccccagcatttggattgaattgtcaataccataaaaggagatgatgccaatgtgtgtgtccccttccattggcaccaggtgttagctcctcagctagttgcttgtcccacaccacatctttctttctcctcccttattaagctactagatgctgctattgctacatctccacatgcaccatcttatctcaactccttagaattcccactcctcttcttcttgttcttcttgcttccctccaacttcttcttcttgttgttcttgctgttcttgtggttcttggcctgccatcggcggcgagcatggccaggaaatgctccagctgcgggaacaatggccacaactccaggacttgcaccggccaaaggagcctgcaggagagtggcggcggttatggcggcggtggcgccggtggcgtgaggttgttcggggtgcagttgcacgtcggcggtgcgcctctgaagaagtgcttcagcatggagtgcctatcgtcgccgtcgccgtcgccgtcgccggcgtactacgccgcggtcgccgccgccgcctccaactcgtcgccgaccgtgtcgtcgtcgtcgtcgctggtgtcggtggaggaggccggcgagaagatggccaacgggtacctctccgatggcctcatggcgagagctcaggagaggaagaagggtgagttcttgagagacatatggtttgtgcatgcttcactaatttgttgtggtttagcactaattacagccacctgacagtgatctaatcatcattaagactgaatttatttttgttgatgagaagttatttgacttcttttgttatgtccccttctccaatttttgccaccagttgctgtctgccatacaagcccatttttatgcttccaacttggtacaggaatatatgcatgactgacataaatttcctaagaatcagatttctgtctctcaagttgcaacctgaaactctcatccttatcacaaacaaagacctgatttatcctagttgtctcgtcctaatcatttgcatctagattcttgaactccaaacactagattgtttttgcagatatcaacagataaaaaaaaatcctctaaattgctgtgttttctacacctgaaattctgaacatgtcaaactcatcagttaactgtcatcaggtgttccatggactgaagaggagcacaggaaattcctggtagggctcgagaagctcgggaaaggcgactggcgcggcatttcccggcacttcgtcacgacaagaacaccgacgcaggtggccagccatgcccagaagtatttcctcaggcagagcagcctcacgcagaagaagagaagatccagcctctttgacgtggtaaacttcaaacatctttgcaacaatatctacacagacagtttcagacagcaagaatcatgtatttatatgagtgagttacagtaacctaacatgtctgaaaatttgatgttttttttcttttctttcagattgaggatgcagaaaaggctccgagtgtgaatgaacgtctgaaactgagacacgagacagcctctgtgcctgctgaaatgggattccctgcactgtcactgggtatcagcagcatggcacagccagaagccatgctgctgcctcctccatccttaaccctgacgccaagctgttcatcaccagcagtgagcagcagcagcagcgaacaaccaagaacaatccatccttctctgatggtggcaaagcctcaggtgcaactgcaactccagccacctgatctggagctcaagatctcgactgtccgtcagaacgatcagcccagttcgtcgccgaggacgccttttttggggacaatcagggtcacttgaacttaaagagagagagaagaagaagaaaaggaattatcttagagattactgaattatttgtgcctaaaaggagaagcttttgctagtggtgtatgtgtgtgtccccttggcaaaaacacaatgccatcttccaccatgtatcatttttataaggctattaggaagtgaagcttttactggactaatctagtcttgcaaataataaaaggaacggctgctacatgctccctctagccatcaccttgattggcttctttatgttgacacaaaggagattcaaaaagagttggtttttggtttggtttgtgtttgttttatggggaggagaaggtgaaagatgagatcaccatattcacttattcagtttgcagtggacactgagaaggacaggcaaatcactggctagtgcgcaaatccattttattattattattcttttgccttttcttgcaccagtttggtatgtacgtatggattcagttgctcaattttgttagattaaattttgaatggatctcacagcgtccctgctaggctgctacccaccaaatacgaagaatatatattttgtagatagtactaccacttttctttattcttcgtattactgtacaatattgtacgatgtttttttagattttatagccatgaagagataccgtgagatactatccttctcttaggaccgcaaaaaaaactcttactattctgtttactctgcccattggataacatatatttacgtgctagcatagaatttactttgcttgcaatactacataataaaaacgtgcttgtagcatgatgataaataccagaaagctaccgaccaaggtttaaatgtccagaattactatttttctttcaacggatgttcttaaggaaatctgtcagattatgcaaccttacattggctctttgattcatgcatgaggtaagaaaaaaaaaagtgaggtaatatccttcttcgagaataataatgtttgcatcgcccatcggataacacacataaagtactaacatatagtatttactttgtgtgtagtactactacgtattagcaaacgtgcttgtagcatatggtgataaatgccagaaaactaccgatcagagtttatcctaggccctatttagttcccaaataaaaacttttcaccctatcacatcgaatgtttgaacacatgtacggagtattaaatattaaaaaaataataattacacagtttgcgtgtaaattgcgagacgaatattttaaacctaattgttccatgatttgacaatatggtgctacagtaaatatttactaatgatggattaattaggcttaataaatttgtctcgcagtttacatgcggaatgtaatttgtttttttattagtctacgtttaatactccctccgcttcaggttataaaacgttttggctttggtaaaagttaaactatttcaagtttgactaagtttatagacaaatatagtactatttataatactaaactagtttcatcaaatccataattgatgaatatatttttaaataaatttgttttgattaaaaatgttactacttttttctaccaacttatttaaacttaaagcggattgactttgactaaaatcaaaacgttttataaactgaaacggaaggagtacttcaaaaggaagtctataaatctaacgtgtcacgccaaaatttttcgtctcgcaaactaaacagagccttagtctcgcacagaaaaaggcattccttggtt

SEQ ID NO: 51192 - DNA, 4450 bp, Oryza sativa
atatggggtaactctcattctctccttatttaatatcgcagggagaggtctttgctttggagctgagatttctttatccaatgtactgtattaaattaaaccaccttaccttcgtaaaggaatttgggtcacaaacgcaacagtaacatatttttgaagtaaattactatcacaacttatattcaaatcttaccacaatagtatatttctgaaaagaaaaggacaactcttttctcacaatatatgaattcagttcggaatcgacaagttcttcgcccctgaaacgatggattcaatgaatcgagttatcaatcattcaggtcaatctcacccaagattagataggatcataggatcatgaatcctgacgaacaaatatctgataagccgctcaaacatgccaggtggcggtctcgagttcgttgcccaaagtcgcacgactgcaacggtggttggatctgcgacatgcatcgctttccctgatggatgcatgttaacttagctcaaggcacaaacaaatcaattcaatatatattaaaactatgagatgtatattgattgttttctgttcactcaggcacagtaattcatcatatcttttttgcaacgataagagcgctgtacctaacaaaagcacacacttacttgccaatttgggagtaaacaattgctctatttaggagggtgatagctagctagaaaggtactagcaaagagagaatataatgaaaggaaagaatcaaagattaggatatggtgttgtgtaaagaactgaagatatatagagtgaaggcaaaggctaagattgcaaaccacaggattggaactggagtcgcacgtaggccccctgcacatgctgaaagagtacttgtgttgattaattaacaactcaaatggttggagatataaagtgatgggagaagaagagatcaaaagaaaatttagataaagttggtgttctgtgatcttatctttgattattttagttcagggagggttgggtaaggataatgagcttttcttcgggtcttttttttttctttatctttgcagatcaaagctaattctatcttgttgaaattattggactgaccccatagcgattattgatggtggggaaacacgtttgaaatagagaacacttgtgaaactaacatttttataaggagattgacagagacacacttcggttatttctcccattagattatgggatatcacataatagagacgacaataccttatatacttggtccatggtgcagcggtccggcctacaagtgtgtttatgcctagttctagctaacagattataaattatgagtagagtgtaaattatcattgacacttctcttaaattactaaacggcacatgatatttataaaaactttttcctcatcggtatttcttactaaacttctttagatcgacttatcaactttctaatgtttgattcattcgttcacaccattatcataatgccttgaatcgcaaggtctgcttagtttggtcgcgagtctgcacactaacgggtttggcagccttgggggtcctcaatcttcatatgatgggcaccaacctgtgtgcaagatgggtctagagtcgttgtgtgtagtttgttgtaactgtgtagagcatctaccctttctaatcttattaaaagatacgagtatgtactttaatttgtgtattaaaaaatttaattctgtgaatcggtatatcatattagttgacactttttggaccaacacgtacgctcagccttcaccgccgtaaaatcagctgcaaatcaacgacgggtgaagtggacgaacaccggccaaacacgtacgtatgcaacgacatgaaatcaatcaagccggccaccgaaggcgaagggtcgaggccatgatgcatggcacctgtcagttccccatttgtcgccttcaatctcccctgcacacgtggcacacacgtaccagacgatgtacgactgaaaccaaattaaatggacaaagattatatctggtccaattattcagatacatcgatcctctcgtaacgtgcacacttatcacatacaaaacgatggctgaatctgaattgctggtaaaaagtactaccaagagatcgaataattagggctacttagctcttgatacatcgctttctctggccatggatatcgtatgtatggtctgcaagacttcgctgctgctgctgctgtatgatgaattgatgatgatggatgcatggatggtctcgactggagatgtgatcggaaacctaattctgggcgagcaaagtcttgtgccgtgatggagccatcagaggcggcgagacgatgagatccatttcttcttattcttcttcttcttcttcttcttcttcttcttcttcttcttctttttgttctgaagctgtgccatcagcagcagcaaggaatactggcccattaatttcgacgttttcgttgaagaaactatgcgagacgtgtgttctcagagacctaagctacaattcacattgtcctgtgtgtacgatgattgtgccctttcttttgttcgtgaagcaatctcaatcttctgccgaaaaaaggagaaaaaaaaaagatgcctacaagttcatatatatgcttcttgtttatcctctctgtacttgttgttcagggaaatcatgtgttagttgcgtctacaattggagtcaggttttgactttggtgaaccccaacttgtgttatctttctccctttttttgttcatcatatgttggtacagataacccaaaaaaaaattaggttgaccctaaagttaattcagatgagatggatagaacgcaaccttgaaaatggttgacataactgaagctcaagtatgtgctccaatagaagaaacgtatagggcaaccattcgtgtctctttcgtgatcaattttcgctagtttgcgtagcactacagtatactatctatctatctaaacagggagcccaaattattgcaaagtgatgccacgaaagagaagaaaagatggctcctctttttttggataaaggaagatgataaatcagtgaagacttctgtggagacaagaaatttgacggcgacagttcagcaaacacccccatctttttaggatcaatatatcagtaaatagtttgattctgcactaaacatggagaattttcaaagattgagacacactactgcatgttgtttcataagtgatcgttgttgaatagcaaaaggtagcacgcatagtgtaggttgcacaaaagaagattggttcgtcagagttaacacaggatatattctgtggctgtaatgcgctttcatgcagattattgtcaaataattgtgacacagtaaccatgcacagtcatctatgcctcaagaattggcagcaggaagtgacagcatctatcgttgcaacttggaatattttacaaccagatatcaatatacagattactatcaaattattgtgacacagttattgcatatacagtatagtcatggatgcttcagcagttcacaacgacattcttatctgtgaaacttggaatcttctactcctgagatgagacatctagatgcaaagtacaaaatgagggcatgtttggattgatgccctaccaaaattttggtagtaccaaatcttgggcaagttttggtactaccaaaattttggtagggtagagttgaaaatgtttatttggattgaagccaaaatttgcccataagagacaagtttataggccaagccaaatttatggcataggtagagttttagtagaggtgtttggtttactactgcaaattttagtagggtagcaatccaaattggccctgaatttcgaatgtacggatatgaacatgtatatccaatgtagattgtccgaagaagaaaggattgaatttcctctcgcctatttgacaaagtataatgaaagatccaatcacaggccgtctcatgacttttcatgggagtacagcatataggagtatactacaatgtgtgaccattacagtgacataatcaatgacatgtctcggggaaaaaaattgcttgacggtagcaatgacatcagcattactagatggcagctaaaaagaaaagtcttagagtaaaatctacaaaactataaatattttatttattttgataaacctatcataaaactagaattttaaaggtcaaattgctaatactattgtgatgttgagttacaaatattgtatttttgtgattaaaaattggcgtttaaacatgtagttttatgataactctattaactatatgtgttctttagtcggcgttgccgttttttgggatttgttgggagtgtagcgtggctcggcccttcccgctgcttggagtttaggtttagccgccgcagtagttttttaagcttcagttttttattttgcttttctcccttcccctggcataagtcggtctggctgattgcgt

SEQ ID NO: 51193 - DNA, 1582 bp, Oryza sativa
agcctttcgtctcagccacacaactaaaaaagcatcgatcgatcaaaaaaagctatagccttgagacaaaagaaatccaaacattccatccgcaccttgtccactagcttaacctgcagccgtgcattagccaaattaagccagccggttcgatcgatcacactttcttatccatgcatctgtccaccagaccgccacgtcgccatcaagctcccctgctttctgtttaatttaattactccgattattagttaaccagatgtaatcctggagtaacctttactggccttaaccttttgtcttaactgtatatactttgcttgggttgcaatccataatgcggccataatgacgcttttatagcgtcttaattaattatctgccctaactaaattttttttattacaactagctagcttcatgttccgaccaccacatataaccacgccgtggatgggaactgatcttatccggattgtgacgccgtcgttgccgtgccacgtcggccggtcgggccgttcttactcgcatcggttcatttttaggtaggattgacttgtcggacgccgacggccggattggcttgctggccggcgatggtcaaccggcaggcacgccgtcgccaccaacaaaagccggtgagctagctagggccggtcttttggcgatcaggaggctgacgaggatatttctgtatatataggcccaaaacagggaaacgtcaagcagttggttcgttacgattgctacgtacgatcgttcgactggttatcgtgtcattctatcaaggacgacaaagatggcgagatcgatcgatgcagagggtgttccactctgcaatcaacggccatgaactgattgatcgttcatttagcaatctcatcttttttacatatagaaagacgttcagcatgcacatgcatctcctataaacgtatgcacgcaaatcttatctctacaagcatcttcgaaagattggactagtatatcttataatattgataaagttatcacgaatacgtcacttatcattgaaatacaaccgtgttaagtctagagtttaaatttaagtggattatttctaatctttttaaaaaaaaatagtcatttaaaccacactcactccgtagctgtcccattttgtaagcggctagcaaatgatcgtgtttttgcagtgtactaataccaaattaacgtcatgtacgtttgtctgcttgctccacacacacaagattctacttaatttgtgagcacatagactaattaattattgatcatgtcgcggttgctagatcaggggggaggataatgcgaccaccaaaccggccacatcagcacgtcgctgttacttgctccacaattaacaacacacaggggtcctcctcccccatcaccttacctcctccccgtgcagatgaaaaagcgcgattccgcaggaaaattttgcatgcgctcgggtgatataattgcgcccacaaacagggccagccacccattgggcacgaacttggacttcgtttcggatgcgtcgatttgtcaccccgcgctgccgattaattactcactccgtcccttaatattt

SEQ ID NO: 51194 - DNA, 3479 bp, Oryza sativa
gatctttatcgcatacggggagggaaggaactgaaggtgaaggaaggaaccggtcaaaccttaggctctaagcaccatgtcagacctcctaaaataatccaccacctcctctcctatgcttaccttttaggacatctatccctgtatcgaagagcagtagtagagtctggatgcgttcgagagaaggaaaaagaaaattaaaaaaatacctaaatttaggtgaatcattagtatggttgatgttatatttaattattataattttaaaaaataaaataaattaacatgaatttttaaaagtaacttctatgtatatctttctataaaatgtttaaccgtttgaaaaacatccgtgcgaagtcttaatctgaacacaaccttaaaagagatatgataaccatataaagggtctcattgtttcactgatgcttagtcaaaattttaaattttaaagattaattttgaagctagttttgtagtgttatcgtagttaattttcatcacttacttttagatattttaaatcgctaaagacgtgtatgtaaaagtattaccatatttctttttctaataagcggtgtggataaacatatgaataagcgaaacgctgaggctaaaaataactttcaaacagtaaaaggagaagtcatttttctctgctctccatgtgcaaaaatgtagccacctacgtaatactcaaaattgattaattagactagtaccacttcattttgagtattaggttgctacgtatatcttaatatataatacttcctccattctccaaatgtaagaatttctagtattacccaaattcacataaatgctaatggatttaaacgtatggaaaacatataaattgatcaatagattaatctagataagacaaaaagtcttacaatataaaacggatagagtaaaaggtatatggttacataggcattacgcatttcaatttgagaagaagggcttggtgagaacgtgggtttatataaaacaacttaatttaaagtacagtagagcaatagattcgacttgatgcaagccatattggattgatccctactgagttactattagcacagttttcaatctccaaaagattagtcgtcttgtgcgcggttgtaagactacccattcttttctccaaccagagttggatgaagattaagattttcgtggcacacttttcaaactgctaaacggtgtgtttattgtgaaaactatctatattaaagtttttctaaaatatcaaattaatatatttttcaaatttataataattaaaactcaatcaattatatgttaataacacttcgttttacgtaaaaacaccatataaggagtttactttggtccacaggttcaaggttttctttagcctatgcgtgacaaccgttttctctagcatcctactatttactatagtaatttgtaaacatattgttcatcacctatcttgacaagtcagttatcacgatatttgcctattatttatgtgttagcaacagatataaaaggtttaattatagaatttttaaataactagtaacaagaccataattaaatatcaaatgctccactatttactaccctctctataaaaaaaacctaacctaaaaacggatgtgacccctccttataccacaaatctagaaaagtgacatccagattggtaggaatggtcacattcccttctaagttagtttgttttgaaacgaagggagtagtgtttagacccccatctgtttcttctgtagggagaggataaattttggatactcgtgacacgctttccaaactgctaaacggtgtgtttcgtgcaaaaactttctatatgaaagttgttctaaaatatcatattaatctattttttaagtttgtaataattaaaactcaattaatcacacgttattaccactttattttacgtgaaacacttattcccttcgtcccaaaataagtgcacttttaaactgttaacgttcaacgtttgaccgttcgtcttatttgaaatttctttatgattagtatttttattgctattagatgataaaacatgaatagtactatatatgtgactaaatattttcaaatttttcacaaattttttaaataagacgaacggtcaaacgctggacacggatatccatgactatacttatatatattgggacagaggtagtaatttttatctacatatctagaggattcaaaccccagccgttcaaagtcgacgacgggccttaggtccaccaatcaaaaactcctagagcctttgaccccacaggcagttcttactgataggtatagtaccgtaccatgctagcccccatggcctcccattttggctacatgatgcttacacggcgtcaaaccgacgagcctgcatgcaccccccggcaggcaacacgccgtgcgctagcttagagagggatcgatggacagcatgggcagcagccaagtccccatcctgtcaaacgtggtgtacgccatctacggatttgagagtttactcgctgcattaaaaacaaaaacagtacgccgtacgtacgtactctaggccgggtcgtacagagcgcacgcagccaagccaatgcagcagataaccacgaacaaacctggcaaaataaagcatctcccaacccaaaccgggagaccagaccagggaggagtcgtgcacattggctttcgtcccaattatagccaactccgtcgcttttaagtaaagcagtaattggtactgtgcagaggcacagaggaacactgtacgtgcacgagcacggatcgataggctgcagcgatgagcggtggacggatgatggatggatccggtgcgtggtccagccgcgcacaccgtccgatcccttcgattcccaggtactctacgcgaaaacgcggtgtcgcgcttatccggacgagctgtgcccgtgtcgcgcgcgcccccgatgtagtaggcagggcaggcggggccccgcgtggtcccttgggcgcctaccggtttgatggtggacggacggacgggatgggtgggtgcctgggtggggtcacgcggtgtggctcgatcgcacggttaacgcgtccctcatcatgtggatgagaaaattgcataggtaccatcgcaaaagattggattcgctggaataccatcacttaaacgggcttcgctataataccactcctaaccaaatcgtgtacgctgaaataccatcctggacagatttaccctcgggtttcttcttcctccatccaactcctcgtcttcgtcgtcaccgatggccatggtggcggcgaggagaactgacggaacgagctcgccggccgacggcggcgaggaaaaccaagggagctcagtggtcggctgctgcgaggagaacttaaggagcgagcttggcgactggcggtgggagcgtgtgggtggcggcggtcgttgcacgcgattgcgggagcacatgggcggcggcgggagtgcaggtgac

SEQ ID NO: 51195 - DNA, 2362 bp, Oryza sativa
ttttgtgcttccagaaacgtccgggaaaacaaagaagattctggaattccagatcggagcaactgagcaagcaactatccaaactacgcacacaccacccgctacagctgagatgcccgaaactaggcgttctcctgcacgggaacatgcatgtcagtcaccacgcagctcgctagcctggccaaccttgggtctgaagctacagggacagcaggcatgcaagaggatctgcatttgtgcagttaaagatagagcagggggagggggatagatgcaaaggagatggaggagagatcagagccacagatgtgctgcaatgatgggtgcacactaggtagggaatgagggaacaacctaggcagggagcaaagccatccaacccaacccaacccaaaccaagcaaaaagcaaaggctatgtgcatcatcccttgctcttgcttgtgctgttggccattctcgagaccgcttggaaaagccaaaggcagcagcttcggacaaatcctctagcggcctacaggaacgccagggttcttcatgtcacattgtcacgtgactcgagcgtgcgagatggcgcgccacaccgggagacggtggagagacccatcgaacaagcaagcaagctcgttcatcaagcatggtgtggtgtcttagcgtgcgtgatggccatgcatgcgtgctgctccccagcgacccacacttatcttgaacggcccggcttatggcagcagctagcacgatgtgcccattgaaagcattgattcgtctgatatctcgcctagcctgttgaatggcctcgcgctcgatcgatcgggtcaagcacgcatggaatgggcaaagatggcgcggcgctactacagccgctgtgctactgtgcagtgacaaagatggcagcacgtacgaccatgtcgactagtgtagctgccacaaatatactatttccccgtctttaaaatataagaagttttagattgatgaaatatatcttaatagtatgaatctgaataaaccttttatctaaattcgtagtattataatgtgttttatttaaccaaaactttatatatatttgggaaggaagtgagtaggagctctttattctatcttgttatgtctaatgtttgatcgtccattttattttaattttttatagttagtactttatacgatgatttatttgttttacttctttataattttttttaatataacggcggtcaaatgttgaaaaaaatcaattttaaatgaggtggagatagaattaaatttgaaaatatattgttcactcaattttttaaaatgaatattcgggatgcaaatttttacgaaaatataccatcgatcttgcacaaccgttgcgcgaaaataacatacacgtgatgtcgtgggcggtatcgcgcagtaaaaaggcgagaccgcgcggtctcgctgaatggaaaagcgaagcccatcggtctcaccaaatcaaacaacgacattatccaacggtttccatttgatttgtggttaattacttcattaacaattaaataataataataattagtgattaattatcctaattagcatttaattaataactaattaaatcggcatggcaccggtatcgctaattgcttgaccgagaccgttcggcttcgcttttacatcccgtgggaccgtgcggtctcgcgatgttgctgtgcgagtccgcgcagtctagcattttcaccgcgcgatgccgaccgcgatgtcattctacgccatttccgcacaaaccgacggtatattattgtaaaaaaaaaagtttgcatcctgaatatttatgagaaaaaaatagaatgaaattatatttaaattttattcgacggagacacggagtgagttggacttttttagccatcggatcgatcgatgtggaccgggcggcgctgtagacgcagtgatgatgcgcagcgcgcggcgtcggcgtgggcgtcgggggcccccgccccggccggcggtacgcgagccgtacgcgcgcgcgccccatctcgtgattagccaaagcccccggacgccgcgtggagctccgtcgtaccacctcccaccctctccacccaaaccacgattccttcccatccgctgctgctattattccaccctccttttccctcgtctctcctcccagatctcaatcgcacgccgtacgttatcactgtgaatcaggataagatagcgtacacgtgtaacagtgcccctccataatctcagcctcccacccccgttccatttacagcaacaaatatagcacaataaagtaggagtaaagattttcagcataataatctcaccgtgatcgtttatttccccgcgaaaaaaaaaatctttatcttgcagctgtgt

SEQ ID NO: 51196 - DNA, 2523 bp, Oryza sativa
agttaaggaaagagacgtccagagaaaaaaatgaaaatccttttggatgaatttgtccgtagaccagagagattttcttggattttcttccccgagaaaaaaaaaagagaagagcccatagtacggcaatgtgcaatactactgctactactatctttcttccaaaggagaaaaacgggtgtttttgtttcaggcctacaggtggggccgaccacttcgatctccggcgttttcttctggtcgtcgccttgcgagccgcagccggcggtggcccgagcgaagagccagcgtggcgtgtgcatgcgcagggcgcgtgactgcgtgtgcggtgcggtatggccacccagcaaacgtggcggagagccatgcgagtcgcccgccgggtggaggtccatcgtggtttgtcgctagcatccgctggctgaattgccgtacgattgtatgacacctcgctaaaatctgaggggcatctatgcttctccttattcttaaagagttaaattttaaatttttaactttaaatttagagctgattttagggtttttttatcgaaattcattttttaatatttgcttttagatcgctaagagcacgtatataaaaattttattcacagttactcttcggttaaaaatatggtatttggcttattacacgaataaacgaaacgatggggccgtatctttcgactactgctcatgcatttacttgaaaataaactcatttgtcttcattttaagataaactcatttttcattcatcccatgctccacatccatataaaaatataaatatgaaaaatttaaaactagaaaaaccttactttaccaaatcataatacaattatttatcatttatctacttccaatacaacttttttaatatatttttacaaactccgatacaagcgttttttctaaaataaatttattttaagattaatagtagatagcatagatatatttattttgggacagagagtagttaaatatctcagtaatgggaaaaagtgtaacctatctttttctcaaattggaactcgatcaaacggttttatctctatcaaaaggaaatgaagtgagatgaaatattcccacaaattaactagggaagcaaaacagcattcagattccttcgaacttcactcctggtcaaatttaggagccgaaactctgtcagataaacctcaacagtatttgaatttgtatatgtgttagttttataccctcaatcttgtaaattgcatatgtcaatatgtaatcgtaattgcctagggcatcgaagccctcatgttgtctacgcgatgatcaaagaatatcagcatgtcgagatgcttttggtgcgatgtgctattggtcatgggtgtagaatctatggtagaactaattgcaccgtccaaagcaccacggtatcatcatcctccttatcgactgcacgagggaatcaaggtgggggagctcgggtcgaagaatggatatctacaaatttcaattttcgattgcaggggcttatagagaagtctggaagtaaagtttcggcctacgttgagagccatatcaatgttccggagcaaccaaaacaacatttgtaaccatgagttcggatttaatttcatgatttataagattattgtctaattgatactcctcatgtccttaaaaaaagtaaagttaaattctaattaccaatataggcatattactccctccattcctaaatgctcgacgccattgactttttaaaacatgtttgatcgttcgtcttatttaaaaaatttaagtaattatcaattctttttctatcatttgattcattgttaaatatacttgtatgtatacatataattttacatatttcacaaaagtttttgaatgagacgaattgtcaaacatgtttaaaaaagtcaacggcgtcaaacatttagggaaggagggagtatatgtctagatcagaagttggtttttttgaaagacagatgatgtagtttggttcaagtttaacgatcgatagtgttttttaatctataaaattatttttttagtactccatctgtatttttttaatgtatgacgccgttgattttttaatcaacgtttgaccattcgtcttatgcataaaatacttatgtcatgattaaagaacatttgatgataaatcaagtcacaataaaataaatgataatgacataaattttttaaataagacgaggtcaaacgtttattaaaaagtcaacggcgtcgtacattaaaatacgggagtattactaacatgaatcaaataatccctcgattcaatgagttaccgtaaaaaggtccccgaaaaaaaggaaaaagggaaaccgataatgcaaaccacaaagtgcaattcgcgaaccaaaaacgatcaacgggacagtgatccacgtacgggaaaaccacccatctccggcgacagtggatcccgtatggaaaaaccacccatctccggtggaaaccatcggccaatccgcggccccgctggcccacacgcatgcgtccaaacag

SEQ ID NO: 51197 - DNA, 2808 bp, Oryza sativa
ccccccccctccccctcttttccagtggctacccaaggtttctagaacctacaggaatatgtccaatccctgacggaccccaaacctaccacagtctagagagcctcacgtactagcgttacccaaaacaaatccgtagggcacccctaccccccaccgcgcgacgtgtcctacccccgctgccctctcgctccacctcgccccccgcatgcctgccaccctcctcccctcaccggcacgtgtccccacctcctgcttgacgcccccgtctcgctggaagtgggcccgactacgcgtggggcccgtgctgtcagtgagacgtggcgctgcgcccaccgggatgtggggagcgagagacggcgtcagttaccggatgcgtggtactactacgacccctccgcccacggcggaaccgtggttggggtttaacgcaaccatggttcgactctatcccgaggtgggagaccgtggttagtggagcagtttataagcgcgcaccgcttcggcttcgtcctcctcgccttacacatcgcaccactctctcttactcgtccatacgccgagtccacgagatctcgccgtagtccatacaccggttgatcggaggtcgtgttgccgccggcggtggccatgatgatgatgggggaaggagtcagcagcgtcccgccgtggtctcacctccccgtgagcggagtcgatgtactcggcggcggtggtggcggtggggatgagatgacgccgtacgtgatcgccgcgctgcgggattacctgccggcgaatgatgtcggggtgggggctgacgaggaggaggaggccgcggcgatggccgcggcggtggacgcgtacgcgtgcgacgagttccggatgtacgagttcaaggtgcggcggtgcgcgcgcgggcggagccatgactggaccgagtgccccttcgcgcacccgggggagaaggcgcgccgccgcgatccgcgcaagtaccactactccggcaccgcgtgcccggacttccgcaagggcgggtgcaagcgcggcgacgcctgcgagtacgcccacggcgtgtttgagtgttggctccacccggcgcgctaccgcacccagccgtgcaaggacggcaccgcctgccgccgccgcgtctgcttcttcgcccacaccccggaccagctccgcgtcctcccggcgcagcagtccagccccaggagcgtggcgtcctcgccgctggccgagtcctacgacggctcgccgctgcgccgccaggcgttcgagagctacctcaccaagaccatcatgtcctcgtccccgaccagcaccctcatgtctccgcccaagtcgcccccgtcggagtccccgccattgtcgcccgacggtgccgcggccatccgtcgcggatcttggcccggcgtcggctcgccggtgaacgacgtcctggcctcgttccgccagctccgcctaacaaggtgaagtcgtcgccgtccggcgggtggagctacccttcgtcgtccgccgtctacgggtctcccaaggccgccaccggcctctacagcctccccaccactccactggcttccacggcaacggtgaccaccgcctccagcttcatgcccaacctggagccactggacctcgggctcatcggcgacgaggagccggtccagagggtggagtccggaagagccctccgggagaaggtgttcgagcgactgagccgggatggtgccatctccggcgacgccacagccttcgccaccgccggtgttggcctcgacgttgattgggtgtccgacctcatcaactgaggcttccaagtcgctattggaagccccttttgtgagcatcaaggatgatggcatggaggaggagaaggtggcggtaagaagaaaatgatggcacgacaaaaaaatccttcattttcttttgtgatttcaagtcaagtttctactaattcctgtacatatctatctcccatgtgaatattcatggttggtggagaggaggcaagtatggaaagatgggtggatttgttttggggttttgaggtagtagcaaaattacccacaaaaaaattaggtgaaaaaaaaaagaggagtagaaatggaggtgattcagtgtctcctgtgtgcatagggtgtgtggaggtgaaggaagcacggaaggaagaagatcatggcggaagaagatggccggatttcggccgccgtcgcggcggcggccctgcctatttcagtgatttctgggggtttatcctctgttcatcgtttgttgcatcatcgactagctgatgaagatcgtcgatcgatttcaatcaagccccccctcttgttgatttcctattttgttgatgtaatctttgttttgttaagaacccccaacagcatattttgtaccttagctttaaatctgaaaatcttttgctgactcatctacctatatgtggtgatgaagcccccctcaatgtattgtaatcacctgcttcaagtaaatgatccaataatattatgttgctatatgtttcattacttccttgatccaaataacactcatcttaatatctctgttcattagtgacgaaatcgatgtgttttgtggagctgagcggggggcgatggtgccggggaacctgccgtgacagagaccggcggagagtgcgactgcggcggagtcgccggcgagtcgttgtcatctttggtggaatcgatggtgcaagattggcctgcacatgctgcagctctctgcttcttccaccgcaccgctgcttggccacaaaaagacacgtcctctttattcgagtatgtacatgtactactacccggtagc

SEQ ID NO: 51198 - DNA, 7503 bp, Oryza sativa
ccacgagacagcggccgttgtggtggtggcttcttgttgctccgtttcgtctcgtacactttcactttactttctttttttgatgggcatgtctagtccttttcgacccttcctgtttacgtcacgacctcgcacagtccagcaagctccatacacagtatcccgtagaaaaaaagatggcgtggactacagtatatatactgtaccgaatacttagagcaagtttaataatatagtcaactactagctctaaattcatctataaccaatctaatagctcattcatacaatagttatatactacactattaataactggtctcacatgtcatacacacactgtgtcttagagtccgtactacagctagccagctgttcttctctctgttaatcttcttaaaatatgtttatagctgacttatagtctgctattgtacctgctcttagagcaagttttatagccaactactagctccaattcatctatatagctaatctaatactctctatgtcccaaaaaaaggacaaaccgtgagttcccgtgccaacgtttgactgtccgtcttatatgaaatttttttataattagtattttcattgttagatgataaaacatgattaatactttatgcgtgacttatctttttatttttttccataatttttttaaataagacggacagtcaaacgttggacacgaaaaccagggtttatcttttttttgacggagggagtagcttatttatataatagttatctatgagcatatactacaccgtttcttataatctagaataaaaaatgcattgtttgggtagtttccgattcgacgagaaactaaaaactccctcaaacggaccctatatgtttgtctgacaaagcagttcgtgttgctttatactccgtattatactcgtaatcgtgatgacaaatttgacgtagtaggataaaagaagaagacgattttctgggaaatgatcagatcaatttgacgaagatattactatatgctgccaaaaattttctgggaaaataatactactagttgccgcttcatgtccgacaaactaggagaagaaaaagaggcggagagagcctagtatagcagtacagctgtagtccacacacgcgagtagagccaatccagcagcatggacccccttccttactcaaagcgagggttggactagcctcgacgttatccatccatccattgccatccacacaaacacagccgcatggatcgccttcctccgcacgtcgccgccacgtgacacgaatcatcaccaacgctccagtcacgtagtacggcctagcagcatgcgctgttttggtttggagtgtgtttaattagttcacactaaaattataagtttaattaaaattaaaattaaaagtttatgtgtgtagaaaaaaatttaatataataaaaaaagttgaaagtttaaagaaaaagttagaaactagatcaggccttgctttggtttccaccgcaaaaacaacgagaggttttgatttgcgggacaaatatcacgggcgttccaacgcgtcgatcgtcactgtacatggaaatcgacgtgtggctgcgttcgttctggggtagggagtttgtttgtttccttgtctgcgcacgcgcttcccaaagtattaaacggtgtactttttacaaaaagtttctatagaaaaattgctttaaaaaatcatattaatctatttttaaagtttaaaatagctaatacttaattaacaatgcgctaatggctcacctcgttttgcatatgttcctaatcttctctatctccttctcctcgaacacaaccctactcgctctttactgtatgtgtgtgagctcgatttaggccatctccatcccaattttgctggcgattatggattgttcagaatgttcagtccaattatttgttcggaatgttcagtttgttgttatgcgtggcaaagctagcagcaggacgtacggcactagtggcaggtggtgagagccttgcgacacaaaagttgcaagggagtagtaataaacacagctaatctatgtttattatgcacaaggtacggacccgaccgaaaattggctttatggatgatgaagcaacttgatcaacttgaagaaatatctttccccaatttgcgtaactgcggctacaaatatcttcttcctccgcgcatgcatagctgtaactgtaactgggctgatttttcgataatatttctcctctcgcatgcttgtgtttagatctgactccaactcagtcgtcaactaatttgctcgagttaattagagattaacgtatagcggtggaaatgtacagctctggatccaaatcgatcagcgcctaaactacgactccgcaaaacgcaatggcaggtcggaactgctacgcccatctttcttccacagtatattcattgctatttttcacaaaactagctgggtggcccgcgcaattgcgcggctagcacccatataaaattatatattttttaatatgattttacttaaaaattattaaatagttatctcgttgtcttaagattttgaaagaccaaaacttatcattcccgtgtttctaattttatagtttttaaaagtcacatcagtggctaccccttacttctatcatattattctttattagcttgctcgatctatcaccgtttctattcattcttagaaacctttaaaaattagatgttaagacttatagtttttagagtttattgtcctgttgggctttttttgtataatttccagaaatcctgtcaaatgttgtcattatactcctctacgaccgtccactgcatcttctctttattgtcattgctattttaaaaatcgaacataattatcgtttaggatcatttttctaccttctagaagttttgccaaaacgtaagcgactttgtcattgtactcctttacgactccctgttgccggttttttttattgtcattgagattttaaaatcaaatatgattatcattagggttaattttttactttttaaaagcccgaaccattaaaaatttgaccttatagtttttaaagtttattatcgcattgggttcatgttttttataatttttagaaatccctttaaacgctgccgtcctttacgacccgtccgccgcgtactctttagtatcattgggattgtaaaaatcgaatataactattattgaaatttatttttcaatttcgagaagacccaccaaccattggcggctctgttattgtactcctatacgacccgctcgttgcctctcatttttattctaattgagatttcaaaaatcaaatatgattatcattggggtttattttttttactttctagaagttcctgccaaccgccttgaccgattgcttcacaatctgtctgtcatcattccttttaatcgtcattaggattctatttggtgttttattaatagtttttagaagtctcatcaaccgccaccactctgctcctctatcggcatgttacttaattaatctcgtcatgtgttttagattgtcttttctttcaatagttttattttctttttcaccaatattagttatttataaattgtatttctagttgaaatcttatttttctttttctaatttcagaatttattttattttccgtattgtgttcttctgttttttttattttttattttcaatttcagttgtttcaaaattgtattcctactttaactctctttttaatttgcctaatttcggatttttattttattctttattctaaattttaatttatctactattgggttctataagtactcttatttcgatattgcttatatttaattccgaatttcagttaattttaaattgtattcctactttgaactcttctattcttttttataattttgattttttttattttttattctgaattttaattaatctcgtagtggattcttgtatggactcttcttttaatattccttatttgtaattccaaattttagttatttttaaattatattcctacttgggatcttcttttttttttaattttggtttttattttatttttatttcgattttgattaatctcgtattgtgttcttatatggactcttcttttaatattgcttactccgtttgaatctttagaacatgtcaatatatttttgcaatcactttgcattgcttaatatatttatcatattttattcagtcatagatggacggggaattctgtaattagtaattagttttgtattctaattatctattcggctccaacacatactatatgcatgcaacgtgcatgtccgattcctcatcaatgaaaatattgtaattacttctcagtttcctattagaattgaataagttagagcagtagtttctattcatattcatattcttcaaattaatctacaccgttaaaatctagtcagtttgtgatctaacggtttaatatttttttgttttttctctgattaatgtaggaatttctagcccccatagcgaacgtggtgcctcctttcaaagctgttttaataatataatagatatatatatataaatacttatctttcagaacagaggttgtatttatcaccaaattgttatctttcgtagctctcaatcgatatgatctgctgattgcctcccgtgttaaccttttatctttatctaatatactatatgtgctttttaataatatattataccattgactttttaagattattcgttttattttagaaatttaaagtaaataattttttttgtcactatagaaactttaagcattacttataattttaaagcaggaagaacaatcaaaggatataataaaaatcaatgacaccatatattaaaaccggattgaatatctcatattcaactgatgaaaattcataaccgataaacacatgtatcaatagatacacaacttgcaaaatattgctttgcaaaaaaggacttgatggcggtagggggtaggcgtaaaatatctggtttggtttgggtggtaccaccatgtatgagggtgcgataatatattttcttgcggtagatacgcgcgggtccggccaaatcgatcgattttagcctcatctcctccccatcatgtggataaggcagaccgcacacacagcactcgtactcgtgtcgtatagtacatagtagtactacaagttgcatgcatgcacgtgacgtcgtacgtgcactgtacggcgaccgtattagtaactgccacagcacagcacagcacacacatgcaacaagtcaaaagtagagagatactgtcgaaactagatttcggcaataagaaaaggggtggctatcaagctggagaagtgaatgggtttggagacaaaggatttatataggttcaggccttcttattcaagaagtaataccctactcctgtccggggatgaatccgccgagtatcttattgattgtatgatttggggataatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatccgaatgcttcaaacttttcatgccaaggcctgccgagtagtgaagacgaagactgtaaagggcgaaaagataaagaatatggtgcatcgaatagatgcacctaattaggtgtacctcccaactatgtgattagttaacaaactaaacatatagttgagaacaaaataatagcacaatcgtgcatcatatgacaaaagcatacacggcgcctaaagaggcattcttagccgactgctttttagccataattaaaaggaatccgagtggttaacactctaaaaggttcacgaatgaacacacttgacaggcatcagaatagaaaactctaaagattacccaccaaatattataaaaattatggtaatgaataagtctaatagcctaggctatgactatttaccataacgaaaacaggcatataacataccgaggaaatgactatggtaaaaacaagttatcccaagttaacccagacagcttttgtagcctaaaaaagcttacaaaaacagcataacacctttctgtcgggcaccttttaatttgcattgtaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaaacccattcgtacctccgatacccttaacaagaaatcccgagatccaagcgacacttcatcttccccgccggaactctcgccattttccccactccctgctacagtacagagctgcgccggcaaactagggttcaccattccactcgaatccaccttcgaaaagttcatcaaaatccttcccgtgatccaccgcctcaatccttcacctctccctagccatccctcgaatcaaatcagcgcattcgaaaaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatacacacgagactgtggtcttctcccatttcttctatggcggcttcgctcttccgacctcaaaatttttccgcgggatattaagcttctatggaatcagcttgcatcacctaaacccaaattccatagttcacatcgccaatttcatccatgtttgtgaagccttcttgggaattaagccccacttcgctctgtttcgccgaatcttctttctcaagccccaaccaaacaagagtaagccatgtgtagtcggaggggccggatttcagctgaggggactctgagccagaagtacttctctatgcccttcaagacctcaaacaaagggtggcacgcaaactggttttatattcagaatcctgagcctgctcttcccgagtactcttgtcttcctccggcgtaccaagatacctggaactctcttccgattggggatgaagcagcccaaaccttggagctgatgaatcgcatgctaaaactcaaagaacaaggcttacaaggagagcagattactcggcacttcatcaaatgccgattggcaccaattaaagaaagatcccgtatggcatttgagtttgacggtaagcatgatcct

SEQ ID NO: 51199 - DNA, 1294 bp, Oryza sativa
cgacgacggcaacaaatctggggacaaaggctcgcccaataaactcccaaagcataccactcccaggaaaaaactggctagtcgtccaaggccaaagatcagaacatcttccaggtataaaactctcggtaccatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactgaaaaccagtcggcagcaactgaaactacaacaacccaagagcccccgactggaaaccagtcggatgtaggtccagatcaagaaactcccgaagttgaagcgcagacgacaacttctcaaggaccagaggctggtaacgactcgttgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcggctgatgactctcgtcctcctatcttgctcaaatggtgggacgagaactcacaagctaccggcatcgtcataaatcgtcaaaaagaagatgaggaagtgtgccagctgaagaaggcacttggagaagccactcgcattgtgaatgtaaatcttccgggtgactgcctttgatgactttgttttctcttcagcaaaactaaaccatgaaccatcatgcagagaatccatcttcgcaatgaggccaagaccgcaactttagaaaagctagttcctcatttgggaactcttgaagcagttagggaccagctacatgaggccaaggagctcgccaaaaagacagagaaggaattaagggaccgaattgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctcttttta

SEQ ID NO: 51200 - DNA, 6873 bp, Oryza sativa
tcatatccctgtatgaagtataccaagcttagagcgaaacgttgactgcacatccagtgggcgtagctatccttaatcctttacataactgtgcaattaatcttgagttaagagctaagatatatatcatgttttgactccatatttacaatgctacagcagaaaacttgtgtggagcgccatacattttatctagagacaatcatcaaactcaataagaattagagatgctagagacgctttgtgacaccaccttgcctcaagaattaattttctatgtatacataatgagaaaagatacattttactatagtgtagactttgaggttttagctactcgatagggaaaaactcctgttttggaacaaagcacccttagtagcccacagcagccggatatggcacttccttggcctatagccgtaagatctagtgctccctcaaggcccggccggtggcatagttgcctaccgagccggctgcgaaaacgcacaaacgcacactctacctctataagcaccttcaaaagattggccggcatattctgaaattgacggagtcatcacgagcgtaacacgtcatctatcaccgaaagaataattagccgtaaatgtgaacacctgtgtcaaatctagaatttcaacctaggtgagttattccacgggaaggaacatttcagtcatgcatatgaaaatttttgtacttccttgcgtagttgtgcatacccatgggtgccaacactactacaaaacccttaataggtgttagcaaaaccgacacctataaaccatttaccaccctcacgggaaaaggctcataggaaaccttcggcaactataggtgcaagttctatagtaaaaatcaataccaatatcataggtgtcagttttttaattaaccggcactaaaaaaccgagccaataatttttcattgtaaaataggaattagatagggagatcctttgtctctagtgctcatgtccttggagcagaattgctacaggccataatcaacaaggcaaatcttcttggacttctgtctaaacctatccctattgaaagtgacccaaattttcagttgtttaacatgccgatgacatccttctgtatgtcaaagcttgtggaagataattgtggaagagaattgttcaccttggaggctctactttagacttttgcacaagggacacgtctcacggtaaattatcataaatgtctgacactaataaatgttgatgaagagaaagcacaaatgttggcaggtgtctttggttgttagattggtacactacctttcacataccttagcttaccccttggaactactaagactagagtggttgatgttgctcccattgttgatagaatcgagagaagactatatgctaattcagctctttcatcctatggtgatagactcgctttggttaattgagatcatttcttccttgccaacctattacatgtgcacttttgtcacgcccggaaattcactagtaattttcgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactctcacaggcagctcaactggggtataagccaaacgtcttctccttctggatcctttatcttcaactgaggtttgattgattattgcaagaatgagcatataacatactcaacaagccacacagcaaatatgcaagtgcacaaggataccaaaggatggcataatataggctcatttgcgaaagcagcatttagcaaagaattaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacatttcctggatcataatcacccccttataaacaaggcatggactccccagcgacccccgtggacttctcgccacttctcagtctggcgcactataatgaatcatgctacacaaaagataaagccgttgcccacgctggcttgtggttggcacgataaatgtttcacagcagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagtgatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgtaaaacgaagaaaaagactaataaaaaccaaataaacaatacatataaaataaacaaacatgtagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcaccctcgaaccaaacgacgaacgacgacggccggcgacgaggtctattggcggcgcggcttcggtcggcggtggcgacgggactccggtgaccggcgacagcggggagagagcggccgggcttctccacacctcggcgcaccttacggcggtgacggcgaccggcggcgacgacggaggcggcggcgcgacgcggatggagctcggccggcgacgacggcggggtggagcacgtggcggcagcgctacgaggcacgggagaccacgggagagggggcaaacgaaagaggtggactagggggtcctatttatagccttggattgaagagatcggactcctcccgcaagaaatcgatccggaaaatcaaaaactcggttttggagataaactcgaaaacgagttcgattcggataagatactcaacgattagctccgattttttgggggtaaagatagaggaggataagaggaatatttcccctcaactaaattggaaaaaggagcaacggggaggcgagatttaacggaggaagcggcggctgcacagggcacagcacgggcggctcggctctgtccagagctggaagatgaacagtgccagggaggtaaattagacttttccggctaggctgagaggagaggaggcggctcaggttgggccggcggaagagagaggaaggaaaggaaggaatgggctgaaaatggctcaagctgaggaggaggattttattactttcccaattaaaataatcacttaaatgatctttgagttattaaaaatacttccaatgctcaaataatttcaagaaaaatcgtgaaaatacttggacactcaaagtacttaacaaaattataattagaccatttaatgattaatttaatatgtgggtaattactgaaatgctctttgtatgattaaaattaggaattgagctccgaaaaatccgagaaaattccagagagtataattaaccatggagagtttaataaaaattaaatccatccatgctttatatttaggaaattttatttcccacatttaacttcacttgtaaattaatgaacatttaatataaattctaataataatttattaaataatttataaatcctgaaacaaaaatcagggtgtgacaactttgcagctgcctaaaacattcattgacaacattgatagggaaaagaggcattgcttatggaggggttctgatgtgaactcaaagaaaaaaatatttgtctgcatgggataataattgcagacctaagaataagggaggtttgggagtcatagatctttccattcagaatcaagccctccttttgaagtatcttgataagttttataacagaagaaatttacaatgggttaacctattctgggactcttaatatggaaatggggtacatcacttaagcactctcaaatgttctttttggtggacatatgtttgcaagttaacagacttctttaggggaattgcaagatgcttagtgggagatggaatttcttggtcattcagggatgatgtttggaatgataaacctcctctgtcctctcacatgctatgattatattcttttgctggaaatactaagattttggttcataactttatctctgtagacttgaaagataattttcagctgcctctatctcttcaagcctttcaagaactgcgagccttatctgcaatgttggaggaggttaacctatctcaggagaatgatatttgggcttacatttggggaaatcttaaatactcttctcagaagtattatgccttaaactttagggccatgcaaccacctcctcatttcctttggttatggaagataaggccacctcaaaggttaacacaaaattatgaggacatcactagcttggataagaccacggctatattatatattcataaaccaaaggtgcatgctttctatgtaagatttacatgttatatatttaaacaaatgttgctacacaacgagtttggtgtgttttcgtttgcagtgatacttgcttgggtgaaagaaaagagacttgagtgtaatgaatgcatagatgatcaaagaagttgactagggatcgacctaagatcatcttcaagtccactcctatctcaccatgtcaattttggtccatacaagacaagagatgaatttctatatgttttggattcagatttgggtctcttaacagcatcaatttcaaatgaacctagcccctgatctaaatggaatattggggcccatgagtactagttggaaagcttatggagtctttgttcaaatggttttggtcccacgtcaaaattcttactgagttgtcaggaattttcaaaacaagtcacataccttatctagtccaaatctgatttaggctttgggccttgtaattgtgttgtgggctaagcccaaaggggtgtgtgtctagggaaaccctaggatgtcccaaatcatattcatttagtagccttcatagtttagactcgggttttgcttagatttatttctgccaatgtagttccgccacttgttcagtttgtggaaccccaatttctaatcttaataattcatatgcaatttagttgcaatctagcttgttcttacttgtgttcttcaattctcatgcagggattagccttctcgacgagatcaaccgggcaacgcacgtttgataaccataggagagatggtgctacgattgcagggttcagattgtgttgatcggaagacagatcgtctgtgtcaagtttccatcaaatcaagagttatcaatacctatcagatgatcatgacctaattcaccaccttgagattgcatctctttttacagtgtccctttgcaacgtcatgctggtatgttcttggtatctcttgggacacatctttgagcctggacaatatgttggtgcactcgagaaactgttacgaaggccattgtttcatgaaaaaaatttctttatggggcttggaatatttggaggcaaaggaatggtttcatctttgatcataaagccccctccttagattcatggggcagctccttaaggcggatctcctcatgttgttgtttcggctgaatgagatatacaaagatgtactccctccgtttcaaaatgtttgacaccgttgactttttagtacgtgtttgaccattcgtcttattcaaaaaatttaagtaattatttattcttttcatattatttgattcattgtccaatatactttcatgtacacatatagttttacatattttacaaattttttgaataagatgaacggtaaaacatgtgctaaaaagtcaacggtttcaaacattttgaaacggagggagcatttcttaattggatctctttgttgtaatttcccttttttatgtacttattctttttttaataaagtcctagtatgtgaagtttgtatattagatatacgaaagttgatccgcgttgggataattttctatcttgtaagactgctccttcgcttatataaggagggcaggatgcctctttgggggtagattcacaatcatattattagatcaatacatagctcggcagattcaaatccccaaataggagtggggtattacctctcattgagggcttaaacctatctaaat

SEQ ID NO: 51201 - DNA, 3028 bp, Oryza sativa
ggacaatttataatgacaattcaaattatcgatcattcttaatgatcacctgactcgactgaaattggtgtaacaagagcgcagagagggatggcctttacaagtgtcaagccgaacttctctgacatatctatcccattcctttcaatgtcaacaggtagattccatttgaactggtttaacaatgatcccagaactaaatgcaccatcctatttgccaatggcattctagggcatatccggcgacctgcaccaaatggaatgagctcaaaatgcactcccctaaaatcaatatttctttcgaaaaatctctcaggcataaatttttccggttgagaccatgtatccttgtgtctgcctatagcccacacatttacgaaaactcgtgcgccttttggtattgtgtaacctgctatgtttgttgtcgtttcagcttggcgtggcaacaataatggtactggaggatgcagccgaaacgtttctttcaccacagcttgaaggtaaggcaattggccaatatctgattcttcaatatttgtacctgaaccaataacttgtgaaagctcatcacaacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatagagctgaccttttttttttttgcatgcccctgttgctgcatggtttatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcaacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagagatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttgctatgtaggaagacagtaaaattaaactaactctgtgttgtatggcaacagtatgaacgtcttgtaatgctgccccttcaagagatggaccagattgtcctctgtttcttgcggatattggtcgagcattgccacttttactttccgagggtcgatgaatccattatcgaaaaccctccgccgtcgggccctttaaatctccattctacaacgataaaaaggagtatattattttctatggtctacttatatacaaagacctaattaattaaaagagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctacctgtggcgctcatctccatgtacagctgatggaacttgtacatttgtgtgggtagggactgcagcagctcaggcttgacaagcgttttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactaaggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttatgtgggcaagcggtggagctgggggggccttgactttgaaggtgccggaagaggagcttgcgggggagtaggtgtgggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacaagacgccgcttgtcgcccagggaggatgatgtaccgcctg

SEQ ID NO: 51202 - DNA, 1717 bp, Oryza sativa
gtgcggccatgcgttcataaaccttccttgccaccttctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccactgtgacgtacatagttcttggcggcttcggccggggcataggacgtccatcttcttccacttccgttatgatgtgccgaccctcaagcttcttcgctgcacctcgttgcccgcgtgccctcttctgtccaacggagggttgattaccactagcctcctcctcctggttcccctccacatccctttccaagtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattaccaaataaagtaatattatattaaaactcaaataatattacatgcctaagactaaaatagtaatgtatgctaagtgtttcgtgcgtatatgctaagtgtaattaagactacaatactcaatt

SEQ ID NO: 51203 - DNA, 5340 bp, Oryza sativa
taaagatcttttcccactatttccaaattctttttaaacccggttagggttaagaaccgggagtaaagataatagcactgaattttgaatttcattatatttgtgtttctaaaatagtaaataatgcattacgattatttaaagtcgaaaaattaatgacaaaaccttcaaaaaattattgttgtctgtagtaaactaagtggataatatataattagcacatgaatgatttaaaattgttaaaaattctaataatcctatataattagcatatgcatgatattaaattgttaaaaattctaattaacatatgtaaataccacatgcatgatttaaaattaataaaaattctaataatcgtatataattagcatatgatgatattaaattgttgaaaattctaaataacatatgtaaataccacatgcatgatttaaaattaacaaaaattctaataatcatatataattagcatatcatgataataaattgttgaaaattctaattaacatatgtaaataccacgtgcatgatttaaaacttttaaaaattctaataaccatatataactagcatatcatgataataaattattgaaaattctaattaacatatgtaaataccaggtgcatgatttaaaacttttaaaaattctaataatcatatataactagcatatggttgatttcaatttgataaaaattctaataatcatacataattaacatatgccatacaacaattgatttgtatggatattcaatacatccaaaatagtttacatcgtgtacacaacaattacagcaatacatcggcggtgacggttgaccgcacgtactttctcctcactattgttccttccttgtgatcgctacgcgagtaaagggtgtcttcatttgataggaggatgctagggtcaatcgtcaccgtgaaagggggttgcccatcaaactgatcgtaatcctcgtcagtcttgtactctactccaatgatttttctttttcctgggagaaccacgtggcgcttcggctcgtcaggccctttgccctttcttcctttgctagacatgtccttgacgtaaaaaacttgcgttacatcattggcaaggacaaaaggttcgtccgagtatccaaccttgttaaggtcaaccgttgtcatcccactgtcaatcgttacgcctccaccagtcaacctaacccattggcaccggaacagagggaccttgagaggtccatagtcaagttcccatatgtcctcgatggcaccgtaatacgtgccagttgtaccatcgtgtcccatggcatcgatacgaacagcactgttctggctcgtgctcttcatgtcttgggctctcgtgtagaatgtgtacccattgatttcatatccctggaatgtcgcgatcgagctagatggtcccctcgccaggaaggccggttgttggttaatcgtctcgttacccatgagatgttgtcgcagccacgcggagaaagtatcaatgtgatactgtgtaatccatgcgtcggacttaccgatgtttctggcacgaactagagccaagtgctcctcgatgtaaggagccaccaatgaagattgttgcagaaccgtgaaatgggctttacaaaataaattgttgtctaccgtcattattgctttccttccgagagtcccctttccccgtagtctcccttcatggcgtgatttaggtaccccgattgggcgaaggtcttcaataaattctacgcaaaattcaatgacctcctctgttccataccccttggcgatgcttgcctctggacgagcacggttacgaacatatttcttcagaacgcccatgtacctctcgaaaggaaacatattgtgtaggtacacagggtcgagaataccgatctctttgacaaggtgacaaagcagatgcgtcattatattgaaaaatgaaggtggaaatatcaactcacagctgacaagacattgcaccacatcattctgaagggcttctaatctatccggatcgatgaccttctacgaaattgcgttcatgaaagcacatagctttgtttttgttgcctggacattgtctgggaggataccccttattacaactggtagcagctgtgtcatcaacatgagacagtcatgagactttaggtttgtgaacttcttctccttcgtgcttattattcgctttatattcatggagtatcctgacggtaccttgatgctctccaagcattcaaacatattgtccttctctgccttgctaagagtgtagctggctggagtcaagtaatggcttcctttcttctttggttctgagtgaaggttgccacgttgttccatatacttcagatcattacgtacttccagtgtatctttcgactttccatatacacctaggaagccaagaaggtttatgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcgaaagactgttttcccactgcgatgtttaggcttcgtacggtggtcggccttatgttcgaagtgcttgcctttctttcgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtccttaccaggttgcttggggccttgaataataatcggcatcattatgtacttcctcttcatgcatagccagggggggaggttgtagatacacatcgtaacgggccaagtgctatggccactgctcatctctccaaaaggattcataccatccgtactcaaaccaaaccgtatgttttgtgcgtcctttccaaattatttaaattttctgtcgatgtttcgccactgcgaaccatcggcagggtgtctcaacatcccgtcttgttgacgctcttcagcgtgccaacgcatcattctaacattccccttgttcctgaacaaacgccttagccgtggtattatagggaaataccacatcaccttagcaggaattctcttctttgttagctgcccgtcaacttctcctggatcatctcgtctaatcttgtatcgtagtgctttacaaacaaggcatgcttctaggttctcgtactcctcaccgcgatataggatacaatcattcggccatgcgtgaatcttctgaacttccagtcctagaggacagactatcttcttagcctcgtacgttgtcttgggcaattggtttccctccggaagaatgttcttgacgagtttcaataaatcgccaaatgccttgtcactaacaccatttttttgccttccattgcaagaactctagagtggtatccaactttttgtgcccctgctcgcaacctaggtacaacgacgttctgtggtcctctaacatcttgtccaatttatgggccaccttttcactttcgcagtcctccttggcatcctgcaacatctgaccaagatcatccgcaacgctgttaccatcagcatcactttcctccttgcccgtttgatttccttcaaatccagcgtattgagctaagtccggaatattgtcgtcttccacttcatcttcttccatttcaaccccttgctctccgtgggatgtccaacagttatagcttggcatgaaccccgacttaaacaagtggaaatgaatagtcctggatgcagaatactccttttgattcttacacttattgcacggacaacaaataaaacccttatgcctgttagcttcggccactctcaaaaaataatgcacgccgtcaataaactctttgaaccgccggtcagcgtacatccattgccgatccatctacatgaaatgaaaaaaaatcgtacacaaataattattcgtacaataataacagtcatacaataatgataaaatagttacaaactctttcaacactcgtacagtaatgacatatcattattcatacaaaaattataaaatattacaccaaataattcttatttactatttctaaagttttaaactaatattaatgtgttgtacttcttttagttttcattttagtttgttttctattatttaatattaactttcactatattttccttctcaactattttataaaaccttctttagcaaataaactaaatttctatatattctttcttccccacacaaattttctctctcatcaacttacaacaaaattttggagacaaaaaagtgtgcaaaacatagctccaaatgtaatatgacaaaaaaacattggaggatgaagttactaagcttttaggcaccgtgatttgtatataatcaccaaaataaattcactagaaattttggcatgacctcccctcttttttgaagaaattttgaagcttgctcggggtggaggaggaagaagacatatatacaggggtgggactttagtcccggttggtgttatgaaccggggctaaagatcccgaggggcttaacaagccctgacagcatttgaaccgggactaaagatgatcttttaccaaccgggactaaagatcaaatatgcccgttaccctttttaaccgggactaaagatcatctttagtgtatgtatcgaggtccctaaacttggtttattatgtctttccggtccaaagtctcatttgaccgtggtcttgcctatgtggcatgccatgtagacgacgacatcgcacattattattattattttctttttttctcccttctttctcttccatttctctcttctatggcctcttcctccgacagcagcgacgcttggtgatgacagtggtggtcggcacgagggagcttgaggtggctccagtagaggaagaagataaaagaagaggaggagaaaaagaaaagggggaaaaagaaaaaatgccatgtcattgttcacgtggcgtaccacataggcaagaccatggtcaaaggacgctttggaccgagatgatacaacaaatcaagtttagggacctcgatgtatgatttgcaagttcgtggaccaaagtgaaacctcatgacaagtttaaggaccgatagt

SEQ ID NO: 51204 - DNA, 1123 bp, Oryza sativa
aaattggtttacactgtatagataatttaatctcacacaagttccttacatgtaatcttattcatggaactacagctaaatcatttcactactacacctatcaaagcaagttccttacatgtaatctgatgccaaaacaattagaatagttcagctagagggccaggaatttatctcgctgacgaaaatgcaagcgtgcgttaatatttttacagaattgcttcagcaatacttgttcctgaaatacaaaggaaatagttggtaatcatataccttcattcttctatgcaaaagtggtatccctgtgtggaactgaaattgaaataagatgtataattatatgaatcccattaatggtagattacatgcttagcacttaaaagaatgcagtaagccaatgcaaagaatctgccaagtacaaaccaattaataacataaagttgaccccaaaaccagtttagattatatgttacacccagaataaagtattgctacaaacagagcacaattgttcagcggtagctttgagtttctcaataattcaaggttggaaaacttttagtaaagaaacatacatggattttctgtcttctatgatgccagagaatatatggtgtaggcaaagtacatagcggaatttgaccaatatcatgctatgatcaccacctgtgaaaaaaaaaatgtagcgtaaaccacttagcgaaacagttcataggcgaaccaacaatttcaatagaatcttacatgtgaaagtgaaacatgtaacacattaatagaaaatttggacattataaaatataatattttaagcacgataaatatttttaaacggtatatgactttccctattgtatcaatagtagaagcatcagaaccataacacataagagcataataagcaggagaaacaatattcaaactaatgcatgtgcttaaaggttcaagcactcccttcctttacatgatggtcgtgtaagccggtcgttacatggtcgttgctcttacatgaccagatcttacatgaccatattcaggtgtagccttaactcgaccactataaataaaggtagtgggagtatcgctacacctctggtcgagaaccaggtgtagccttaattaactc

SEQ ID NO: 51205 - DNA, 1653 bp, Oryza sativa
ctcctatatccgaaggttgtttccgtataagacatggatgtggtgggtcctgccgagatttagtcaactactattaggtatgtgttatccataaccctgacaaattccccctttatttacattgacaattcaccataagtcacttataagatattttcacaaatacctatactccattataaagcaccattacaaagctatttaaagtgtctttatctctactataataaaaagaagatatttttccggtattttggtacgtcatccgtgtatgagtcggtttttaagtttgtttgcttttgggaataaatatccgtatttgagtctgttttttaagaccattcacttttggtaatacaaaaggaatcatataagaaatttgtttaaaaaaactcgtatgctaacttgagacgatcggactcctaactgcagctcatgattttctaaaaatatatatatatacatacgatctcccacggtgaatttcatcttaactaaaccatataacaataataagattaaaataaacttcacccgttgcaacgcacaagcgttttttctatagaaataaaaaaaaggccttacaaagacattttgttcatttgttgtactgtggtccttgctgtccctgcggcagatgcacatcctctgcaatactgctgatgcagtagcagacactgatgtgtgggctccgctactgcatcagcagtcctgcaaacaatccctactgccctgcggcaccccttggactttgccgtgagtacgtacgtattcacttgatctagtaggttttgaagttcctacgttgcctaaatttacagatagggttgatcaatcgtgctgtatggtccaaaggctctcatctagtttacttgtcataaatatctattaaagtttatcctaataattgtagttaatgatatttatctcttctctcaataaaccgtatcatatcattttttctaacccttagatgattaatctatactccaaaatatcttcctccttttttcccaataaaattatcttacattagattagagttatctttagatgattaacctattttatcttcaatcttttccttctgtcattaagatacattaccttagttttacttttgaataatcaaactacatataatttaaattgttataaaccttgtcatcttaattgtttataacttttttcatggtcgattaaatatgaaaattatataaagtatataaagttatgtcatctagctatttttcatgttattttatagggttaattggatacatgccattagaaatttaccggtttttaaatataccactagtatttatgtatttggaaatatgccattataatttcacacatattcaaaaatatcactacttacctcttatatgcatttccatagaaaattggaccaaactgccatttttccccgcttcttccttcttcccctttctccttcctcctcttttcgttctcagcggcggcgagtggtggcaacagcagcagcagcaacgcggttgcgagcggcagcgcggcggcggcagcagcagccgcagcgacgcggctgcgagcgggggcggcagcagtaaggttgtaggcaaagcaacacgagattttacctcctgctgttcaaaaccatgtataactcga

SEQ ID NO: 51206 - DNA, 3165 bp, Oryza sativa
aagaagaaatcggaggaatttcggagttgtcgataatctcctcttactttttgtacctttgtaattactctgatttcatagaaatattcttccgagtaattaagattttgctttgtgagaattatctcttagttagttccttttagcattctaatcattgttcgctatatttaatatgcagtgtttatgtttactttagtgagttatagacactagagtagaaattaatttcttaaacatggtgtttaggtagttattttcagagattgctgcgtatcccacatatcattagaggttggtatagagatagtgacagcccacaagagcaccacagtcctcccagtccgggtacggagtagagcgcgttctggtagcagtgagcaagttagcgcctgaagttttgctataggattaaaccaagctttctatagacattgtttatcgctaggaaatcctctctatcatttgcctatctttgcttcgtgcccttggatgaacctagagaatagctgagcacacacgttcctcatggaaattgataccttggaatactcccgagtgaagtgttatatcggcatatccgtgcgcttgcagattttatctgtgaccgtaagaaataccaataagcatttatagtgccgttgccggggaacaattgctattctcctccgtaccttgttcatcctcatatctttgatttttcttcttcctctacccctgctatccgttgaaattacctaaaatacaactctcgaccctggagcaacctatcttcaaattgttagctcctacaggaaaattctatgaaccacctccttcattgaagccaatttttataaccgactacgaaattcgccccgaattaataagtatggttagggagaaatccttttttaggtttcgaccaagaaaatccctaccatcacctatgcatgtgtttggtttagggacaaggtgggatgggttggatccatccctgtttttgggaatgggatgatcccattttctgtttggttgaagggatggaacgaatcctattttttgtttggtttgaaggatatgatgggttggaatgatcctatgccttgtttggatggagggatgaaggtgggatgcctggagtgtacacattgtaaaataacatttagacatgaaaattacactatttgaaaattaaataccgttaatatcgctacatttttagtcagtatacatcaattcttgtatcaatccattcatagaaaataacacatggccatcatctactgtcaagaaattcacctaaaaaaataacacatttttgaactaattatactgctgttggttcaattgctactaactaattgacttcatccatacttactcataatactatgatagcgatcaagcgcttcggagatgagaattgacaaatatcagtctctctgatcaataccaattattggatagagaaatttacagaaggatagcagagtagcgaccggcaagagaagaggcatcaccagctccctgctcatgcgctcccaccgccgccttgcccctgtttgcaccgcagctcgcccttgctcatgcgctcccgccaccgtttcatccctgctcgcgccgccggctcgcccctgctcccgtcgccgcctcgcgcgctggccgccgattcgcccctgctcccgccgctaaccctagaacgtagtcgtgaggaggagctgaaaagagcgaagggaaaaaaaaagggatgcggtgaaacccgggatgggccatgagggttaccgcgcctcacacgcatgtggaggtgggatgaatctgtccgccagtttttggcggatgagttggtcccgaatattgaaggaatattcttttttggaaccatcctatcccatctagtctctcaaccaaacacatgtaaaaatgggatgatcccatcccatcccgggatatcccttcaaccaaacacatgctataggaatttgagcagttgtgttcatactttaatattcgaggcattaaagaagaaactgtacggtggaaattgtttccgttctctcttcaagagagcgcaatacaacagtacacatctaccatcaagtgcgcaaatggtgactggcccaagttgcgagaaatcatcatcttccagcagatgaataaagaatccatcggtgcagcttagtccagatttaataatttagtatgatctggtccaaccttgttcatacctgaatatgtgctattacaacattttcatgcaggtttagacaaggagtatgcattataccttgacaccattgtcggaggatcattcctgcataaaactccttcggaaggacaaataattctagatcgaattatggaaaatacttccttcatagagcaatataatgaatccctccctaaggcatcgatgcgtaaaattaaggaaccttcgatagctgaatctgagactgaaccgcctacatcaatagattcggctaaggagtcctcctccaaaccatcaccagcaaagagcaaagaaattcaaactctggaatgtgctataatgttcaggaatgatcttgatgaagattttggaaacacccagaattatttcagtaaaaagaaacctcctatggccttgccacctcctgatctaatcgaagatgaatatcttaaagaaatagtctgggagctgaccacagtcatgagcaacgaatggttaaaagaggcagagctttcttccgaagtaattcggaataattccactcctcgaaccatcccttgcaacttagaagggaatactgttggtattctatatagtccaacagtcggagtcaaccttgtctcagaatcattcacatttgcttatttgagtgacaaggccattactccgatgaacaaattcttcaaacacccgaataggaagttaattgaaggatttgggattgttcaagatgtatctgtccaatacaacgataaagaggccatcttggattttcatgtctttgaaatccaagactttgacgtcctaattgggcatctgatcaagaaacttctcatcaactgccctcgattaggtagcctaaaattctctttagtagggaacaaattctctatttcattttcacaatcaagatttgccttgactgattccctgcctgaagacgaatatgcaaaggaagtaacaactattattccttt

SEQ ID NO: 51207 - DNA, 1980 bp, Oryza sativa
gtgtctatcttttcggacatgatcgaatacattatggaggttttcatggatgacttctctgtctatggaaaaactttcggtcattgtctccaaaatttagacaaagtcttgcaacgatgcgaatagaaagacctagtgcttaaccgggaaaattgccatttcatggtccatgaagagattgtccttagacatcgtgtgcctgagagaggtatagaggtggatcaagctaagatagaggtgatagatcaacttccacctccggtgagtatcaagggaatccgtagcttcctcggtcatgctggtttctatagaaggttcattaaggacttttctacaattggcagacctctgaccaacctgttagttaaggatgtgccctttgagtttaacgacgagtgccttaattcctttgaaatcctcaaaaaggcacccgtttctgccccaatcatccaacctcctgatgggacactcccattcgagattatgtgtgatgcccgtgattttcctgttggtgcggttttaggccaaaccaaagagaagaaacataatgcaatctgttatgctaacaaaatcttgacaggagcttatggctgttatttttgctatagatatgtttaggtcttgctaggtgttaaggtaattctctatactgatcatgctaccttaaaatatttgctcaccaagacagatgctaaaccccgtcttttaagatggatccttctgctccaggaatttgacttagaaataacgacaaaaagggagtagaaaattccgtagcagatcatttgtcgaggttgcaaatcactaatgtgcaggaaccactaataaatgatttcgtactagatgacaagctgatgattgtgaacaactccaacccgtgttacgcgaatattgtgaactacatggtatcaagatatgtaccactgagagagaacagaaggaaattaaagtatgaaagtcgtcaccacatatgggacgagccatatttatatagagtctgcttagatggactactaaggaggtatgtgccaaccgaggaaggacttaatatcgtagagagatgacgatcagcaccttatagtgggcactacggtgcattccacacacaagccaagatttggcagagcggattctttttgccaccaatgtatgaggcctctaaagagtttgttagatgcttccagagttgccaaaggcaaggaggcatcactttagatttgcaaaatcacttctcgccctctcctcctcctcctcccttttcctctcgttctcctccatagttctcaacagaagatcttgcttccattcatgcgccatggtttttatgggtgttttaagttgtgacgtaagagacaaaatcgaccactccctctccaaactcacttaaccagaagaagacaagttgcccttttcgtggaatattgatccaaaaaacagtttccaatccttctctggaattttacaacccaacccatgaaaatttttggggcggaaggctcttataccagattgtcagctactcgctagtcaaattggagaaaagaggaagaacaggacaattacacacacacaaacacacacacacacatgatttaggcaactatttagtacatatattgctccaatccattaggtttgagctgccgccgccatcgccaccgagttgccaagcccaagttcttcgagcagagtactctgttcttgtattacaaatctcaccaactctccttctctctcacgcaagttcaagctaatgcaagactgtattggatctattacaaggcccatttcggcccacaatacttgatgttcgtcgcggtagcgccagtgccatctctgagtcttcctgtacatcatccggcaggttatgctcttcagtctccagcccttcttcttcagtagttctttggcactccttgctcaccagccgccctgacaaaatgttgctgtcgatgttcaagtttattgccatatcacaac

SEQ ID NO: 51208 - DNA, 1916 bp, Oryza sativa
ttcgcaggtgcataataagattggtaggtgtaaattaaagatgagaggatcaatctgacaagcattggaacacatacatcaaatacatttttttacttatagtgtcatataactgattctcaagcctcaatgtacagtgctatatgtgagatgatcgaagatgtcagagtgttcactagtacaaaactacatatctgtgacagcctatcccgtgtttggtctttcgcactgtcacaacgtcgtcatctttaataggctgaaataaataccgacacagatatacccgtacagacatattccatgagcatctattgcgagcccgtcaccgatgagacctattgatgacgggcttatgtttcggctcatggaataggtccgtcactgataggtctcatctgtgatgggccctaacttaggcccgatgaagatggttgtttagccccgtcaccaatgtgtgtcattggtgacaggctcagttttaggtccgatagagatcactataaaactcgtcacaaatgttcattgtcattgtcatgtttacgatagcagagatatgcgcattgtcattttttcaaacatagttatatgcatgctaatgtacttatgaatacatggaaaatccaaacaagccaaataaattccattgcagatgagtaccggagcactgtccattaaatttattctaagtttacaaatttgggtctgttagatgtaatcagcttatatagttaattgaaccattttatttaatttgttataaattctaatagatttataggtgggctgcttcaagcaaaagcttaaagttgataaggaaacacagctaatacaactaattcaattaattataacttaacaatcccctcatatacatgtttgaggtttcccttaggccttgtttggttgggccattcccggccgggatcggggcccaatccccgtggatcaccctggcgaggaaacaatctcggcccatccgaaattgtgtgttcggttaagcccagtatgggttttaccctggcctatcccggcctttccccctcacctaggcccgggaaaaaatcagcttctcgtgtggcgtggaaaaattcctcacgacgggagccgggaggcgacgtgcaacacgcgcagtggcagcacgacgcggaggcaattcgaggtggcacaacggcgggagcggcgcgacgcgaggcgacggtgacggcacggcgctctcctccggccaccattttctttctagtgagcacgcagccttttcccttctctcctcctcttccaaagctagggttagggttttcttcttttctccctttcccttcgtcgccgcaattggtcatcgtcctcctcatatcctgctcgatctggtgagtgcttgatttgggtgaggattagtgagttcttgatcagatggggaatgagctttttttcttggttgggtggggatgagttattgattcgccgctgccgtcacacgtcctaaaccatctcattagttcttgatttgggtgtggtgtgttcttgattgctgcatttcccgctctactagaaaaatgatttttagcgatgttagccttttatttttccaggcgggtatgactctcgaagccaaatatctgcctataaaaatataaaccagggtgggttttcatcatccacctacgaaaatcaatttttgcaggtggaccacttaagtcgtcattcgtcggcgctcgaaaaacaatttttacaagtggtccgcctacaaaaattatatttttacaggcgaaaaaatacgtggtccgcctagaaaaatcgttctataaaatcttcttccttatctactcttacagcccccatccttatcttctcatccaccctccccccaccactcatttccccctctcctctctccctatcctctatctccctcgcgcgca

SEQ ID NO: 51209 - DNA, 2721 bp, Oryza sativa
ggtctcggggaggggagggaagtggaggggagggaagtcggcgacgaggagaggagacgcgacgatgacggcgccgaggacgacgacgacgatggcgacgacgcgacgacgacgacgacgacgacgacggcgacgacgcgagtacgacgacgactgctgcgatgacggcgctgacgcgacgacgacgacggcgccacctatggaggccggcggatggacgacaacggcgttttttttaagtttacatgttgattgatgttgattgatgttagcttgcaagttgatgatgttgatttatgatttgaaacctaggatgggtggggtgggctggcgggaaatttttttgttgcgcggtgaatgtagcgcctgcaaagaatgaactgctgcatgcgagaattatttttgcaggcggtgctttggtccatctaaaaaaattaaggatttttacagtcgtttaggtacctgcggaaggtttgtccgcctacgaaaacgtgttttgaccgcctggaaaaacatttcttctagtagtgcggtgagttcttactcgtggtgaataagatcagagctgcgaatgcgaaggttgtccatggcagtacagaatgtaataactctctggaggtgaagatggcaactcggaccttaaacgtatgatttctctgacataaaagatgcaactaataatttctcatgtgaaagtttgcttgaaaaatgtggttttggatctgtctacaaagtaagttcagatttcaaaatcacactctattaccattagctagcaagcaagtgtttagtgttgtcaaggctaaattgtactcccacacgttctaatttctagagagagaaactagaaaaaggttgaggtggtcatccttttctacattcatcatatatctgttatacacttagtctgaaactttgtgcattataatgttcactggttttatttttatgggattgaatgtacaacaagaaatggattgttgcattagttcagttcaacatgttttcataagattatactacatgtcatctccaacatgtttaagaatgctgaaagttgacaagatattaatttttgcgatgtgaatataataatccctctgccaatttgtttttgtctaaagtgttattatgaatattaatcatgcatgatgaaaatgatcatttacaactagcttatatgctatttttagaagaaaaaaatcattttttgtttgtgtggcatggcaaaaggcaatgcttgcataagttcctcgaagtactgtagattaaagttaatggtatttgtgtataccaatgtcaccatatggatgcatgggggaataggagcatgttgcttaatttctggatcaatgttctgaacatggttaaacttcagaaaattgcaagtaaactatattagataatgcttaatttttagttgttataatatacctctctttggggttacccacaagtagttgtcaatttatggaattttaaattccatatacatatcctcaatcagctctactatggtcttacataattcttcgtaattctcctatgatgacagttggagaagatgctgatgatggtgtaaattatggaactggaaggctgtaaggatctttttgttgcaggggcggtgaaggatcaattatgcatttgcacttcacttctttcaataggcctaaaatatttattaagcatagactgtagaagctaggactgtttggactgaaaagaaaaagtgacatttgatgttcattggagattacagtaattactccgctgagtatattttgtttgtacgataagatattatcaaattccgttgctatgtttgatgcttcctccgtttgatgctctgaagttgatgcatataaactgccaagctaactcaatagcagcgttgaagtagcaaagcaccaatcctgctattgttgatcttgatcaaaccgaacacatggatttgagagggggattagtgggtagggagggattcatccccaacagagattgagtgacatgacagggcttcactcaatccctccctggattgattccccttggggattaaatccctagtaaccgaacaaggccttatggagcgttgtatcgatgtggattgttattttctatagttatatactatatatatatacacacacacacacacacatatatatatatacatatacatatatatatatatatatatatatatatatatatatatatatatatatatagaaaaactattctacacccagggtatagaataggcccccctccctccaacccaccttccctccctgcagggggcaaaacccactccacacctcagtcaaagctcccccacctcggtcaaacccgcccttcattttctccaccacctccactcttctcaactctcgtctcagaacaacgtagtaacgcgatgttcatcgtgcagtaacaccatgtcttacgtgcagtaacaatattgaaatatagtcataatatagtcatgacggatctacttttgataagcacttttttctaacatcatggtccaaacggtttttaaaagtagtacatgatgtgagagatactaccctttaaagattggttttttataaatttgactctccacgaggagtaattctatatcataagtatcactgctgatctgctatgcgttactgcaatcacataatatcgttactacaagatgtagtaacgactgtaagtttcata

SEQ ID NO: 51210 - DNA, 1861 bp, Oryza sativa
aaatggattcagacaatctgtaggcctattagaactgagagcagaaaaaccaagaaagataaaagagggaaattcacaactcccatatctgcgtggagacgatggccagaaacctgatcccggtgttaacacgatgtggggcagcaggccgccagcatgggtagcgtggggtcgacgcggacggcggtggaggcagcgacagcggcggcggcagcgcgtggacgaaggatcggcggcgtgcgcagcgtggggtcggtgcggacggaggttgtggcgtcgtcgcggatggaggtggtggtggcgacgtcttcccggccgcggagggggcggcgtcgcggacggaggggccaagagaggagagcgcgaggaatgggccggtctgcagcgggacgacggcgcccctcccctccgctcccatgctctgcttgcgactcgcgatatggggatcggagcggaggcggcgatgcgggtgacggcgccggtctacagcagcctggaaggggtggcggccttgcgggatttgagcggagatcgcgggcgcggcaattagggcagcgatgcggttaggggagggagggaggaaggtgagacggcgcgcgggttgcgggatgagggggagatcgatgtgcgtggggctgggggatgcagaggtgaggaggtggagatgatctgatgcgttggattctacacggatgatctgaacccttgagtgttgaatgaaagaatgaaagaatgagtgaaactatttgttaaactatagggtatatatacgagctgtctagggttgtgaaagtaatcgtacgccttagacctattaccacccatatataactgcatcaacgaaaacatgatgtagaggtgattttcgaattacctctaaaatcgtgagttctatactacagagacaattctagagccactttaaagattgattagacaacttcaaccctagatactttagagacaatttcaatatattttattgaattttatattgtagaatattcttttagtaaacaatcattagtacataaccttccatccatgacggcctctcacatgccgaaaaagcgggccgtcacaaagaagtcacctcaatcgggccgaaaaagcgtccgattgatatatggtcgcatagacacgttagataggcataaaactcaggcccgtcactaataacacctatccgtgacaggccgtagtttaggcccgattgagatatgaaatcatatctcaatcgggcctcaagttagcgcccgtcacggttaactcctatccgtgatgggtcttagtttaggcccgattgagataacattccatatctcaatcagacctcaagttgacgcccttcatggatgaccatcatccgtgatgagcaccaacttggggcccaattgagataacaactaggcccgtcacagatgactcatccgtgacctattgagataataactaatgcccgattgagatgacttagtatttttcaacttttcatatgaaatgtttatatttgtgagttgaccagtagcaaaagaattaactgcagtataataacattttattagtcaaaataattttttgggtagtaaatgatttcaaatggaaaaattttcaacaacaaagttgtataacttatcaagatttacaacttttattttggtcatttttctatataacttgaatttgaatttgaaaatatgacaacttcaaacaacattttcaaatactaaatgatttcaaatgaaaaaattgtcaacaacaaagttgtataacttatcaagatctataacttttattgttgtcatttcttcatccgacaaagtgttagtaacattgttcacacaatttacatatatctgtt

SEQ ID NO: 51211 - DNA, 2173 bp, Oryza sativa
aataaatcatccgaagaaatgatttaatttaacctacgaggtgaatccttaattaaataaatgcatttaataatcagaatcggcatgggaaatttctcttggattctacatgtcaaaatatgctaataggattttcagtggaattttcagagccttggaaataattttaaccaattaaaataagcaaagtgcaatatttaatccttgggaaattccttttctttttctctttttcttttcctcatttttctatcttgttgggccgtcggcccctcacctcccgcgtccaccccttccttaccgggtcggcccgttttccctcctcctcccgaagtccaggctacctccccctcactccctcgggcactgataggtggggcccacctgtcagccctttccccaacctccagccgctcccccgagccggcaaccgccgccgcgcgcacgccgcccaccttccccgccttccccgcgtcccgctccagcacgccccgccttccccgcacccatgcccccacttccgctcgcgcccacggcacgagatggccgggattcaaatttgaatcccgcctctctctctctcctcctccaacttccccactaactccgacgaaatcgaaccactcccggccgttcccgacctctccgcccctatataatccatccccacatcctcctcctcatttttccttgttccgccgacctctcccgagctctccaccgctcccgcaccgtgcacccatccgctgcggtctcttccactactccggtcgcctctagccgccgctagggccaccgccgcaccacaccgtcgccgccgtcaggtttgcgcggccaaggtccacctcgtccacccctcctccgtcgaattccgccatcgaaggccgccatccgccgcgcgccggtgagcctttccataggtcaccctagtctagtctaatgaaattaattagtccaggtgggtggttgggcctgttgcaacgtggtgtagcgttggacagtggatggttaatattgattaattattacaactgtttactgctttcaactactgtttataaatgctcaatttatgcaaatgaaccgctttagctatcctttggttatatcctgcatcataccccctgttccggtatgacttgctgagtacggtggttgtactcagtcttgctctattttccccaaaaccccagagtttgagtatgcgtcggatggtgacttttccgaggagtaggcttcgtccgtgccgtcgaggatgcctgtggagtggtgttcccactgcaatccaagtcaaggcttagctccatttatcttttaattttccgctgcatttatgtaagacttttataatgtttttaagacgtggatctgtatgtcaactttgtcgtttgtgtaccccgggcggtcctggacgagggttttaatgcacattctgcatggaattctattcgggaatttctgggcgtgacacttccccaccgcgccattgttggcgactgttaaagcccattgtataccgctaacatctgcataaagttcacataataaaacatccaacatactgataggtgcttaatctcacatattccagaagtgttggtgtatatttgtatgcaggtgataaaccctgaatttggtttctcattcagggagtgcgaactcccagcggtgggtatggtaagggcttgctccggcctttgacggcgttggagaaggaggggacagcggaatcccatagccctccacctatgaaggtgaagcgtcacttgacgcaccctccaattgtaagggcggccggccaatttcaaggagatgaagtaaagtcgccggagccctcggttcataagctagcatcgcaagtaaagaagctccgcaaggagaacattgagcttagggaccgaaatgcggagctaggggtagaactttttgaacttaggaataatgttgatacccttagtcacggtttttgcgctaaaatcaagcgtgcatttgtagaaatggggaaggagaataagtattatgctaattagatgtctcctctcccatgaataaagtagtagtaggtgcttggtttttatcttttccaattatgtaagaacttgctataaataatttggctcattggtgttaaccccaatgcatgctaagtttgtttttgtttttttctaataaa

SEQ ID NO: 51212 - DNA, 6821 bp, Oryza sativa
aaattcttcatatggttgatattgtatattcattattctcagctgaacttgtgcttgtgaacaaccatccatgtttagggaaccttatgcatctaagtaattgctttatttgagatgattaaagatgaaaggaattcttgcaacttctgttatgactcttgggagtttgttttcaaaaataaaattgttttaagaagctcattcctccaattgacttcattttatacctaccaaggccatatgcaagtatatcattgataaaccttattatgcatatgattgcttgacattatattgagttttgtcaaatttatgtgactcgtgttagatatctttcatactctcatgatcaaggggtcatttccatttttgtttccacatatataatacaactaagcttctacactggaagttggcttcccacaaaaatttccatccaaataaactcctacattaaactatgctttcttctcctcgaaaagttcttggtaaaagaaaatgagaaaaggagggaaaggcatgactataagaaaaaaaagagaaaaggaaataaagcttgctctcaaaacattgagcatgatgaaaagaaaatatagccatgccccttccatattcatgccaagaaaacaaaaatggaggagaaagtatagggaaaagggagaatcatttctttattccaccattccacaaaatattttacttttctatgttctaccacaaataaagactcttgatctaggagtatgactgatgatcttcttgagtccgtatttttggctttgcaatatatatgatgcaggtatgtcacaatttgtccctaccgaactccacatatcagccttagaataggggtaaattctggcacattttgccttggtgaagatccaaaaagaaaatatatattcttgagagataagagagaaagtcaatatgaggaaaagagctggtttgcgaaaattcattaaaatcccataagtctgacagagaagcaagaaggactggaatcgaggtcattccatctatcaattgcttaagatggtaagatagccactaataaggttcacaggtgcaagtatggttgtgaatgatttatattcctgatttatatcttgaagaaattcattctacaataacctttactcaaggacgagcaaagagctaagtgtgggggcttttgttggcgactgttaaatgccgattctatactgccaacatctgcataaagttcagataataaaacatccaacatagtgataggtgcttaattaatctcacatattccacaagtgttagtgtatatttgtatgcaggtgataaaccctgaggttaggagaaaatttagagtaaagtgaggagaattatgtatccatacaaggatgggttgtgaacttcatcaaaacactagagaatcagccaaaaataccaaagaatggatagaggaggaccaggggaggacatgggccaaagccaaggccagatgggcccagcccaggtttggtcgaaccaccatcctcaccgtttgatgtggggtttggcgtggatgtcccagatgcatccttgatgacggttggagggcactttggaaatttccccttcaccaaccgtcacacctacctctatgtaaagacatcactccctcacttcactcacacacttccaagcttgagctgaattatatgaggctctattggactatattgtatactagaataggaagagagtagagtagaagaagtcagaagaatttcggagttgtcggtaatcttctctcatttcttttattctgtttttactctgaattcaatataatattcttcctcagtaatttagatttatctcgtgagaattatctcttggttagttcgtaaatagcatacgggatcattgttcactatagtccatttatttatagtgattgctttagtttttgatttgcactagagtagttattaattgcgtagacgcagtgtctaggtaattaatttccagtggttgctgcgtatcccgcagtacgtttgaggtaggtatagaggtggtgacagccctcaagagcacttaagtcctccctgtccgggtatgtagtagagcgacatatgggaacaacggattgccagtgcttgtagtattgcattaggattaaagttaagctttccctaggcactatttctcagtagtaaatcctctctgtcctggcctatcatatgcttggtgtccttggatgaaccggaggaagatctgaccacacacgttctcttggattcgatacccattggaatactccgtaggggaagtgctacatcggtatatccgtgcgcttgcggattctatctatgattgtaagaattacgaatagccatctgcctccatggcggacagcagatgcggcatcaggaagaggacgcgaaggacgagaggtcgttctcgcgtcagccgtgcccgccgcagcaccctcccgaccgcccgccacgctcgcctcccctcccagccacgccccctccatggcacctcctccacgccacccgccggtgtctggagcccacctaccagtccccttcctcgttgcgcccgcccccgcttgcttggcacgcctgacgacgtgccgccgcccaccgcccgcctcgcgggccgccgtgcgcaccaaccgctcgcacggccgcgcctgatgacgcgcgagagagagagagacggaatgaggggaagaggaaaaggaggaggtgggagagaataataggtgggccccaccatgtttttttaaaaaaaaatgctgactgggttgccttttaggacaaaacggccctggattggatcgaggggggtaattcgttcggtattgaaagttgagggtgagtaatgtttggcttttcgagtttaggggggaaattcgtacttttttcatagcaaaattgttttggtatagggtaccggttgctagtattggtgccggttgggaaccggctccggcacctatgatggtttttttacttgtgtgcatatatattgtatcaatgttgttaatatttttcctttttttacaagtatttcaatgtatttgagacaaatgagatataacatccttgaggttttaaaacagtttcgcgcgccattgaagaaaaatcaaggaattaatggaaccgacagtaacaagcatgcacgtgtacgtgttaccgtgaacagtgaccggagcgtgtcacggtccagcccggccgagtcattgtcccgcgccgcgacgtcgagaagcacgtcgaggaagtcacccttcctggcctcgccggcgtcgcgctcgctcagcctctcctccaccaccgcgtcgaacacccggtggagccgcgcaaacaggccggccatccgccgccgccatccctgcaggtccgccgcggcgatcgccgggaagaagtccgacacgttcgggcaaccgccggcctccatgatctccacgaccacctccttgaactccatggactcgccgtggtcgtccaggctggtgaggttgcgggagaagatcgtgctcgagaggaggttcaggctcgtcgcgaacgcgacacggccgacgtccaccgccgccgcgccgccctcgcgctccgccagccgggcgacgtggtccacgagctcctgcaccttctcgcgccggagacgccggagcgcgtcgagccggtgcggcgcgaacagctccgccgccatgatcctgcggagcgcgcgccaccgaggcgagttgggcagccaggcgacggagttcgtggcgtggtcaccggtggcgtcggggacggaccggctggcgaaggcggcgttgtgcctctgcaggaactcgcgggcaacgtccggcgaggagacgaccaccgtggtgaccgcgccgaggcggagcgacatgagcgggccgtacatcttggcgaggccggcgagcgagcggtgtggctggtcgccgagcaggtgcaggctgccgatgagcggcagcgggcggggtcccggcgggaggaggcggcgggagtgtgcaaggaggtcgaggaggtagacggagaggagagcggcgagaagccatggcagccatggaagaaaagaagccatttgttattatttttggttggtggggtgacacacaatgccggccgttttatgtatgtatgcggcctcgcgagggtgagagcttgttgtatttttccaaattatgtacatcattcactaccagtagctgtccaagtgattctccctgtgaaatagctgtcaaagtcgatgtcgacgtgtgctgaatggaacgttcgggaacgtatatattctagtggattttttttcctatttattactgatcacaaaaaagattaattatccattttttccggatataaagatataagtggtgaagttaatttggatctgtttttaatattcgaatttaatccaccaccacatttttttacatcactattgtacagtcaacatataatatactagacttgcgtacccacgaataagcccataacatacgctcataggaccgccacttttgtaacaattacatgacacatgcgtgttcatcattaatcatataacgttatacttacacacccacgaatatgccccattacactactacaaaacacctaataggtgctggtttaacaactatttaccatttcctatctccacgagacgacaaatctagatgaaaactgtgctaaactgggcctaactaaagcgtaaagaacctctagatttagccccgtcaataataatacatttattttcgcatggaaataatatgaaaacactattaaaattaatttcctagctgtgcgccctctccctcacttttcctccacttctctccctctctctctcacttttcctccctccctatccctctactggacacaacagcagcgccgaccacaaccagcgatgacgaaagggccagccacaaccggcactggcgacggaggaggcggggcgcgcgacccctcaccctccctctctctctccggcagagaggaggggcagcggcggtggcgtggccatagagggaggttgccgatggcgtgcggaggaggcaacatggcccccccttcctctcccatatttggctcccctcccctcccagatctggcagagaggaggggtggcggtggttgcctgagaggagggtggcagcggtgcggctcccctcctctccctctccctcttgcctcccagatccaactgaggggaggggcggcggtggcagctcggctagaggggggaggagggagggaggtgttgccgggggctccggcgatggcggtggcagcggcggcacccacccatggcgcagcttccctccctcccttttggatctctccctcctagatccgaccagtagggggagggggatggagggcggttgcggcggcagcggctcccaacggctctcctcacctcccctctctccctctccctgccaaaaccctaaccctagatccggacagaggtacgagggctacggcggcggcgcagccggagacggtagggcgagcacgggtggggttggtggtgatttttttttgttcgcccaaaatattttcgctggcgtctcgctatagcgcctccaaaaatgaaaatgccttctacgaaattgatttttacaagtctttgcatattggcgtgtctttccctccctggaaaaataattttttgtcgactgggacaacgattttcctagttgtgggagggtggccggctcgttgcaacctcgagctctcaacgctgggctggagcaggttgttggccgctgtggcggctgttgccgggactgtggggcggtggctgttgctggcattgtccaggcaaaagcagagaaacagccagcagatggagcaacagctgtaactacaaccgctgtgtttttttcacataatatctttcaaacggatgttaaaccattgaatgcttcactgagcttttttcaattttcgttttatataaggtaaattttgctacatgacatcgtgactttgcggttttagttgtaggacaccgtgcgaagtgacttttggggaaagacactggcaaaaattggatatttgctggtgaacaccgcacccattaaaataataattttcggtcgaagaggagaaagaaatcaggtaaaagttctaaaatacacttggacccgctctctcatctcttttctctccatccccgcaccccttcctcccctgcgttggccatgtcagcggcgcctcgcccttggtgcggattatggcggcgccttcgcggatgcggcggagcgcctcgccaaggtcgcggcagccgcagacgaagaggacgcggaagttgtgcctcgccgatggcctccaagatccgggcctccacaaagtgctcaatgcgggccttggccatgactgggatggtgacgacgcacttgatgtcgtggatgagcaccgggtcggacatgtgggcgacgctgcctgcgcgcggatgtcggcgaggatgcgcttccagcgccatgaccgcgcaggtgccatgccagcctcctcggcgaggcgtgcctgctcgggtgtgacggcgcttgccgccattggaggaagcccctcctgtggattttgcctgtggcgaaatgaatggaaccgccttggcggcgccattccccaccaagaatgtgcggccaggtggttgctgaccccaggacgacaatgggcgcggtcgtggtggcggactgcaatgggtgccggaatggtctcgggccggcgtggtcaggccggcaaaggacgacggcggacgcgattcgcgcaaggacggcgtgggtaggccgacgctggtagggcttggtcatcggtatgtccttggtgtgcagc

SEQ ID NO: 51213 - DNA, 799 bp, Oryza sativa
gggcaaacgaaagaggaggagtagggggtcctatttatagccatgggaggccgggatagagcccacaaagacgggaaaatctcaggaaagtttagatattcgcgggaaaaaggaaaggttgaaccgcgaaattggaaaggatttccatataaacttttggggatttcttggggacaaggaagaggagattgagaggattccattcccgcaaccaattcggaaaaaggagcaacgatgaggttggattttggaaggggatcggcggcaacaggcacggcacggctcggctatggctctggctctgtccagagctggaagatgaacagtagcgcagggagagaaagtagacttctttccgggcttttcttttctcagcctgattagaagagggagcaaaacaggactttggctgagagaagaagagaggatgcaggctcgggttgggccggcggaagagagaggaaggaaaggaatgggccgattcagcctaagacaagggaggagaattttattactttcccaattaaaataatcacttaaatgatctttgaattgttaaaaatacttccaatgctcaaataatttcaagaaaaatcctgaaaatacttggacactcaaagtacttaacaaaattacaattagaccatttaatgattagtttaatatgtgggtaattactgaaatgctctttgtatgattaaaaattacgaattgagctccgaaaaatcccagaatattccagagagtataattaaccatggagaatttaataaaaattaaatccatccatgctttatat

SEQ ID NO: 51214 - DNA, 6668 bp, Oryza sativa
  unsure (1)..(6668): unsure at all n locations
aagcaaacacaaggcataaacaacgattggagcattttttttcttttttcacattggttttatgtggttatttaaggattggcaatagtaagggaaaacattttttttctttcacataggttttatatggttgaggtaaactttaatgcctcaactcttttatagacatgaaaaagcctctattaaaatgccacaagacatattgatactttataaattatgtcgacatttgatgttgcgattcaagtatttgcatagtatggtgatcgttggtactaggatatatgcaagattgtaataaaagagatggggacgaggatttttatataggttcggggccctgaattgtcaggtaaaaaccctactcctattggccgaagccagtcattgctcttattcaccataatcacacctgtacaatatttggggtagcctatctaactgttgtcgacttggcggtctaaagtgctgactcgtagtcgacaacagggtagccttcctcctcgaatccgtatccggtgagatcaaagacagcgctatgtctctcctgacagtatccgtaaacactgtagggggctagccatgcttatctcttaagtcgatatccggcgtcttatcttggcgtatgttagcttgtatattgatcttgtgtcttgatctattgttccttgtcccctctcctcctagggggccttctatttatacccataggtgtccccttgtccaagtagaactagggaaaccaatatcgatacaatctgagtagtccttgtcatttccatgtagaaccctatttatctttccttatgcggaactcctcctatatccaaaggttgtttccgtataagacatggtatgtggtgggtcctgccgagatttagtcaactactattaggtatgtggtatccataaccctgacagtagcccccgacttcaatgcaaatgaacgagttcatattctcaatccgaagacctcggaatgactgttgtcgagctcacgtgaccgttcttggtgagttcagagataacattagactttctttagcagcctcatgtgggcaccgtatatggtttgtttgagtcaatctccgacgtcaaccaagaaggtacagagcatatgactaaatctcccgtcttgctgcaatcgagaatttggattgaagtcaaaaaattttatctcggcgggtacaccatcttttcattccgtattccttgtcgagatcctccaaccgttctcaaatggtcgagaaggtgcagagtctgcgacgaagccttgtcaacatttgtcgtactcgccttagtcgatcttggtgttgaaccatagagacatggagttttcgacaatgtcgaatagaattttcctgaaatcaatactcagaaaagaatattagatagaaataacccccgagcgaatgctcaaatggtgacatgttataatatccatggaaaactaaaaatgaattaaatttacagaccaatgtttcatgtacgagcatcctcttttttaccgacttcgatcagtcagtttgttaagtcatacactctcccaagcccccgtcttgtcatcggagataagttctcggaggagaaggctcttggacccttgacctgccttggttgaaaaaacgcttaccctagcccccagccgtgaagttggaaaacccaatttccgattacacggcttggttaatacgtacggtgagaactcttacatgaccagatcttacatggtcgtgaggaaacgaagtttagcagtgtgcctatggatagagaccggagatgtaattcatttgcattattaaaaaaagtagaggaaacggagaagaacataggtttgacgtggggaggaggaggacttgatttggggataaatgttttgagtttgtatattacattcattgcgttgcaatgctggcctttgccaatttatagacgcacaccaactccctcttacgccaccctatcaggcacaatgcagcgaacattgggccgcgactccctgatgggcctctttcctttagtcgttggttgctgccgatcctaaggcataaccggataacattctcccctccatcacagatggcttgtcccgcagtcgaaaaaccgagagcacagcagctatatggttgatttcttttcctaactttccaactagcattcctcttttttcctgcgcctgtttttccaactgctaaacagtgtatttttttttcaaaattttctataggaaagttccttaaaaaattcatattaatcaatttttcaaaacaaaaagctaatacttaactaatcttgccttaatacttaactaatcctgtgttaataagttactctctgttttacatgagggagggattagttccgccagatctagcnagctatcctctgcaaccggccgcccttgccggcgaaccttcacttgcttgattgccgctgcaccacgactaatcagttcgttgttcaccacctgccttggaatcggttatggttcatctttaacaggagggagagctgcagtgataagattagcaggtctcaacgcaattgtgtgacatggaccacgcggtgaatggtgcacaatcgaaaattccagacgatacgccacctgccccactattaataagagtaaattgcactggcggtacttaaacttataagacgaacttgcaaagcatcactggtggagaaaccgtttgtagtactggttcgtaacccgcctttagtcccggttgtccaaccgggactacgaatccccgggtgaaataaccgggactaaagatcgatctttagtcccggttcatgttaccaaccgggattaaagaacggtcagccacgtggccggccgaaccatctttagtcccggtttgtgttaccaaccgggactaaagatcggtgtaccattttttttattttgcatggccctatttgctgcaaggttgaatatatatataaatatatatatatatatatatttatatgtatattatgcatatatatatatgtgtgtatgtataaaaacatatattacacacatatgtataatttaaagcacttaacattttatatgcatatatattaccaaaatatatattaacactaaagtaaatgtgtacatatataaatatatatatacatgcatatatagtacaattcatttgctcgctagctatagctacgactttgacgccggcattatgtcagaagaggaaggaccgacgttatgaattgtcgatccatcgtagtagaatacaccatcaggatttaggacttcttcgttgatgaatcccatcagttgttcttgaacagccgtgataaaatccttgtatgggagattatccttcatatcaatatgctatcattcgaaaaataatgacatatcaatatatgaaattaataaacaacttaacaaattgatacgcaatgaaattttgaatggtttatgtatacgtacatcgagctctcgtgtggtgtatatttggtttgataggcagtgggcatactcgcatacgtagtagccgcataagttagttctctggtcctgctttgcacactacatgagaaacgatgagagatttaatataatctttatatttaactgtaattagagatttaattaaatacaattttggatcatgcatatactcaccggaaaatgaaacctccgtccaagtttttctttccaagtcatgcggaccaattgacggaaccgatcccaagccctacatgtgcagttgcaagctacgattaattaattattacccgagatcaacataatagcaatagaatccccgcgactttggaatagatggaattatattacctgtctatcagttggaagaccttgtcaaaaatcttctcctctttattcattgagtcgtacacagtgactctgcatgcgtccaagtcgaagaataacaggacccagtggaatctggaatatgcgtgagatgagatatatatgaaaatgtacatgctatatgtatgggaacgaaatttgttcgaatgacaataaaaactcactctgtgttgtacggcagtagtatgaacgtcttgaaatgttgctgcgttaggagatggacgagattgtcctccgtgtctttctcgtacttgtcgatcatttcggtgttgattttccgagggtcgatgaacccagtatcgtaaaccccccgccgtcgggccctttgaatctccattctacaatgataaaatgaaattattattgtttacatatatgacaggagctagttattgaacgaaacaaatcgaactcaaagatacttacaaaatccatgcgctcaaaagagagacgtcgagggcgtccagatggtacagatcgaagacatccttgaaatggagccagagaacatcttctccttgcaagaagtcggggtttctgatcctcactccgaacatctctctacccttggcgctcatttccatgtaccattcatggaatttgtacatctgtgtcggtagggactgcagctactcaggcgagacaagcggtttaccgagttcaaacttgtatgccactttcgccttcgggattggtgcggctccaatcagctgatccatagttagaccggtatctgaaatgaaatccgttattccaaaattttctccggtcaccaacggctcgacctcttggtttgtttgttctccaagctgaaggactggtttggacttcttgtgataggctttctgaagtgttcggtcatagtctgatatcttaaaggcctccttgtttgctatggacattcccttgaagaagttcttcacgctcgggtcaataggtatcttcttttcaggactccgaggcttgagttgtctcttcacttctcctaccatataagcatcaagctcctcttgactgcaatcgtacggcggctccttgtttgtggtggcgtcaactttcgccttcttcgttgcccttgtgcgggcaggcggtagagcttggcgagaccttgtcttgggaagtgcaggcggacacggtggaggtggaggaggcggaggagccgaggagccggaggagatggtgcaggaggaggtggcggaggagacggaggagatggtgcagggggacgtggcggaggaaccggaagatatgatgcaggaggagatggcggagccggaggagatggtgcacgagatgtcgcttgtcgcctagggaggatgttgtaccgcttgcgccatagtataatggcgtggtttgtgtctcgtagatgcgtctcaccgtctcctcctgggtagtccaactcgaggtcctcgtacgtggcctccaccagctcaacttcgaccctcgagtatcctgctggaatcggcctgcagtggtaagtccctgaaatgtccgttgggatggccattccggatgtcaccttcacgtgatgagagcttatctattagtaatcaacctaagcagcaacttgtggaatgtacaagtcaaaaaatcataaaactacgagaatgccacctcctcttgcatgctgagctcgtagctcgataccctgtactcaagatctacaatcttctcctcggtatctctcttgctcctctgccgactcctgtacgtgtggatgtcctccttgaatccaatcttccagggaatcacgcctttccctcatgttcgtcctagatgctcgggagactgtagggcgagtgacagctcgtccttctcttgtctggtcggaatgtgccctgagaagaggcttccactgcgtccgttagtcgactggcagcctcgcgtatcttatcgctaaagacaagggagccatcaattgggttaagcgttccaccgtgagcatagtaccagaacttcgatcgatccggccatttagcggtggccggatcgatacccctctcaatcaatcttgcctccatctcctcccacttcggcattgcgacgctatatccgcctgaccccaagtggtgatggtacttcttcttggcggcattttctttgtttctggccatcatcgcttgcccttgatgccctgtcttgtaagcaacgaactcgtcccaatgatctcttagttttgggaatacgtcgaagttcggtgttagtcccttccaaaatgtatttcttgtaaagatctcccttgaagctctggaactgttctaccattttcttcagagtccactatttcactatgttttccggaaccgcgggtagcgtgaacgtttcgagcattgttgtccacaacatctctttctctgattctgggacaaagttgtcattatccccatgtgcccttgttctgcgccagtacaccgtgctggcaggcacgttgtccctcacaacgcaactgctgtggcgtacaaaattcttggctgcttctgccggggcaataggtcgtccgtcttcgtccacctcagttatgatgtgccgaccgtctatcttcttcgcggaacctcgttgtccacgtgccctcttctgtccagcggaaggatgacttccactagcctcctcctcgttcccctcctcattcccctcggcatccctctccacgttcccctccttgttcaagtactggtttggatcctcgttcccctcttcttcgttccagtactggcagcttccctctgcgattgtatcgtacagtatctgttcctcatcgcgatcagccatctgtgcatacaaaaaatatttgttaggtctataggtcatattc

SEQ ID NO: 51215 - DNA, 1621 bp, Oryza sativa
aataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaatgcaaattggccataacaaaggaacagattcacaccacccagtgacattcaaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaacgtaaataaacatgtagatcataatgttagatgaattatgagacttgaacggcctcattctgacttcaaataaatttattatgaattttacaagattaaatctatttaaagcccatttaaaaagaattaaataaatttaattcaatttatggataattttaatatgtagatctttattttatacaacttttgcatcttgaaccacattaaactgagctaagatgaattagttatgaatttttaaagattaaatcggattaaaacacttatatggattttaattgaattatgacgcaataatgaattatttttgaaaaggaaaaggaggattattgcgtcagcggctagggtttgcggtggaccaggggcacggcggcggttcaagggaacggacggccgagatcaaccctatccaaaacggactgccgagatcgaacggtccacgaccggctcacggggaacggcaacgatgacgtcagcgatgacggcagcgatgacgtcagcaccggcggcgactcgggcggctcggacgcgcatgctcgccggcgaatgacagcgcggcgacgcgaacggagggcaccaacgggtagagggcgacgcggcgaactcaccggtgaccaaaacaacggcggaaaagcaacggacggcgccg

SEQ ID NO: 51216 - DNA, 1390 bp, Oryza sativa
aaagcatttttatttcggtggtatgggtgatcctgcctgaggaacctccgatggcgcatgtacatggtcttccgacagtgattcagccacttgcctcctgtttgggccatgcaccttacacatcgctttcatgcccttcaccgtttggcccgacgtgtttccaagtgctgggtagtctgttattttccctaacaaaatagcccgacatatgaagtgttctcgcttgtacgcatcccacatccgcatgccttccgtccatagtgtatgaagatcctctaccagcggcttgaagtacacatcgatatcgttgccaggttgtgtaggcccttgaatcagaagtggcatcatgatgtacttacccttcaaatagatctaggaagggagattgtagataataacagctactggccatgtgctatgacgactgctcatgttaccaaacgggttcatgccatcagtgcttagtgcaatcctcacatttccgatgtcgtgagaaaactctttttggtacttcctatctatctttctccactgagacccatcagctgggtgtcgtatcattccatcttttttacgctcttcgtggtgccaacgcatcagcttggcatgctttttgtttgcatacatacgttccaaacgggggatgattggaaaataccaaacgaccttcacctgcactcttttcttatttccaccctcatcatccccgtctccacacttatagcgggaagccttgcataccgggcattgctccaaatatgcaaattcaccacgatacaaaatgcaatcatttagacaagcgtgaattttctgtatgtcaagaccaagggggcatataacttttttggcttggtacgtcgattctggcaagacattgtccgtaggaagaatttctttcaagagctctagcaactcagtgaagctcttatcggaccatccgttgctcgccttcaggtgaagcagcgataggaccacttggagcttgctgtgctccgccttacatccattgtaaattggagttttggagtccttcaccatggttgtgaacttgtgatattccttatcatcagtgtcaaatctctccccgtcgcgcagcatctgatctagatttggttcaccgtgatcgacacatgtttggtcctcctccttgtagccgacatctgcatcatgcccgtgacagttgccggcacttccctccccttgctcctcctcgccaaggaagttgtccataaaaccctttgtaaggagatgtgaatggacccgctgagctggaagttgtctgtctttcttgcccaatttttaaaattatggcatggacaccaaatatattctagtgcatcgactgagtttgtgctggtggccgcggcaacgagagccgttactcccctga

SEQ ID NO: 51217 - DNA, 1470 bp, Oryza sativa
gtgtagggcccaccgtcggacatgaaaaacactaatgaaacaaaggtgccggttttgggttgagaaccgacacctttgtctcaaaacaggcacctatgtgtggggcctgccaacggctagtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccattagcctcattgtagatctcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcatctactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagtgacccccgtgggcttatctccgccacttcttagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaatagtgagctaatgtttctaagcagggctaagctattatacctaatatctagttgaaccaatataaataaagctcacctagtcaaattataataacccaaggtatcaaggaataaagtaatcaagaacaaaagggctataacaaacaataggttaattccacccaatgacattcgaaaata

SEQ ID NO: 51218 - DNA, 5178 bp, Oryza sativa
gaaggagcggacgagaacggcggcgacttggcgatcacgacggtggccttcccgagcgatgacgacgaccgagacggcggcggcgcacggctggagcgacggcggcgacggcggcactatgttgcacggtgctagaactcttccggcgacgagaggcgaaggcgagagaggcggcgggtagaggagacaccggggaaccttttaaaggggctcggaggcgacggcgaaggcccacggcggctggcgacgagaaggaaggtttagggttcggaggaaagagacgaatccgattcgaactcgaatccaatgatttccaaaaagaattagccgatgattccaaaagagaaaaggtagaggagatcccggagattgtttcccctctatcaattcggccggagaaggaaaggatcgaccaaatttggaaaggaacggcggcggcgcgaaactagggtttcgggcggcggcggccggaggtagacgacgaccctgacaggtgggccccacctgtcagcgtcggacgcgcgcgcgctcggcggcggactgggccgacttgggccgaggagagagagagagcggttttgggccgactttcggcccaaagccaaaagaagacttttaaaacctttttcaatttaaattatttcttaaatgcaattccatttattaaaaatacttccttagctcaaataaatcccagaaaaatctaggaattatagaattaagcaaggtatttaatgaaattttatctggccccattttatattggaatttattaattaaaattagatcttctcttcaagacttttaaaataaattctaaagattccatttaaacaacaatttatatattttgaattttcagggtgtgacaaacctacccccttaaacagaatctcgtcctcgagattcggaagaactggcgaacagatgcggatgagctgacttcaattcatcttctcgttcccaagttgactcttctgcgagtgattactccattggactttgcaaaaacggataacccgattcctggttcttctctcatctatttccaagatacggattggtttctcaacataggtcagatcctcttggacttctatccgttcaagattagcttcttcggtaggtacccttaaacactttttcaattgcgaaacatggaacacattatggattcctgccaaagattgaggtaattccaattgataagcaacctctcctcttctactgacgatcttataaggtcccacaaaacgcggtgccaattttcctttggtatgaaaacgatgaactcctcgaaaaggcgtgacatgaagatacacataatctccttcttcaaaactcaaatctctgcggcgattgtcggcataactcttatgacgagactaggccacacgcaatctttcttggatgattttcaccttttcttctgcttctcttaggatatccgtcccgaaaacttgacgttctcccgtttgatcccacaaaagcggagtgcggcacttctgaccatatagtgcttcgtaaggagccatctgtagactagcttgataactgttgttgtacgaaaattccgcatagggtagattcttatcccaacttccaccgaagtctaaagcacaagctctcaacatgtcttccaaaatctgattcaccctttcggtttgtccgtctgtctacggatgataagcagtactaaagttcagcttagaacccatctcttcctgaagtttcttccaaaaatttgaagtaaactgactgcctcgatcatacactattttcttagggacgccatgcaaacacacaatccttgccatatacaattccgctaagcgacttccggaataggttgtctttactggaatgaaatgagccactttggtaagtctgtcgactatcacccaaatagagtcatggcctgatgacgttctgggtaaaccagtgataaaatccataccgatttcttcccacttccattcaggaatcttcaaaggctgcagcaaaccggcaggtttctgatgttctgccttgactcgctgacaaacatcacatactgctacgtattctgcgatttcacgcctcatacttgcccaccaaaatctttccttgagatcctggtacatcttagtactaccagggtgaatggagtataaagtatcatgagcttctttcagaattgcatcttttaaatctttgttgtcggggacacagattctctcacccaaccatacagttccgtgctcatcctccaagaaaccgatagcttttcctcttctcctattcttcttgatatcttgaatatcaggatcattaatttgggcttctctaacttgatcaattagagtgggcttcgcttctaaggctgcaacaaaacctatactgacaattcccaaatttaatctttcaaattccttgcataattccaatggcaaatgtcgtccttccgtagcattgcaatagcctttcctgctaagagcgtctgctacaacattagcctttcccgggtgataatgaattcccatgtcataatccttaattaattccaaccatctcctttgtctcatgttcagatccggctgagtaaagatatactttaaactcttgtgatcggtatatacctctgtacgagtaccgaaaagataatgacgccaaattttcaacgcatgaactactgcggccaactcaatatcatgagtagggtagttcttctcatgcggacccaactgacgagatgcataggcaaccaccttcccatcttgcatcagtacacaacctaacccaagtttggatgcatcacaatacacctggaaacccttctttggatcaggtaaaatcaaaataggagctgatattaagctacttttcaactcttgaaaactctgctcacattcttccgaccacttgtacttcacatctttctgaagcagtcgtgtcaagggcttagcaatcttggaaaaattctctataaacctccggtaatatcctgcgaggcctaagaaactgcggatctctgaaactgtcttcggttgtttccagttggttacggattccacattactaggatcaacggcaactcctccggctgagatgacgtgaccaaggaacttcacttcagacaaccaaaattcacacttgctaaacttagcatacagttgatgttctcgtagcttctctagtgcaaggcgaagatgttcttcatgctcttctttggttcgagagtagataagaatatcatcaataaagaccaccacgaacttgtctaggtattccataaacacctgattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtagcacctttaagctgatcaaacaaatcatcaattctaggtagtggatacttattcttgatagtcacatcatttagtgcacgatagtctacacacatcctctgggtatgatctttcttttccacaaaaataaccggagctccccatggagatgaacttggtctgatgtatccttactgaagcaaatcatctacttgcctcttgacttctgccaactcattggctgccattctataaggtctcttatggatcggagttgttcctggtaccaaatctattctgaactctatatcccttttaggcggcataccaggcaaatcatctgggaacacatcgggatactcccggactataggaatctcttccaaagttatctggttcagtcttgaccttaaagattcagaagacaatgcatgaacagttaccactcgaccatcattgctggtgagagttacttttctgttagcacagtctatcacacctttatgtctggctaaccagtccatccctaagatgacatctaggtctttggattctaacaggataagattggccagaaatggtactcctttaatttctattctgacagaggggctaccttgcaaagagagtgcttgattacttggggtactaaccatcaaaggacgtctaagatcttctactttcatcccatgatttcccgcaaaactcatagataagaatgaatgtgtagcaccagaatcgaaaagcactgttgcaggaactaagttaacaaggaacgtacccaaaatcacatctggagcatcttgagcttctgccgcagcgacatgattgacacgagcctttgatgctggtgcggtagagttgctctggacagggacaaccttcatgcgtcggggcttcggacacttgtcagcgtaatgtcctgggtctccacagttgaaacacaccacgggcttgctgccatgctccctcttggcaggctgttgctgtgttggagctgcaacagggcgtagagcttgattgcggatgttgttgccagcattgttgttgaagaactgacgctgcggacgaacaacagacgaagaacctccatgtggcatggactggggtcctaaagtaagacgcggcctctgattattcccctgttgtgtcttgaattgagcaatccggcgtttcttctgctccatgcggttgtatttgtcctcttgacgaatagccttatccaccaacttctggaaatcagaataatccccagtcatgagtgggtaagaaagctcatcattaagtccttctaagaacttctcctggcgctcttcatcattgcgcacatcctccggagcataacgagccagacgattgaactcgtgcaaatactccgtaacagagcgagatccctgggtgagcgacctgaattccttcttcttgagggacaccactcccgatggtatatgcgtcttccggaaagcagcggtgaattcaagccaagtgataggttcagcagtagtcctgttcagacggaagtgatcccaccattcagaggcagggccatgcaactgatgtgatgcaaatgaggccttctcctgatcagtgcactgaagcaaatccaacttcttctctatggcatgcaaccaatcaccagcttcaacaggattagtggtactagagaaaataggcggcctcacacgaagaaattctgctaacttgttatggggaggtgcatggttatttccttggttctgctggttctgaagt

SEQ ID NO: 51219 - DNA, 836 bp, Oryza sativa
ttgcgcttggattcttcttcttcatcatcacttatgatgatgaccggaggatctgctagggttggggcaacttctttctccaccacacgaacctttggcgccaattgatagcgagggacaaatagagctctcttccttgcggtaagacgaatcctggccttctgcggtggtgcttctcccttcaacgcggctaattccttctccaaacgatccaccttgtcttctaacttgcaaatcttaccacgattccggtcttcacgatcttgagccgctaacacagtctccgcacgactttcatccatagcccacagcatctcgaccaaatgccttgtggtagcatcattctcaattccttcagtctcaaggtaactgccacggtcacttccctggggttgacgaggatggtagcgatactcagtgtcggccaactgatcactataacgatcgcggagctctcctatggcgatccttgccacctcctgacatgcatggatgtagtttcttcctccagcttcgaacatcactgaggggatatcttcactattactgttcaaggtgactttgactcggcacttctcttcatgacgatcatgaggaatctgggcataaaaaggggcagtcccaaatccaatgacaaaggatatcgtacgcaactcttggacaaaaccctcaacaccaaacaagtactcaggcttgtagcgcggcatctaaagacaagtgaaaggagggagttaagacatttatccaattaatagcacaagtttttggattaatttgaataaagtttagaaatcaaagtaaaaaggtaagtaaataaagtaaaccaagcttgcatg

SEQ ID NO: 51220 - DNA, 2939 bp, Oryza sativa
accagttagactatttatattgtttttttatttttaaactaaaacgttagtacgttctttgagaaaattttgctatgtaaattgagtttttggtattttgaaattttgtagtgtggaataagaccacccatgatttttttttggaaccaccgtaccactggcggttcccatcctctctcggtggagggcccaccatagacaacgccgacacagagcaacctccccttttattcaccgacactactacaaaacacctcatagctaggtatcggcaaaaaggtatcggtttatttaaaaccgacatctattaccgttttccacctctatagactgaaaaatatagataaaatatggtacctatatttatattataggtgtcggttctagataaaaaccagcacctataatattagtaacagtttttttttaaaaaagtacctaataaattgtaggtgccgatttaaaaaaaaggtacctatagtttattataggtaccggttttataaaaccgacacctatacagaggtcagaggcagacaagctggccgacttatccagctacctgcccatacttatccatatattatatctcgccatccatccccctcctctaacatctcttctctcgctcctctcctctccctttgccttcctatctggcagagcagcggcggtggccctctcccggcccaggagcccacccgctttttttcccttttgcttttcccttcccaactttggcaggaagtggagaggtagcggccgcccctgggtggtggcagctgacgtggaggccggtgagatcgcagcagagggggccgtggtggtggtggaggaggctcgttggccccctccctctcggcgaccctcccccttctcctacagatccagagatggcggcggtggagaagactgcgggcgaggtggtggccgacgcagaggctggtgcggcgaggtggtggcggcggcgacggtggtggtggaggcttgcgagcatagtacaaaaaaccaggccagaggttgacccgctctggccgtcggttcaccggtcgaactgccggattttatttatttatattatatttgatttgccttattttaaatatagaaccatcacaaattggtgaaaatatgcataaacaaacaagtatatcttttattatatggccacaacataaaaataaaataaatgtagtgtggtaacataataaattcatagtcatagaacaaattaaaaaccggttcatttcttaaaaaccgccactggttcactggttcccatgaaactgtctggttcagcgtttttgaccggttcgattgcagggacggtctttttgctaaaccgagccgccaaggttgtgccagttccggtttttttccagttcaaccgctagtccggccccctttttttttttttactatgcccccagcgcggcgtggggtggcggccggcacagcgcgtaggccggcgcggtgaggtggcggcgcagtcgccggatcggctccatcggcgatttttaaaaagaaaatactataggtgctggttgtgggtgaagaaccggcacctatattctctataggtgctggttctaaaaccggcacctatatctatgagtattaatgccgaccaatagatgtcggccgaaaaccagcacctataatgatttatgtactagtgccaccatcgatcccccacacctccacaatcgagcagagagcaggataagaccaagacgagcgtataggggtgcgtggagcgagggcatgagaaggaagagcagcggaacggagcgaactgggacgcaaggggtatcgtcctgatgcatggggacgggatcccggtgtatagttttcccgttattttttgaccgagggcaagaaataaatggccagatgcggaagtcttgttttcgcaatggacaatggtaagtcgttactcgttaattggcagcagaagcgaaggatatgaaagttgaaactagctagccagctacgtacgactcgattgaatacacctacgtcgttgaaatagagaatacgacgttctagtagccacttttgcagtaacaagcaacctctcaccttagtcagctagctagcgcatgttaatttgcagatatcggaagcaatcaacttgagcagtacatgtagatgtagtattcgtactgcctgtgttcgctgttgctagctctctcgacgagatgacaacgaggtatccatgcatgcagctagctcagtagataagggaggtagctactacgttgcagcactatagccctagctatagcttggcagctactaaccatgaaggagaaggacacgagcaagcagctgctgccgacgcgggcgtcgtcgtcgtctcgctttggcgggaaagtgggcagcaatatcgcggtcgtgcttctcctcgtctccttgggcttcgtcctcggcctcacctcctccaacgccatgttcctcaaatccttctacccctcctctctcatgccatcatccatggcgccattgcggctagtgctatcgtctacttctacttctccgtcgccgccctcgccaccgccgccgccgccaccgccaccgccgcagcaacctgcaccgatgcacagcatgggagatgaggagctgttctggagagcgtccatggcgccgaaaagccggcggcggctgccggacggcgtggtgccgaagaaggtggcgttcatgttcctcgtgagaggggagctgccgctgaggcccctgtgggagaagttcttcgaggggcagcgaaccgatcactactccatctacgttcacgcccacccgtcgtacagcttcaccggctcgccggagtccgtgttccacggccggtacgtcccgagcaaggcggccaagtggggggacgcgtcgctggtggaggcggagcggcggctggtggcgaacgcgctgctggacgccggcaa

SEQ ID NO: 51221 - DNA, 4261 bp, Oryza sativa
accgcgcgctggcgctggaggtcgccgccgacgacgagctctgcttcccggcgttccgcgacttctgcgtcgggcgccgcgagtgcctcatcgacgagcactacctcgcgaccctggtcaccatgctgggctggggccgccgcaacgccaaccggacgctgacctacgccgactggtcgcggccggtgaaccggcacccgcacacgtacacggcggaggaagtgacggagaaggtcatcggcggcatcagggcggacaagcggtgctcgtacaacggcgccagcagcggcgggatctgcaacctgttcgcgcgcaagttcccgccggagacgctgcagccgctgctccggttggcgcccaaggtcatgggcttcggctaataaggtgacagatcgacatgcatgctcgcttcattccttgcgttaattggaagagatatggcaaagcatgctgcaatgcggctaagctggctgcatgtagttgaggcccagagaaaaataattttcgtttaattatatttcgttcgaaaacatgttgatcaggtatatataattaatctgtttctggctgatttgtgttgttacctgagaaatacacagattggctttgacagaacgaatgaacgatattttgttttgacaaaaatgataacttgtcatctttgcatgtcttatttatgtgtgtatcagttgacttcgttgcaaattcttggtcagcgtaaggttaaacaacatgcatgtatattgatcttcgagccacactataaaatcatggtgatcactaatatatactagttgtgatgaagatttcgctaagaatatattgagaggtatagttgtgaaaaattggttttgagaacgcagtgtttgtgcagcggctgtcggcactataaaaactaattttcataggcaccatatattttactttacatgtgcatcaattaaaatccgtttgtaataatagcaataagctcatgtggtccaaacctgcatgaaatcaaattccctagacggttggtcacccgcctgtgaaaatatgcctttgatcataggcaatggggccggccgacgacagggcctgccggctacggagatccattttatccgccaccaaaaataatgttcgtagtagtatgatcagactactatggagaaacctggtcaaaccaagcttcgtaggtccaactataagtgtgagggatgtagtcagcttggaggatcgactagacatgctatatgaagtcagaccaagatgagatgcgccagtcatactagatctagagaggaattggtttcggttaaatctttgagcatcaaagttgtatcgatgttttcatgccttaatatgttgaatgttgtttttgggttaacatgttagaagtataatatgttagttagagataagagtcaaaaacaaattatagagataagatatatcctaaagataagatagagttttagagatagaatcctaaagataaatctactcttacgtactccaagtctctatcccctatgtactcctatatataccttatgagagggtcgatctaatatatgagaaaacaacaaaatacaacaattagatttttctacatggtatcagagctatagactagcgtctatcgatcctcggtacgatccatccatccttcagctgcccccggggagatgagttgaatctataagctctatctggggcaacgcattagctagctagcctcctattcattagatatatttcctaataattagtattagatcaatttatttttagccacgtcgaaccctacgatctccaggagccaacacgatttcgtcagaagccgtccctcactagaatcattaagcagaaggcgaggccatggcgaatagcaccaccgtccaagtcgccctgaagcccgagcgacgggaacaccagaccgcatctagtcatctactactgcatccatctactcaattgagaggagaagcacatggtgcacaggagaataatattctcacgtccaacaagcatcaaatcaagcgtcaaaacaccaagccatccccatcgatcatcatcgccaataacctaccaacggccacgacctaagccgcaactgcttcctcctctacaccagccatatatttgtcttcaccgacaatacagcaccaatggtcttcatcaacacgctgccgccgtatcgtccacaagcatggacacatgcgtgtcctctgacagattaatctgcaagacgcttcatcgacgacaacatcgattacgtcctgtacgacggcaacgaccgcgtcaccgatgacggcatcgatcacgtcatttacaatgataacgactgcatcaacacggcatcactattgtgattactgctacacgacccagaaggatcaaccaaaagtggtagcctcattgccaacgacgtcctttgacatatgcaagacgtccctaatgtcatcctttgacatatacaaggtgcaagatgctaaaattgcagtttttgtcatcacaccatggcgtaaatatttttttttgccttcggctatttgtggctacaccatctaccatgactaccacgaccgcagctactacatgatcggctacatcgacgaacgtctacaacaactccagttaaagcgtccgtgtcatcgctatcgtccatgacactcccgctatgactacgggagggaataggggagagtcaagcgatgacacagaaggggacgtaggcaccaagtggaggaccgtctatcagagatgcaattgatgatggtgacttgaaaaagatgaagaaatagaagatttcaaatccagtcgcaatcgttcgcttcgctcccgttacgactgagggggatgttagaagtataatatgttaattagatataagagtcaaaaacaatttataatagaatcctagagatagaatcctagagataaatctactcttgtattgtactccaagtttctatcccctatatactcctatatataccctatgagagggtcgatctaatagacgagaaaacaacataatacaactacataacataagtatgaaaatactttggaccaaacgtccgacgggagacaattcatcggatgctacacccaccgagcccacttcactcccaacgaccatccatccctatccccacctctctcacttccctcatctctcatctctctatccaagcagtccgctgtgataaacatgataaatcgtgcgtcgccgccactcctgctacacactcctgagccgttgtcaacctgccgtcgccgtggagcagctgctgaccttgccgatatcgaggcatctcctgagctcgtccaatctcctagcaagcaagctaatcagatcaaacagtagcaaatggagagggagcagtagcccgatcgagctaatgtcgtcgagcgtgtgcctctctgccgccactgatgttgacgaaattggtctcctacagcttccaatgaaaatgaagttaaaatctcatgctcctgtcaccaacaaaactagcagccaaggtcacatgttgcttttcatgctatggagcacatgctgctcggtcctcctccatattaatggcgtattgatcttgttgtaaaagcttccgaggtcagggttctgggattcaatagcgtaaaaatttcgggacctaccaaaatggatgaatctcggaaatttcagatgaaatttgaccgaatttggtgcaaaattcaaacaatcattaaaaaaatgggtaaaatgatcagagaaccatgacaagcatcaacacaccaccaaaataccatttaatacgcattaatgcatagatctaacaaccaagttcataacaacatacatagacttagcatgcaaattcataactgtgtagtccattagtctaattcatcaccatgtctaaggtctaaaataattacagtctatccatacatacacccaaaagaatactaaacatatatccataataaatattagtcatgtaactgtcgtcaattgctactgccactagctccatatgtgtagatgaattcaatcaccatcatacatgcattcataaaatactttgtcggtgacatggaaccgggagtagcatgactagaggcttgaggcagacacaatcgcccacgtggcctggcaccctcggggggcgtcgggcccgagggtgatgcgttcgccctcctcttagtccccccgagagggtcgggccgcacccccctcggccccgagggccgaggcgccccgacccctcgtgggtttttgctccgcgtg

SEQ ID NO: 51222 - DNA, 1817 bp, Oryza sativa
accgggtaaaggcagacggtgagccgtggtgagtattagaatttgatgggataggcccaatttaattgtagtatttttaatgaaaccaaaattaatgttaagggattaatatcatcttaaaaccaatgagaagggacctagacttaaataagctacaaatggatagcacctattgatagggtggtggtaggactgccacacacgcgtgcgcgctgagctaagctggggacggggacgggacgggagggctttcttgccttcccctgtttcctctgctggcaatgtcaaccagtaccaggaatggcggcaatgaatgagaaaacggtggcaaaggaggagagaacggccacaacaacggaggcaacaacaacaatgccttatctggatccaaagcgttctccgagcatgttgttctattcactttagtattgaatatgttagtagatgatgctattcctgttattaatatgttcatatttagaactatcactagatcatccttttattcacatgtcatatttattatcttatttttctgtattaaaatttacaagactacatttccaatagtgaggtaggcgatggcgggcgaaagggcggtggactcgcgcgaagggcagatggcgagcttgcgacgagacacgcacgcaaggtgcttgaccgcaggagtgggtggagcgagaggcgaaggttagggcagtatgtttgtggtccgctgaaggctgagttctttcactaagatccctaacttccatatctcgtttttctcattcacgctttttaaactactaaatcgtataaaatttgtgctttaaattttttcaaaaaaattgtattaatttattttcttaaaaatatttaatactacacttattaattaatcataccctaattattcaccccgttcccagccctaccaacggaacacagcccccagtcgcgcgccgcccattattggagcacgccggattcgtggcaatagggtgcgggtgacgtgagccacagtggcaacttggtgtggtcggcgcggcgattggttcgatctggttcgcggcggtcgagtgtggtgcgggagcgggagcgggagccggagcggcaagacggtttcgatcgggcgcacgggagacggcctccacgattcggtcagggcggcaaatgcggcgcaccagcgctatcgcgtgggccggtttcgcccggtgcgctgcggcgaagtcagcgtgcgcgtgactggtggctgggccacttcggccttgctgccggtctggaccagttaggttaggtcagctagcctgttgctgggccgctacgaatctgggcaagatatgggctgcagcatattgaaaggggagttttttgttttcaattttattttattaaaaaatttaaaaaatatttttttcaaagttttacagatctacacccctaatatccttccaaatgattttttatgacatggtacatattcattggtgtattctaacggccatatggaaatggtcggtcattttgcaaggggccacctacaaagtatcataggctagccatttacaggaaggctctagagaacggcaagtggcccgcttataaaatgttgtatgtcactattttatatagatagtctgcaaggggaccgccattaaaatgttcgcgtgactgtaacaacacaccaacgggtgtgtatcatgacaacataaagtgtttttaaaaaactttgaaaccaaaagttattttacgagagagcgttagggagtaaatttgtaaaactttaaaaaattgtaaaaaatatttaaataaataaaattagatattaaaaaaat

SEQ ID NO: 51223 - DNA, 1883 bp, Oryza sativa
ttatagtataatatagagtaaatttcacaaagctacaggtattttgcataatttatcacagaactacagatttaagagcttgtttcacaaaactatatatttagtgtctccgtttatcacaaaactacagatttaataacttgtttcacaaaattatagatttagtgtattcgtttatcacataactacatatttagtgtcttcatttataaccaaactacaggtgtagtgtcctcattattacaaaactattggtttaacaatgctaaaacctatagttctgtgagaaatgaagatattaaatctgtagttttgttaaacaattttttaaatatatagttttgtgatatattctgcaaagtacatgtagttttgtgacaacgaagatattgaatctatagttttataaaataagttcttaaatctatagttttgtgatagatcgtgcaaagtatatgtagttttgtgaaatttactcaatagtataaaatttgcagttttttttactgtaaaaacacagctcggtacagtggtggatctattgttggggcttgttggtgcgcaagccccatctgcatgattcccttcctctaattagcgactaatgactctaattaattagcatttagcgtaaatatgtactggcaaggaaagctagctcaagcactgaatgccaaaattaagttgccaatgtcaaatatgatgtaagtataccatactaatttctcgatagatttgtgtagatatatttgtatagctgcgaattaaaatggagaaagcaatgggatgttaattgatcatatgcatttggggtttcatccgaaaatacttagttgagcacgattgactaatacagtgacatcttctgtgccacaaatagtaccatgcgccgtcctcctccttgctaaaaatagtacggcgtgccgtctgccgcttatcgtttcttttgctaaaacaacaccgttctaccaagcttgttggctcgagattacacattcatcctagcaggcatgtatgcatcagctgccaacagtgcatgtcttttcttttccttcttataggatattctcttaaattactcatccgatttacgatccgattacaccgttttgttcataataatttaatctttataagatcttacatgattatattttttaaaaaaattacaaattattttcataatatatctaaattacttttagatttcattaaattatttcttagacatataaaagtaaatttaataaatcctaaaaaaggtaacttacatatatattataatagtaactcaaaataaaagaaagtaacttgtcacgacatcaaaagttaatttattgtgggggtaaaaacataagtcaaactaataattaaatttaatcaacataatatagaactaaccaatcaagtaaattgttcaccgaatgtctgaaattttttttaataaaatctaaaagtaattttaatacatgataaaagtaacttacatatataataaaatcaattatgtaatatttggttataaaaatttagttgcaacgaacatagtggtataatcagattatagatcggataaataagttagcagaaaattttataagaagaataaaagacatgcacgttgacaataataggttggcacaaaccccataccaacctagccttcagttgcataaactctggcttgaaatgataattttaccacatttagcaactggaccatcgctccttggtactaaaccaagagctctctcggttaagatttttcgtcaattgatatatcttagtttgtttcaatcacactttcatatttaaacacgagccctccctcaatttacatcctagattctccactggctcggtatcgtggttgacagtagtcg

SEQ ID NO: 51224 - DNA, 1511 bp, Oryza sativa
  unsure (1)..(1511): unsure at all n locations
catattttccccgaatagagatgtgtatgtaaaattcagtggtatccaactacttcccattgagaaagtataagtttcttgatacgagatcggggaatttcgtgattagcgttggcatgcttaacatgcccttttcataggggatcaatcggttctattttatgttttaaagaagaccataaaaaacaaatatcatatttattgatggacctattaaaacaaaatctcatatacatttatggacttatctgtcagtaagctaactccaggggcgtccttgggcccgtgcgggctgtgcgaccgaacagggcccctaaaatattatgtcctatatataataatattagaggctttaattttgttaatttgcagttcaaatagtagtaaaacaaggtccaaaacgctgcaaaagatgaaccaatccatcttccatcatactcctgtccaggcgtccacgtcgttgcgtattgccgaagtcctgacgccgcaactgcttcgtctcctctccccagtcccctccggcctccgcttctacctcatcgctgatgataggctgatcaccacgcccctttttaattttactataaaaaattactaggctactagggccccattttaatattttgcacacgaacccgatttggcctggacgcccctggctaactcaatcaaccgggcataggcccaggctccctggttcggtgcagggatgtgatacttggctagtatatgtggttcaattatttttatttctttggtgtttagtctctactattcttatctctttaccacattgagaaagtgctggaaaattccggaataccctcttttatccaatggctgagatttattttatctattttgtcacttcatgaatctaacggctaatattaatatgatgatgtggctcatcctaattgtattttaggattcactttacactagtagaaatttgaccaaatctgtaaaaaaaatcattccgaaaattaacagacatgtcagaaattttgataccccggaatataaaacgaaattacgtccatgatggttaattacacatgccaccaccggaaacatccaatcccaatcacaatttcactttcttcaatatggcgtgcaaaacgccgccttattttattgcaaataacatcacagtatcacatccaccaccttcattttatagctgctagaagtttgccagtttccagctcacaccgtacactcantaaaagccgtagcaatggcgacttggattcttggatggttgctatggcttcccgtgtttctcatctccctctacctcgtcgacatccttgcacactcctgccgccgccgccgcctggaccccgcccacttccgttcatcggcagcctccacctgctcggcgaccagccacaccgctcgctcgccggcctcgccaagaagtacggccctctcatgtcgctccgcctgggtgcagtcaccacggtggtcgtctcctcgccggaggtcgcccgcgagttcgtgcagaa

SEQ ID NO: 51225 - DNA, 3019 bp, Oryza sativa
agtactctcttcagtttgataattcgtgttattttcaataaagatatggtttccaaagcatatatatgagtgtgattttctgttataactaggaagaaaggccccgcagatgcgcagacatcttatttactgttttatgaaataatgttaaaataagtcatatctcaccatttatacgctgtgagatagaccatagactttaatatatttaagaatgcatgttagacttaaaaaaacatcttgtcctagttccatatagattcttctacagtcacacaaacttattatcactattttaaaagttgagtaatatatgaaactatatatgtttatttccaaatccatatataaatattctaaaaacaccacttctaccgattaataggatacaccattaaaattaaaccattaaagttaaacataaatgctgggtgaagatagtcatagtcatcgagactttcttactctagtgccttgaatgatgggtctctcattaagatagccgtgcacgtgctctctcgagatcaacctagagcacaattttaatgtctaatttactatcacacccttatgtagtattgcattgtcatactggcaccgccttaactcagtgtatatacgcccctgttatacttacgatagcatagcaaacactgttgtttatgcttggtgaccctaggaaaggacaaagaaaagataaaggtgatcgacatagttgtgttttgaatcgatttgtggtacagagtagacacggtatgcttaagattttgatcattgctactcaaatttttatagtatagctagaatactctcattcataaagaagcaaggtccatcacccgatggtagttaaataattagccaaagagagacataccatcacaataatctccagagcactattgtttatattttgacaaatacctatagtttagcacctgatttgttttaacacctactgttggcaacaacatgataaacctttactaatttaaatgatgtatttatacttctaaacctatttatcaattacgtagtatatttatcatgtcatatttgacaaatatgaaattattttaaaattataattacattaattttcatatattagcccgagatgtggtgatgcatttagaatcggaatacaaattttattagacacaaatattttatttaaataaaggaatacaacaggatcacaaattggatatataatttaaaagataaccgtttcgagataattgattttatatttgatatttatattaccgatctaatttatatttctgcatatttgtggagtaatatatattttatatggtaaaaagttatattttaaagaccattgattttgttccaatgtacgtatgttttttattaagtatgtttcttattggctttatccttttttatggtaggtacgtgctttttttttcctcataatagttatatgtaaccttttttctcattttacatacgtacttatgtttttttgttctttgaccatcgaggtgcatacagatctactaagcacgctatgttttattttagcttttgtcgtacatacaggagaaaggtattatatatatagagagatctgatttattgtataaaattatgggtccaccatttaagtgaaaatcaacagcatatatctaatctaacattataaaataacgggtctaccaatttaaatgaaaatcgatggtgagattaaattttgtcacgtggcatcctaatagcatttgtatacagatctactaagcacgctgtgttttattttatctttcgtcatatatacaggagaaaggtattatatatagagagatctgatttattgtataaaattacaggtccaccatttaagtgaaaatcaacagtatatatctaatctaatataataacgggtccatcaatttaaataaaaaattgacggtgagattaaattttgccacgtggcatcctaggacctatacatgtaattcgaataccttctaattataccatattttgtatgttattgatagtcagagtttgtaatagtttgacctcaatattgtccataatttttctacttattagctgacaaaaatttcctcaaatccccgttatatgtgcctagctttcgcattcaatcctctagtgaacagagttcgagcatgaaggagggagccagaataactcaacggcagtggttttttctttcttggggaagtgtgtggacagtgacactgctggggaagcgctctttagtcctattttgcaaccctttgtcccgggttacaatcgggacgcctaatccggaactaaaaaagatgtccaatttttaagtcctggttggtgttaccattcgagactagatttagagatgattttgtcgataattttgtgaatgatttggtgctgcttgcatctattgatttcgagcaccaatgtcgtcacccccaaatccccacaaatcattcaccaaatcatccacaaaatcatccctaaatctacaaatatctacaacaaaatctacaaatcattcacaaattcttaaaaaaaaaccacaaagccacagccgttgtcggccggctggccgtgcaccgcctcctggcctcccatcccgccgcctccgggccaccaccgctgctggttccaccgggccgccgcccggctgctgcggccgcttccaccgcctccaccttctgcggccttgagtgccgccacggccacttccgccgggctgccacccggcctcccctcccgttggatctggcagaggggacgccaccgcccgctagccgcccgtctgtcgcctctgcctgctgctgcctcatgtgccgccacggtcgcttccgccggtcactgcctggcctcccctcccatcggatctggtggagggaaggccgccgcccgctgtcaccgtcgtcagaggaggggggagggggaggagggaggagaggagggggagaggttgagaaaataaggggaggaggagataaggacaagtcgcacggctcgaggcagctgtttg

SEQ ID NO: 51226 - DNA, 1611 bp, Oryza sativa
ggaggaagcctaccgatagctggcagcaataacagggcgatacgacattgatagttctacctcgaccacgtgtggttgagtaggtggatagtgtactggaattagaagaggggatacttgtcggagtgtaggagggggtgacgatgattgatccaatgaaaacccttcaaacaaaggttaggagatatgggtcggaaagtgggtagttgagaagtaggagtatgaagatggctagccagtgggagagcacactagtggggcccaatgagtagatgggtggcggtactcagggtcaggtcgggaagggtgacggtggtgcacatatgtgtgtgtggctgcacatcgtttggatctgtttggagacaggggaggagggtgtatatacgaagttcgaagtgatcgtaatttacaaataaataaggtgcgattgacaaataaccaacccttatttatctttttcaattcctaaaacatcttaaatgttgtgatgtaaaagcaggattagttttcattatctgaaggattatgttttgttattaactgtcaccaccgtttcatagtatatctattatgtaggacttgtttgctgctgggagtgacacaagctctagcacaatagaatgggcaatggtggaattgcttaaaaacacattatcaatgggtaaagcctgtgatgagcttgcccaggttgttggatcaagaagaagaattgaagagtctgaaattggtcaattgccatatttgcaagctgtcataaaagagacattgagattacatccaccggttccactgttaccacatcgagctaagatggcgatgcaaataatgggttatacaatacctaatggtacaaaaatattgataaatgtgtgggccataggtagagataaaaacatttggacagaacctgagaagttcatgccagagagattccttgatagaacaattgacttcagaggtggagatttagagctcatcccatttggtgcaggccgtcgaatctgccctggaatgccattagctatttggatggtgcatgtggttcttgcatcactattaattcatttcaaatggagactaccggttgaggtggaaagaaatggaattgatatgacagagaagtttggattgactctagtaaaagctattccgctatgtgctttggccacaccaacttaagtcaacgagccactgtttgagttagaataatggactgctctttgtcaactcaagcattgtatcatgcacggtattattgatgtgaaaataaaaatacatcatcaatgaaatttgtgggtatttactacttcccaatgtttatcaatagtcctgagaaaattacacagcatatatttgtattagaataaaccctcgtggggaaaaatgtagaaatgttagatgtcaaagtatacatgaagtgaagtgatatgtatgtccttcctcattatcttgagatttggggaaaactgtagaaatgttaggtgttaaagtatacgtgaagtgaagtgaactgtatgccattccccaacgcgagatttgggttgaatttgctagtgtgcataattaaatatggcaatgcatacacaaaggtctcaagtttgaacctcttgg

SEQ ID NO: 51227 - DNA, 1494 bp, Oryza sativa
ctcacgcattaaaacgtaaaagaatatataaattcaacagaagatatcctgcattaaatttgaacgaaaaatatgcacgagaagatatcctctcgaagaattaaaattttcccgttacacaatagatgtatacacacggatgtggattttcatccctcgaggggacattcactcgttgtttgcatgtcatctaaatagtcataaaacaatttaaaaacaaatgacaacatagattaatacgaaatatatcactccataaacatgcaaaaccaaattcaacttctacaagttgcaacaaaaataacaaattaatcatcccatgcaactaggaggggtgtaaccgtgggactatgttgtgcgtatgtgcatggcataatggacatggattttcatccgtcaaagggatatcttctcgctgcttgcatgtcatctaaatagttattaaaaaaatttaaaaaaaatgataatatagattaatatgaaatatattactacacaaacatgcaaggccaaattagatttctacaagttgcaacaaaaagaacaaattaaactgaaaatagttcccgtacttttgcagttatatttgttatttttgttttaatatgtagaagttgaattctaacaaatatgtttgtggagtgatatatttctaatctatattgtgaatttttttcgaatttttctataactatttaggtgacatgcacgaaacaatggatgaaaacacttatccattaataactttaattttctattgggaatgagctaagctttattttgcatgactattatttacatttaaaaataaagggccaattttggatgagctcaaggaccatagagcaccctgagttcgaaattactgaaggctattaccataggtctgggttaaaaggttattgaaattctataaaatttacatctcgtcatttaaaagaaattaaacatgatttcgtagataagtctagagctcaagcaagattcaatagtatagttagctataaaaattgacaccttatttttaactaatttaatagctcactcgtaaactacataaattaatttaattgctcactcataatagattctgtgatatgcatcttccattttatattctattactatatgaaatatttcctgcacaactagtttgacaataattcatgttttaggatttgtttgctgctggaagtgacacaagccctagcatagttgaatgggcaatagcagaattgatgagaaatccattgtgtatgattagagcttgcactggtggagaaaccatctttcgtcggtcggccgatttccacaatagtcccggatgcaataaaaaccggggctaaagatgatctttagtcccggttcaaaagagtaatgggcatatttgatctttagtcccggtttgtgttaccaaccgggactaaagatcatctttagtcccggttcgaatgctgtcaggacctgtcaggcccccccgggatctttagtccc

SEQ ID NO: 51228 - DNA, 1794 bp, Oryza sativa
cacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcactcgtccccagctggagctagcgtgttacctcccagagatggcacgttagtcctggtcagatatatgccaggcttcatcctaaccattacaggcaagatattgtatgaagaagggcgaacatgcagatggataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccatctgtttatgaaaaggtggggtaagtccccacaaaaaagagagaaatggtgcatgtggtatccccttaagatataaaaggaggaccttgcccactgagatggaggactggacttttccagattagaaacccaggacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctcccggagtccccggccgaaccggcaaaggggggcctgcgcggtctcccggtgaggagccccacgctccgtcatacttcataattgttggactgtcctaaccgttgccttgacaaccaacatcaccgctgccgcacaaaatcaccatgaggagaatgtggattggggactcaagtagaagatggtggaggggaacagggagaaatggagctgggagaaagaggaggacgccggagctgctgctccactcctccggcttggagtgatggagtctcttcaccagccgccactagggggagaggacagggaggataaagagtgggttagggtttttttgtgtgagatttgctcttttatactagggaagatacttgagggctgttttggaccatgggctgggcggaaaattcaaattgggccgaatttttttggccggtttagtgttgtctcgggctggaccgaaatgggcgaatttcaccgaatttcggcccactcggtccgtatcccagaaccctgtccgaggtagctcagttttgtcctgtggtggaagcccggattcggccacaggagcaaattaaaggaagaagatagatctaactattggagtagaggaaaagaatggacggtaggcttgttgcaattcattgtattatattggtgcactttgttgttttcgtgtgttccgtctttttctaattggatgttgcacgaatgtacattgtattttcttggatgttgcacacaatgtgttttcggtgttagaatcagtatctttaaatgttgcatataattggaaaaattttaaccacatgatgaaacatttttcattggacaatgaaacatatgaaacaattttgctgaaacatttcttagttaatggtgaaacatgtgaaacatttttctagatatggtgaaacactgcccggagtttcgactgggatcggacgtctgatgcctagtcgtccccacataagtagtcatttcttttgtggttaggacgttgattcccatgtgta

SEQ ID NO: 51229 - DNA, 796 bp, Oryza sativa
tgagtctgattgtcaaacacctgagcgattgttgggttctcgggcggtggagatgaactgctgtcaatgcatagcagacacgtgctccactgatctgctcttcactgccactgacgttgttggagtcacggagaccattccttatcttcaccatctagaggggattgggtagaaatatgagaaaaggaagaaaaacaggaggcttagaaactaatctttcttataaatttaagtgcaattatcttaatcttgattgaaacactgaaaaggaagcaaacaactcctaattaaggtagccataccactcacacatgatatcgaccgccgactaaccaacaagcaacaaacctaaacacggaaactagcaagcaaacaaaactaagaaggcgacgaagctaaaggcagtgactctgaagctcggagcggcgcttgcgatcagtgaacaggtttgacacctaagatggacaagggatagcaaccaaggcatgctcaaatccaaattaaacatggcaacaaatgactcaaatgaataaccgagcatggtgatttctatgcatagaacatttttcgtgaacccagataaagaaacaaatgcaactgactaaacaataacttaatgcataaaatagatgcatagttataataatatgcataaaattgccccattgaacatagacacgacctaatgcatatcacccgataaattcccgactgactttcgaataaactccgaataaaatattactaaaaccctagactgagctaattataaagatccgatccgaatgaatgacta

SEQ ID NO: 51230 - DNA, 3265 bp, Oryza sativa
ttaactgcaagggtgccaccagcaaaatcatgcacccacagcccaacattcagtgtattttaattaactaacaccattgcggtggcacaaatccaaagctatgctaatagtcaaagtatatgtaataatgtgatctccatttgtgtactagttgaactaagcacggctaagcatttcctaaaccaacatgtaatcattttgatacccaagttatcaatggcatatggtaaacaatatatggctgagtaataggacccataccacatgacattgtaaaagaatgcaacatttaatagaaatacgggatatttgtaaattgagtataatatgatcaaatgtaatgcatcactttccttgctctcgcactgatgagacctcagcaacgtcttcgagaaaccgtggatcgacgaaacggccgaaatgctataagactactgaaacaggaaacaaaaccatttttaataaattctagggatttttatgaatttactgagacttgaatagacttaatcggagctcggatgaattagttatgattttaagaagataaactttttttattaataaaggaaaatccttattcgatttattgcgcaatattgccccagggctgacgtcatcaaaggaggggggcgccgacaggtgggccccgcacgtcagcggcttgagagagagagggaggagcgccggcatgcgggccccacgggcagcggcacaaggtggaagggacgcggctggcggctcggcacagctcaagccggccggccatggtgcggtggcggcggcgcgcggccaccagcggattgcgaggcagcggcgatcggcacgaaggcgacggcgcacggccggagcggcggctcggccaacggcggcggcgcacgtgggaagggagagaaaaggagggggagggagtcctcaccggaggaagcggtggcggccggcgcgggaaaacgaggttggcggcgacgaccggcgatgccgaggtacggacaggcggcggcgacacgctaggagaagacggagaggagtcaggagaggggacgacgaccacggcagcttaaaacgccggccgaaaatggggaggacggcgcgactcaccggcgtgcgaggagataggcgctccggtggaatgccggcaacgcgaggcggaagccgggaaagctcttgcggcggcgaagctaacggcggcggccctagcagcgacggcgcgcggccggagatgggcggcggcggcggagctcggcgagcgcggcgcggcggcggtagagggcgcggatggaagcggcgagggcggaaaacgaggaggggtctcgggggagcgatttatgggcgcgggaggggcagaaacggccagggagggcccctattgcgccggtgacgtgggggagtggaaggagagaggggtgggattcaaatcgaatcccgcctccaagcgagcgcgcgcgagagagcgggagaggtggaagagtggggcagcgatgtgggcgcgcggcacgggcggagtgggggcacgaggtggagcggagaaggcggcggcgcgggcggttagagctccggctccaacggccggagataggagacgatcggcaggtggggcccacctttcggcgtcctagagagaggagggaggggcgcatgggccggcccaacaaagaggatgccgagcgcgggagggagtggggcgacggcccaagaagataaaaggggaggaaaaagaaaaaggaaaaatgagaggatttttcatgtgattaaatattgcacttgctcattttaaattagttaaaattattttcaaggctctgaaaattctactaaaaatgcatgcggaactcaagaaaaattccaccatgtcattttcgattattaattgcatttattaattagggattagctctaggttaattaatcaatttcttcggacaatttatttaacaaatttttaaagaaaaaaaagggaaacttcagggtgtgacaggagatggcggagacgatgcgatggtgccgctagccacgaaggccaggacgtcgcacgcggagagacaacgcccgtgaggtctgtgtgctcacttgctatcccctcttcccattcacaatttgattcggttcgattttatttactactagctcatagtgatctctgttcaatcccaaatcttatctatccaattcaatctgatttgtacctatccaatggaagcagagcctctctgtatctgtctctatttctccctctcttcaacttaattaatggataaagaacattttcttgagtgattggagtttgaggatgatgcgtgcgggtccggaggatgaacaggaccacaggagacgagatggggaagaaaggggcaattaggtccaaataatttagaaaatagagtgaaggagtaagtagtggtatatgtgaaataaccaaaaagttgtaatggcatgtctctaaatagatgaatagtaatgacatatttcaaaacagtgaaagttataatggcatggatccaattaaacctattattatagtcggttttttattgaacatgcacctataattaattaaaggtgttggtttttttattttcagccagtggaagtggggaaaacactctagctgttggttttagctcttctggcacctattgtgccgatctatatgtgtgtttttaagtagtgaaaagggcgatgcgctcgatgttgtggtatggtttactgtcaagaaaataaatgcacaacaaaaacacaaatttttacataaaaaactcttacatgaaaacaccatgaacatcgattggcaataatcagtttagaagatataatgacaacgtaggggatacagtagaccgtcgcactattcgcgtatagccgacaagagtatataaagaagaaaaatagagtcctaataggataaggaaactaattcaaactctaatagattaataggaaactactcaaaatatactggtaagtgaatctcagataacatatttaacatctacaacgatagcaatggcttgtacgtcaccagtttctagcgtcgtcggctggggacaagatccacagactggaaagggcgggtgtgctcatccaaatacggtgtgtttgtgtggaagaatctgtatatttgctctcttttatggtactccatagctcggtggtaatggcaaagaaaatattgcacattgtttgtctttatttgtcttatctaagtaaaaaaaatatatactcctcctcttgattaatacttccggtcctgaaatagttatctttatag

SEQ ID NO: 51231 - DNA, 3612 bp, Oryza sativa
aattttgataggggtgattgataaggcaagtccaaattacatctaaaatttttggagtgggcctagaatagggtgagctaaatttctatttatttttcaactaaaaatactagtaatatgcccgtgctaaacactacggtacaattatatttgtttttaataatttttagaatttcatattagcaaaaaaatatttttatatggtctgtgctgtgcatgtgagctttaaatcaattaatgccgaacatcaaatatatttcatgtaaatctatttccttgcacggtattcatgttgttttctattcctcaactgtcaatcttcatcattagttttacctgtgaattttttttgcaaaatgaaacggagaagagcgattcatatctcacttatatatgtaccaaggggtaaacactaatatatacgatgatcttttcatttcactgcacctgtttggctgtttggttattggttatatctccaaatgcaattatcggtccaccaccaaactgattttcatccatacttacctaatcgacaacatataagattagtaatccaactcatatttacaatacttccagatgcaccgtttaggtacaaatatggatcaaaataaatgaactatacagcacaccggcaaccatgtaacagattcttaataaaatacccataaataaccccacctcacaattgcttatcaacatgtgctctatattaaacaccaaccgtaatatctgacaccatatagtttatttacagattcgagtgcagaaaacactaaatatgcatccatggtgctaaaaaatattggttatacaaacaaattggaaatatgagctctcagtcttgtatgttcagaagctaggaaggaatcaaattggaagtacttgaatgttaaatgacactgaaaaatgtaccatcaacaaaagaaatggcaagtacagggcatgctctttataagtggtcatgacatcaaaatagcaaaattcttaatgacagtgcctatctcactaatttatctctcgatacaactggagagaaggtgacacagcttcagctccccaatcaccctatcccttgtatatgagaaacaactgaacgaatcagtatagaaaatcacaagcatcttccataacagtaaatccacatgcagagatgcgtaaattacagtgaaattccagattaattcccatatcccgttaagctgcattgccagtggcaatgtaatataggatgtgtggcaatgtaatacagcccacctcataggatctgtggccatgtaatataggccatgacctggattactaacagatcaaagaccccttgacggctgggatattaccttgtgacacaaaagagagatcatgctattttgtctaaatagcaaatatagggtaaataagtgaataaatttcagaagtgaaataaccctaccaaaggtaggtaaacaacagaagaaatttctcttatacagagtctagttagcaataacaacagcaagtaacatgaacattgatggaggaaaatcaagatgtttattgttcataaagtgatcacctgtacataaatagaatcgaaaaccaccacgaacctcattagatggtacctgccaagtcacaaaaggagtggagcaagcagtgaagcatgggaataggactaaacctgggctgagaaaatattatctaattgtttgctcatgaaatctcagccccttttgattatgtcaagacatatcttctcattgattatgtcaaaaataataaagctaaagagaatgttagtaaggtaaatctctactaattaatcaatagcaaagttttttttaaaaaaaataatcaataggtcagttggcatttttaattacagaagcactacaaaaatctgctcagttttcagcttggggatacacctattataagcccctcatattgtcgaactcagccattgcccatgaatcctacactaagtttccccttcaaacaatatatgattaattacatacagaaaatgtaaatttagttgctactgactatatgcagatttcatttcgttcttgagtaagttatgtcatgaaaaggacctgcaattagcatgagatgtattccgtttattagttgactatgaatacttgtacctacagccagccaagtcaggcactgaactgcaactgtcccctccagttgccaattctggattagtcaacatgccatgcaagttaagcgaacagttaccaaaatgaccaaatacatatttagtttctttcacatagaaacataattgttatgtaaatcaaaatgtatcttaagagcatatgagatggtatacaacagaaaaatatcttttcattaccaaagggacataaaaatcatttagttgagccagcctgatgcaaaaactcactgttttccctttttctcacttactgtcatgttaagtcctaagggctgagtgcacgctaccaaaccctatacagattaaagaatcaaatatccccaacctagctcgacaactcgagcattgaagtttcctggaatgatggaggtataccaaaatgaactatcatttagatagagaaaccaacagacacatgaatcatgcacgcagattacctcgtagtgtggaagcctgtgtactcctcactcctaccggccatgagcaacggatccggccaagacccccctcgacactgtcgcattagctggtttcataaaaagcatgagatattcttctgtagttgtttgtctacaagcagtcgaagacgatatggaaaatgtaaagttttgatggtaaaagagccatagtttaagaatgttcaatgaatccaaattccatccaaccaaatctaaaactgcatggataagccttcaacttctggaatttttagcatctaaaactactaaaatgtattgaaagatttttctaactctcaagaacagtggagataaattataagggttttctcataatcaaatattccaattaagatggtgtcaggtttgaaagcactcatattaatgaggtaatatacattttacataaaaaagaagtgaacattcatgtccatatgttacatatttcagtagcatcaaatatcagcttaacataccatacattagcatcattaaacaatacttatctcggtgaacagggttgaggaacgtggtactctactttcgagaggattttacaaacatgtttgagatgtttgcttgtcaggtacagtaaaccactaaggacttcagattttggagtagagttttgcatcacaaatatccatgcacaatgaacaatgtttaataatgaacaatggggatttagtcaacaaaggagataaaggcattatgcatctctatggatgaaacataccatgccccgtatgcctcctcgtacaggaacgggatcgagaagcactcttatcttgttcgcaggcaggatcgatggcttgcagggttgagcgagccctgggatcagtggcagcacgagggactcgaagccggttcaacttcgaggtcgggatggcgatggagcgacgcagcgatggcgccgatggggctgcgggctgcggtggcgtggagcgtcgattgagggcaggcctgacctcgcctcctcca

SEQ ID NO: 51232 - DNA, 738 bp, Oryza sativa
tcttatattaaaattgtagtaatcatatatgctaagtctaacaatcttatattaaaactctaataatcttatattaaaattataataatcatatgctaagtctaacaattttaaattaaatcgctactaatcttatattaaaattgtaataatcatatatatatatatatatatatatatatatatatatatatatatatatatatatatatatgctaagtctaacaatcttatattaaatcgctactaatcttatattaaaattgtaataatcatatatgctaagtctaacaatcttatattaaatctctactaatcttatattaaatctctactaatcttatattaaaattgtaataatcatatatgctaattctaacaatcttatattcaaactctaataatcttatattaaaattgtaataatcatatatgctaagtctaacaatcttatattcaaactctaataatcttatattaaaattgtaataatcatatatgctaagtctaacaatcttatattaaatcactactaatctttgtcacgcccggaaatgtcacgcccggaaattcactagtaatttccgaccttatttgtgcataaaatcctcgtccaggaatcagccgaggtacacaaactgacaatttaatatacaaatccatcataataataacgttacacacttacaaaagaaaagaaaccagcagcggaataacggtctagcgatggcttcagct

SEQ ID NO: 51233 - DNA, 39987 bp, Oryza sativa
  unsure (1)..(39987): unsure at all n locations
gctactactaactgtctagcttgatgcccaactccgcctggttggtgctcctgagtgcttgatggaaatcggatgaagaacagaggggtgataaggacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcgttcatgtgtcaagcttgtcccacataggagaagagatgtcgagatggaagagagaagctaggctataggcagctactacggtcgataccagtagctaggttggtgacaagaaaattaattaattaattattaattaattaattcgtcttctctgttgttacatcaatcggccaatggcggcatctccccgtttattccattcaaacggaaactgcccaagtaacccatcctttccatctcctataaataccgtaccatctcctccacagctcaccatccaaatcaacagtaatgttctacagttagtgagatgtagagagagatatggctagctaatccatgagagaggtctagatagagagagggagagatgatcagttcttcagaagaggctactactagctatctagcttcatgtttaactcttcttggtttgtgtttttgtgtgcttgttggagttgttaggaggaagagaggggtgagaggtgaggctgacagaagagagtgagcacacatggtgactttcttgcatgctgaatggactcatgcttgaagctatgtgtgctcacttctctctctgtcagccatttgatctctctttctctctttctccctcatgtgttatactgttctctcatatctatcttctttgaggtagtaatatacttgagcaaattaagctgcttaattatttgtgtatgatgatcagctgctgatccggcctcatttcttgcatatatgaccacaaccacatacatgcttgttcattttttttcacaaagaaagagaacagtttaatttaatttcttggggtttttggatcagttaatttgtcttgagaggggaagagatctctatgggttttggaggtctgacagaagagagtgagcacacacggtgctttcttagcatgcaagagccatgctgggagctgtgcgtgctcactctctatctgtcagccgttcaccatgcccaatatgattaatctccttctctcagttgacagtaatttctttgccagatctcctgttaaattttctgcctagctagctattatgcacatgcttattatgatgagcctgccaatatcatctccacggcaaaacacaaactagctatgatttgattcattatatttcttttcgctgtttaattaattatatgcaggcatacactagctagtttccagctagtacaaagacgagacgaggtcgttctgacgattttcatagtcgtcagaagaaggtgtgcattggtttaatttttgttcttggctgtcagactagatcatctctgaatgatcaagagccggatcaaataattattgtgagcaccgaaatcgatcatgcgtactctctctgtgaagtatttctgagaaataatatgagtgtagctagtatatatactcttgaagggtgtctaattaattggggtctctagctagctccttctctgaatctgtccatgaattgaatctactatgtatgtgctggtgcttactgttatttcatgtactacatataattgataaatcaatttaggctttcagtttctttaatttgtgagcacaagtttacattatattgtaattggaatctgttgcaagtactatatactgtttttttatgcatagcagttgagaaatagaatccaatatacttgtgcaatttattctatgccaccttaattaattacttcttcctagtaatgaagtgctagcttcgatctttcaatattacctgtcaatcttaatttatacttgtttaatttgactgtaatttgccagctagaattaaatgtacattaaattgaattcttcagtgttgttcttgtgaagttaaaataatttctgaacattcacccctctataatcatttgtctatatagaaaaagcatgaagcaattctaatcacaaaaatacatggagttgtctagatcaaacaattaattaatcaatcatcaatcaaaccaaagacgtgtaaggtcatataatacaaatttaacttgacaagttaatgagtagaagatgtatgcaacgatattttccccgtagcttatactactgtcgatatatgcgtgtgaccatagttcacaagccctgtattttatgatttcaaatgttcgttcatacatatacactactacaaaagcccttattgacaccgattgagaaccgaccataaataccgatcgattttccagccggtgtcaatttaacggtactaagggcacccacaatggttatctataggctctctataagatatccatgtcagcatattttcctacttgaaagagattaaatgaagagagagagagcaaagctatctactaacctggagatagtctatagagaaaaacgagacaatgtattagaaagctatagatacccatgtagacatactattgagatggtttactattaatctagtctattgctgagatgtacatgttttatagatagcaccttactttaccattgcgggtgctctaatgcacaaccatataggtaccgattttagaatcaacgcctatagagattatctgctatttgtgactatgtgctatttgctatttttgaaacatggagcaattaatctgttataataatcggatcggatgaacaagttgaaacaaaaagggtccaaattaagccatgcaggtttttgctatatagtcgagctgtgttgatagttgtaaaaaaaaaactgtgttgaaatcgtgaaagtacccaagtttgatctgaaaaaaaatcgaaaaagaagcccaagttggggcaatgcaggcacacgcacggcggatggatggtccggtccacatgtgtgagaagggaagctccacgttcctccggccaattcaggtaattgggccgtggtaattcatttcgcatgacagtaagtctattttgtctccctcttcttgcttctggttgaaccacatccctcaacagcaaaaccgggtacaacgtctcccccatcttcgaaatatggtggaaaggtgttacacccggttttgcagttgagagatgcaattcgatcagcagcaatagttcagagatgtataatggacttattcgtttctcaggaaaatatttcttctacttagcttcatctgggcttcatccttttggggcaatctctgtttgagccagcatctcagctatgcatgggccagcagcagctcagcataaaattggtccctgaaaagtgtaaaagttacaagtggttaaccggttacttgtccagcagaaatggtttggtttggtttgccatcatgtcgaatgtacttctggttcttaaatagtactctctccgtttttttaaattataagtcattttgttttttaattttttatttgataaatttatagaaaatattagcaatattcacaacgttaaattagcttcgtcattacatgtaactttgataacatttttgttttgtgtagaaaatgttgctttgtttgattaagaaaaaagtcaaatcaacttattatgatataaaatagagagagtgttcaccctcttaagtacaacactacgtaccaaagttataatcatggaattgcgtgctttttatggttgcgaatcacctaacatgtatcaaacacttttttcccctcctcgccaaatgatctttttaaaaactttttggtagacttttctggcctcggataaaagcgtgtaccttttacttgaagaaaaataatagctcagcatatttaaaacactatctaccttggccacgccctccatcattgtcatttcgatcccccgtcattcatgtagaattcgggttgaaaaaactacaagctccattttttatatatatgtttatcataatttgcatacgtccctttcatagatcatccttttgtcatcctagccgaaagggcggctgggctgacctccttggcaaggaaaatcaatcggatggaaaagaacattggatttgacctattgaaaatgagatcagaagaagcactcctaatggtgtcaatgtgatgttagtaccccttttctgcctaatctccaccccagattctctcccaggttgagaaaaagaagaaaacctagaaaaaaaaaagtggctttctgtgatggacggttttgtttggcgtgtttggctgtggccctctatatcactgctgctctatctatctatcattctatctctgcactgtgccactgtgctactgtgctcctgctttagccttaggggctaataaaaccttgtcaagttgcaatttgtgtggtgattatgctctgaaaatcttaacagtgcctggggtggcagggtcatgacaaggcacttttgctgtgtatcttggtgtggggttttcatgtccactcgtaatcagaaatatttccacatgtttctgcataaaaagcatgtgcttcattaattcttgagaaatgtcgagctaaaccaggctaataatttgtaacaacgcaatgttatttaacatgtgtccattgatgtatgatgcttatcagtcccaacgtttcatctacaattggttatcacaacattagtgacaaaaaataatttttgataaaaattttatatatgattttttgacgatttaaaagctaatattaaaaaaagctatgaaaaaaataaaaccaactctaaaattaagattttaaatcaaaattttggttgcagctaacaagctgcataggaaatgatgaagcaatatgtatatagtaatagtactatatatgctattgcaattaacactaatatccagttagcaagctattaactagtgtggaacatatgtgaatttatgatataccatgacgtcgaagtggaaataatacgatgacgttagagccattgtaacttatctaataatttacaaaatacatcaaaatgtacaagtacaacctaaatttcaacttgtttatggttgaccgacaacgttggatttgttaatcttgcctaaagccgaccttaactgcttcttgtaaatccagacaaactagtattccttggactgtgacatcttgagtcatccttgaaagctcaatgtatgacaagatgaacgacaaagtgcaaagcataatttccattttattctgtaatcaccttttctgcacgttggtgaaatcttaacttcgaattatcacaatttccatttctccctccatggatgaacataaaattggtggtccacaccacacgagtcatcaaagccatccaacatctaaaatttcgtctgaattctcacaatcctttgtagtgtttttttatacaaatcatagctaaatacacaatcatgcacagtacacaccatgcatctcttaataaaatttggccggggaacatttgttggctcagcaaaaaatcttgtttcattttccttttttttttctaaataccatggcctcctgaaacagatcttatcccaacattttctgatgtggtcttcttttagaacaacaaaaccatgagtaaatcacaatctccaaaaaggtgaaccgagcaatgtcaatataaaagcagccgtgcacaaactaaaaactgaaggaaaagaacaaattaaaagtgggaaaaatctatacgtactaactttttcttactaaatttttactaacattgacatgtcgtattatgagtgcatttagattttttatatcttccatctacttgaatcaaacagttgagatgattgttagtgcaaatttagtaagaaaattttagtacgtgtaacagtgctcttaaaagtgcatctatctgtcgtgtgcctgcatcactagatcactgctggtacacatatataggctgcccaattttttttcctgcatatattagcagaaaaaagaaaggagataaagcaccgtttacttctttcggccaccgatttctccaaaaacgcacgcttctttctgtctgaacttccttcagcatcaagccctttcttttcagaatatcttcagtctcactcttcaggcatctgtatatatcacaacaccacctggtgcttaggtttgttagagagaaaaaaaagtgtatttaattagtgttaattgcaagttatgatgcaatgttatatccttttggttttggaggcagcattaagttgatttgtgtaaatgatttgttttcttccaagaaaacttcatctgaaagtgttcttttcttcagagcagcagagcatgtgtgcagtgttcctgatcagtacttgtgtactattacctgtcaattgctaagagcctttaccaaaaagtttcaattatttggagagacaacacacttattgacaaagggaaataaagcattttttggcactagaaacaaaaagcaaattatatccagtttataataaggcaaagaaatggtgaaaaaagaaggtaataatacatgaatgtatctgcaaaaaacgtgatgactttctagatgtcttcctcttcaggcatcaaaccaccacctggtgcttaagtttgttagagaaaaaagtgtatttaattagcgttaattgcaagttatgatgcaatattccacccatttgatttgtaggcagcattaaggcccgttcttttctgattttgagatgctcattttcatttgcacgcttcgcctctaaacggtgtgtttttaaataaattatatataatttttttcttgaaataccttttaaaaacaacctttctgctctttagtggttaatttattttttataccctcaaacagctatcataaaatcaaattatccatcaatcaataaattttaggcatttttaaactggtttagtttccaactttttttttcaaacttctaacttttcaaacacatcaaaactttcctacacacacaaacttccaattttttcatcacatcgttccaatttcaatcaaacttctaattttgacgtgaactaaacacacccttagttaatttgtgtaaataattgttttctttccagaaaacttcatctggaagtatgcttttcttcagagcatgtgtgcagtgttccccagtgctacttgccaaatagtattgccaagagcctttacaaaaagtttaatttatttggacataacacgcttatttataagggaaataaagcatattttgcactagaaacaaaaagcaaatatacccagtttatactacaaggcaaagaaacggtgcaaaaaaataaaaacaacacaaacaaaaaagtagtactaatacaggaatggataagctggtgacctcattgcaaaaatagaggggcgtatttgcaaaacgtgaagactttctagatgtcttcctcgataaggttccagataagtccaataacttccatctttttatttttttcttttgaaaaagctcacctatgcactttcatcaagctaacatgtcattttaaactaaccaccaaactgttttgtgagctctgggcaaaagaaaaaaaaagacataaacaaaaacaaaatgtcaaccaaacatctacaggtactgtagatgataataattataggttttttactagacaacatatctgtctgaaatgagttaattaatgtaatagcagagcataaatgcaaaaaaacctctacaattctagatttatagagggataaataaaacagaataatccaacaataaatgtgctttttaaagctaaataaatctaatttaacacacttaagcaaagcagctgagaagaaaaaggtaggaaaaaaaaaaaccccggcgtcttctccagttctgctccacttgtccgtagtctctccactacagtccacacacaacgccgaaccctgcagtgcctacctacccgcacgaatctcaaagcaccatccgacgcctcccccagcttctccctccccctccccctcccccatcgagaagaagaggagaaaaagaagaggagagagaaagagaagagactagtagtagaggagagagaaactaaacccaacccaaatagggggaggaggaggaggaggcgcaaccaaacccaaccccgccgcctccgccgccgccgccgaggaggatctccgtcgaaggcccaccggagctcagcttgcggggaactcttctagcggctggagtctgatgcgtcccagcccatggcaccccacctccacctccggttgctgctggtcgtcggcgtggccctcgggagcgcggggctgggctgggggggaggaggaggggagggggaggcgacagatcgggaggcgccggacccgtactcgatcctgacgtggcacgactactcgccgccgtcgccgccgccgccgccgccgccgccggtggcgcccgcggccacctgcgagggggacctgcacgggaaggggaacttcagcacccgctgcgaggtctccgaggaggtggagctcggcggggacgtctacatcaccggggagggcagcctcgtgctcctcgccggcgccgccctcacctgccagaggcccggctgcgtcatctccgccaacctctccggcgaggtccgcctcggccgcggcgtccgcgtcatcgccgggagggtctccctcgccgcggccaacgtcacaatcgccgacacggtcgttgtcaacaccaccgcgctcgccggcgatccgcccgagcggaccagcggggtgcccacggggacgcacggcgacggcggcggccacggtggccgtggcgccagctgctacgtcaaggatgggcagacgcaggaggactcgtggggcggtgacgcctacgcgtggtccgacctcgagcacccgtttagctatggaagcaaagggggctctaccagcgttgagaaggactacggcggaagcggcggcggtatcgtgtggctgtatgccgatgacctgataatgaatggcacagtgctcgccgatggaggggatagcagcgagaagggcggtggtggttctgggggaagcatctatatcaagtctaagactatgtaagtgttcttagaattgcttcaaattccttcctgcttcctacatgtgctaattgaaatgatgcatgggcatttaaactgcctaacaaacttgcagattagaaacagtttccaaagctgaggtcacatatgaatatattggttcagtaggatttatttcgtatttatacctgtttttcattttgttattaatgagtcatggatgcggggaggtagtactaaacatattagggatttacagaggcttgctcggtctaatagatatgagaacaagatttcctgtcatgctgtttatatttttgttaataaacgattagccgccacaatggaattgcagcttcttcaacgaacaaaaagaacatgaagttattaaatgttcagtctggttgtaatttttcttaacacttgagaagttaaggactaatgtgataggaatgtatgagtttagcatatttagtatgtagtcatgagctcaagcttgactatggtactagacaattggatttgaggatttttttttgcactaggtgttaataagagaaattaatgtcacagtccagattagttcagtggttaaattatgcatataattgattgactaataaatgaatataggaatagtttcattttattgttaccaactttcacaattgcacatatttggtagttcaaaccaatccagctaaacactagaccaccaatgcagtaatgagtggcatttgagttgaggaatgctttcattagcttgaactagctgttattttggtttgttataaatctgttgactatgcgctctagtatattcaataagcccatgcagaattgcaaactttccccttctgatcttctgtttgcaacaggcatggtgctggcaagataagtgcttcaggagggaatggtctggctgggggtggtggaggacgcgtttctattaatgttttcagtagacatgatgacacccaagtttttgctcatggtattgtgcttggtcttatgcacactgtgacactgatcctttcttatatccctgaaatgcagattatcaaatagcaactatatatttgcaggcagcatgatcgtactgtattgtttgtcgcaaaatattctgagactcctttttattactgttaggcctcagtatgttattagtcttttgtttaatgagatgaagctcatattctgagtaactttctaatgatatatagaatatggatggagctatagtgtagacaattttattgttttgtttatgtttgaattaacgtttatacctttttcaggggggaagagttcgggctgtccagataatgcaggagctgccggaactctttatgaggctgtacctaagagtcttgttgttagcaacaacaacttgagtacacaaactgacactcttcttttagagttcccaaatcaaccactatggaccaatgtttttgtcaagaatcatgctaaagttgctgttcccttgctatggagtcgtgttcaggtatgaatctgtatctttcagatgttcattaattctctctctacagatcatggtttctttactctttagtatgatatttgccattttgctgtcataaattcattggtttctataatacttacatgcatatgcacttcaaattgtaagactgttaatctatacttactcttgttcctctttttgcatcagtggtagcacgttgaacaagtgtggataaatttgtactgttagtggtggatccacccattcggtaggttgggtcggctggcccagctatggtccatgtcaccccacactccccagaacccccttttagtactgggccgcccatattagccattatccaccagaccataagaagcccataaaattaattaagtactccagtccagtcatgagacaatcaatcgttgttccatctttcaatttcgtgatgatgtacctctttgccagagcacctgactattcatctttattgctcttgtcctcttcgctgtgccggttactatgctagctgccagagtcagtctgtgctaacactgtgccgtgcgcgggcccgtgggcacacgaccgcgcctctgccggtctgcccgatgccctagccagcagccagctatggagaggcgactctagaattatactctattgtgtatctttgatgttcttttgtgccttagtttattgactgtaatatgtttttttaatacaattacaatataaatatggtacagtatatgttgcgttttattatctttatcgagaatttttgcccccatttttattttatagctgcgtctgccactggtacagtatgataatttacactcaatcagtaaggtctatacatgttctttttctgagtttgaggctgtctctgcattttggcaagtcacatatttcttacagtttccattattttgcactgcacttccttcacgtacattatgcaaatgtgggagttgccattacctgataattaggaaaatgcttgtcaatattgctttgcgcaatatttaacgatagtccgcaactttttatttatactttcaggtccaagggcaacttagtcttctatccggtgctattctaacttttggtttgacccgttatccatactcggagtttgaattgatggctgaggagcttcttatgagtgactcaacaatcaaggtgttattttactatttgttcttgccatgtattgtgttgttttatggtattcaccttactatatgtgctaaacgcatgccaatttctatgcaccaatatgaattgttttcaggtgtttggtgccttgagaatgtctgtaaagatgcttcttatgtggaactccaaaatgttaattgatggtggtggagattcaatagttgcaacatcgttacttgatgctagcaatttgatagttctaaaggtaatgttcactgtcaatgactctttttctcttctctgccttaacacttcgcataaaagttctgctcatatatttgtcaggaatcatctgtaatacactctaatgctaatcttggagttcgtggtcaaggtctgttgaatttatctggagaaggagacataattgaagcacaacgacttattttatctctattctacagtataaaagtatgataaccctttgttctactgcattttgctttaattctccacagcttttctgtagttatttatttttatctaccacatggttgttgcaccttcaaaggaaaggcttttgactttaacatggtgggtctggattagcttctttgccttagttcccataaaggaaagaaagtaaagactacatttgctccttgaactctgctcggagtccactttccaccttgtaactaaaaaaatggttactttttactcccataacaaaactggacaactgtcactgacagacaggttttagttttagtggtggttttgccacatcactcttttgtgccatggtgctgacatgtttagggggtgtacgttgttctgactgtctcagtaaagagtggcagtgggggcgtgcacctgcgcatatttagagcagctcttgctggtgctggagtggtgaaatgtaaggtgatgttcttccaatgacagctggacaccattcataagtgtggtccacctcaatggaaaccaccattaaaactagtattgggtgatatttgccggatttggaagttacttttgtattttttgggggtgggtgggttgaaaatggctggattttggcttagattgaatattagactcctgccagagttagggggccaaaaaagtactttattttaaaaaggaaagacatgacagtgagacagacagccagctttctaaagaaacctgtctgtgatgtgatttgcttatgtatattggattattggataaaattttcttcacctgctgtgtgctattgcagaattaattatgacgtgatcacttctgcatactttctttgttttggtgtattattttgtattttccctgtacttgtagttttaggatctgtacttgtactattattaagaagaggttgtgataagcatttcttttgtaggttggacctggctccattttacggggtccacttgtaaatggaagtagcggtgacgtgtaaatactgccaccttcaacattgaattgaaattatcttttcttatgttttatatgccaaaagattcatctcatttattcttgtgtgcatctattagggcaccaaagctgaactgtgatgatgacatctgtcctgtggaaataatacacccaccagaagattgcaatctgaactcatcactgtcatttactcttcaggtgcattcagtttttgaaccttaccttgtgatgtgtcatggatgggttcctttgctagtgtaatgcaaaatttgaccacttctctttcaggtatgtcgtgttgaagatattgacatctggggtctcgtacaaggaactgtaattcatttcaatagagctagaagtgtcagtgtgcacacatctggtaccatcagtgcaacaggcttgggtaatttttgtaccttccttttgtttaccattctgtatcattggcttgttccctgcacttctggatcaatgctgcagaaatttgtagagttgctgggtttctaagcttaagagagtttaagcttctggatatggtgcacatgtactacgatgttgaaactcagagggctttgtcatctcaagttgcagtatactgtttacataccttgcagcttcttcagtggctaattcataaataatgatgagaggagctatatatttgttttattttctattttccttcataattcaaaaaaaatgctttagtatacttaactacatctggttgtaactatttcaccacaggatgatcttttgtttgatggtatgctgttggcaactgatcccagaattaattttcgtatcttctaatttcaggctgccgaagtggagtaggacaaggaaagatattaaacagtggtgtaagtggtggtggtggtcatggtggtagagggggggatggcttttataatgaaagccatgctgagggtggatctatgtacggtagtgctgatttaccatgtgaacttggcagtggcagtggtaatgacaccacaaagctttccaccgctggtggtggtataataggtaacacaattgttcaattagcttacctacgtttattattaagttcatagattttaggactcatgctattgctgtaactgcactccagtgatgggctcatgggagtattctctaccaagtctttccctctatggttcagtagaatcaaatggtcaaagttccactgatgtggtaacaaatgcttctattggaggacccggtggtggttctgggggcacaattcttctttttgtacgtgctttgtccctagcggagagctccatcctttcaagtgttggtggtcttggaaactttggcagtggtggaggtggagggggaaggattcacttccactggtcaaacattccaactggagatgagtatgttcctgttgcagctgttaaaggatcaatacgtacaaggtcggtctgattctttctcctatacatgttctagtattctagttctccaggggaatgttcaacactgtgatacaagtcgaatatggtttgtctcatacaatttgcttagttttagtatggacccttgtgatggctacgtattgtgacttgttcactacattgaagctttttctttataacattatcactcagttatcagggtatgaaacaccttaagcaataattactggtctgagggcaatgtaagatatgaaaaagcatcattacaggaaaatgtttgctttgataatttttttgacttttgaccctaatccgtaatgaccaaattgaaaatgttaagacggtatttatatgtagaaatactttgatcttatggaattctggcgtagaaacaagtcactgaattctgattgattatactattataaacgtgctgtgattgaaatttgaatctgtagctttcagcaaattccatgatgcagtgtaatttgaattctgtcctttcattgccagttgtttgtgcaaacaatagacatgtggcatgcctggaatttttatgtgttcctctcgtgcactgaccaaatatccttatacagtggaggaatcagcaaagggaaaggatttcctggcgagaacggaacagttacaggaaaagcttgcccaaagggtctctatggtacattttgcaaggtaacttgctaatatttcatagttccatctgccccttgtcttattatttagttgtaacttgcattgtaaaagttgattcaaatacaccaaacaacctactcaattgttctgtcattataatatttgatatattaccccatctagtggcattctgttgcttacatctgctgtaatgctgttgctacctaatgtggttgtaattatttctgtggaaaatgcaggaatgccccttgggaacgtataagaacgttactggatcttctaaatctctgtgcgttcaatgccctccagatgaactccctcatcgtgcgatttacacaagtgtccgaggtaattctttctctatgcagtttttgatgtgatatagcggaaatgcagccaaggacaaaattttaacttgtttatctaatttctaaatcaattaggtatcataaatctactgtttttagatttatcttttgtttttctcctttgtaacatgcagcttcatctatattactttgctattggccttgcatttacttaagtttcaatactgttgtgcaagcttcagaagatgctttaactttgcttgaacattctaatctctaacctagcttatgtttgacaggaggtgcttatgaaaccccatgcccatacaaatgtgtatcagatagatatcgtatgcctcactgttatactgctctggaagagttgatatacacttttgggggaccttggttatttggcctattactttcaggtcttcttgttttgttagctcttgttttaagtgttgccaggatgaaatttgttggtactgatgagttacctgggcccgcaccaactcaacaaggatcccaaattgatcattcttttcctttcctagaatctctaaatgaggtattttatacaccgcttccgtcatgttgtgtgccatatgaccatcatgggttctcatagaagttttttttgtttgttgcaggtcttggaaactaatagggctgaggaatcgcatgggcatgtacacaggatgtatttcatgggccccaacaccttcagtgaaccttggcatctcccacacaccccaccagaacagatttctgagattgtgtatgtgtacatgccctcacatagatctaactactacctgaacaaattcaatgtatcttctattttggtaattgcatatgttttatccgtgttacttttgcatgcaggtatgaggatgcatttaaccgatttgtcgatgagataaacactcttgcagcttaccagtggtgggaaggatcgattcacagtatcctctgtgtacttgcataccccttggcctggtcatggcaacagttccgtaggagaaagaaattgcaaagacttcgtgaatttgttcgctctgagtatgaccattcgtgcttacgttcttgccgttcacgtgcgctttatgaagggctcaaggtttgtagttctgttttaactatttctagattgctaccacatgcttatctctgaggtcatccttccctagcctaagaactgaaatcctttgatgtttcactctatgattttttttttttacacttcaatagcagagtacctactgcatgcttctataactgaatgctatcagaggattggagtgcaaagttaccagtcatagaagttgtatatcttaaatatgccatattgcatgaataagagttgtgttgaatgtataattagaaaataatatctataattagaaaatatcatgcatggttggttgaaccatttgtgagtgactctgctataaatctttcatgctcttttccattttggttctttggacaattatgaactcattacatgtttttaccttcccagaattgattatatcttggaataaaattattaaatgaatgtcatgtttgatagtgttgtgatgcttggaattaacatctgcctacttcataaatctttaggtgactgcaactcctgatcttatgctgggctatttagatttcttccttgggggagatgaaaaaaggcctgatcttccacctcgtcttcgccaaaggtttccaatgtgcttgatctttggaggtgatggaagttacatggctccattttcactccatagtgatagtgtactcactagccttatgagtcaggtatgattttaagatctttctaactgcattagttatgttctgaagctttttcttatacttctataacactattttaaacattacaggctgttccctcatcgatatggcaccgtcttgtagctggattgaatgcccagttgcgtttggttcgacgtggaagtctcagaggaacatttcttcctgtcctcgactggcttgaaacccatgctaatccctctctgggtgtgaatggtgttcgtgttgatcttgcctggttccaagctacagcattagggtattgccaacttggtcttgtcgtttatgctgttgaagaaccaatgagtgcagagcttgatggtagccctagaattaaaatagagcaacattcactgtgagttactatttttattcgtcctgatcatttgttttctttccctttttcattactatttattcctaatgacttgttgcatcatacagaacacagaacatgcatgctgatactcaactaggccattctagaattaaggaagctcttatgcgcaaaaggatcacaggcggaattcttgatagtaatagcttaaggacgcttaaagacaggagagatttgttttacccgttttctctcatcttgcacaacactaaaccagttggccatcaggtttttctctgccattattacataagactcttatgataaaattcctggcatttgcacttaccataattctcttgttcttaaatgcaggatcttgttggcttagtaatctcaatattgcttctcgcagattttagcttagtgttactgacttttctccagctatattcatactctatggccgatgttctcttagttttatttgttcttccacttgggatactatcaccttttcctgctggaataaatgctctttttagtcatggaccacggcgatcagcaggccttgctcgtgtgtatgcattatggaacattacttcactggtcaatgttgtaagtatgctatgtccatctgcatttcattgttgcatgcttatttgtctatattgtattttgagatcctaagacggctgtagttagtgtctgccattattcactggttttagctttccccgattttgttcttattgttgatttatcttcataatcctcttcccatgatattcaggttgtggcttttgcttgcggccttgtacactacaagtcatcaaccaaaagacatcctagtacgcagccatggaaccttggaacgtaagtgccatttccctttgcagttatatacaatacaactaaatgcaattaggatatggatgcatttttttcccctttgccttgtcttgatcctcctttcatctcatcggcgcattttcaattctatcacagggatgaaagtggctggtggctcttccctactggactcatgttgctgaaatgcatccaagctaggcttgtcgattggcatgtggctaatttagagattcaagaccgcgcagtatatagcaatgacccaagcatattttggcagtcatgacacttggcattactactactaaaggttcttttgggagctttttacaactcaattttttgggagttgataaaaggaagggtgggggtactcaaagcacggcctttctttattgacctttggccgaagaagaagcaactactacagtgggttatagatgcaatttccgcgtccctctgctaatcatatgtgcagtcacaaccaacctgtattttggtgttgtatatataaaaaaggtgtacttgatccattatttgtaggatttagacaccatagagtttataaacagttcccaagctaactgaagagatgtgattttgttgttgttgctactgctcttgttgtcggtgctatgtactttgcctctagatgttgagctgggcaaggcaggcattgactgtgaaacttgtactacctgattggataacacaagtgctaacttggctgatggttttcatccctcatcattaacccaatgcaatgctgataccaccgagttgtgacaatgtgttcgctcttggatgtgcaatgcgcgtggatgtgctatgtgtggttagtgtgttaatcttgttataaacgtgtgttctgacttgtgagtgtggtatatcaatctcttataagatgttattgttggaaatttggtcacaattcagcatattttaatccaaaatattaagataataaacatgacgcttataggatatgatctagtgcaattgataaattggagcatcatgaacatgtttaatactccctccgtttcaaaatgtttgacaccgttgattttttagtacgtgtttgaccattcgtcttattcaaaaaattaagtaattatttattcttttcatatcatttgatttattgttaaatatacttttatgtacacatatagttttacatatttcacaaatttttctaataagacgaacggttaaacatgtgctaaaaagtcaacggcgtcaaacattttaaaacggagggagtataaaataagcatcaccatacacaagacaatgcaataacattgcgactgatagtagcagaaaatggagaaccaacagtaacggtaaaaggttatacccaagaatggccaaaatggagaatcaacggtaacagtaaaataaaatgttatactccgagaatggctctccgctggagtttgagaaagtattgcatccccgagaatggccaaaatggataaccaatggtaatagtaaaaggttatactccgagaatggccctccgttggagtttgccaaagtattgcatctgttgatgttgttagagtttgagaaagtattgtaccagttggtgttgtcgttcccattcacctccttgtctccggtgttctccgtggacatgttggtgaaggcgcagatgaacaggagcagtcgcatgttggtgaaggtgcagatgaataggagcagtcgcgcgtagtgctcccaaaaacttgagcgcccgcctacccgtgcaagaacgtaagcggacgcagttccggaggtatgcgaaggtagcacaggaacagaagaacatccggaaagaaagtgcgagagttggaggaagaacagaagtgcaagctccctctgttcgtcccgttagcgaaagatttgtagcgcatgcgagagttcattcagagaattcaatcaacgcgattaacttgagccgttagcgaaggatttgtagcgcatgcgagagttacattcagagaattcaatccacgcgattaacccgagttaaagcgattaatcaccaatccgttacgtgagttaatacgcgcgattaatcaccgatccacgacttaatacaccggatttaatcaccgtccgttacaaaacgagagagagagagcagccgccttgcccagcccgctcggcgcgcgtgcgtgtggctgactgcccaccatctcaaccggtcacacagagactctctgctagcttcatttttaagttgaggcctctacgcttagttttccaatgtggtattaatacccatagcactaaatgtaggcaatggaatttattaggatttaattgggcctagcctattaatctaacagttatggcatatcaatctctcgtctagattcacttatgtacatatgaattttaacacatcaaatacacataaatccgcatgaacctatccaagacccaaaacttcttataagtaaaacagaggaagtaaaaattaaggcatgctaaaaacggatgaagcctcgattgatagcgatcagtatacatatattctacaatttccttcatttcaaattataagacatttcagattttgaatagattcatgcgcggatcaatatatgtgctccatatatatgtaaattcatatgtatgttaatgaatgtagacaaggattaagaggctaaaacgttttataatatgaaattgaggctgcatttttatttgttctagtcccatattttggttttgtggtttaagtaaaaaaaattatacttaatcatcaaattttaattttaaaaatttatatagtgtaacattgtaagatttaggtttttggattaaaaaaaaacttctatactagcagtaattgctagcataggatttttttgacacaagtagtaatactgccatttttaagtgtaactgtgccttttttttttccaaagtttgaccgtctatcttatttaaaattttttatgtttagtattttttactattattagatgataaaatatgaataaaactttatacgtgacttattattttttatttttataatttttagataagaggaacaatcaaacattatatatagaaacccacacacttaaaataggacggagaaagccgtactaattcactacatcggcggtttgtttagcaatttgaggaaaggggattgagagtttacacgagggaggaattccctcccaattccacccttacctcaatttcccatcccaattccacccttacctcaatttcccatccccatccctgttccaccaaaattctgatgtctccaaaccaaataaaacaattaatatctcacccctcacccaatccctcctaaggctgtgttcgctagagcctattcccaaccagaacagtgcacacagaaaacggaacggtctattaacgcgtgattaattaagtattagctattttttttttcaaaaatagattaatataattttttaagcaactttcatatggaaacattttgaaaaaacgcactatttaactgtttgaaaagcgtgcgcgcagaaaacgaggaagatgagtattccctctggtttcattttaattgacgttttggacaatgacacggtctacaagatacatttttgaccttatttttctattataatatatataataaataaatgcatgtttacttttattatagtattttaaaagacaaatctatatatgttgttctagttcctttaaactaaatatttttaaaagttattgatagtctaagttataaaagtttgacctcaaccttattcaaaacgttaattaatatgaaaccggagggagtaggtaactaggctggctgtgtccctagcacgcaaaacaagcagtgtttagcgcatgcttaatcaagtactctagctaaaacaaattttaaaaataaattaatgtgattttttagagtaatattcctataaaaaaacttttgtaaaaaatacatcatttattagtttaaaaaatatacgcgtgaaaaacgagaaaggtgagttgagaaagtgaagataataagaactcagtctaaaactccctcaaaactaactggccgcggctgtaaagaaaaaagaaaggaaaaattactacacctagtccgaccccgaccgcgtctcgtcggttccccgccacaagcccacaaatattatgcgagagagagagcacccgttaccgcctccctcacctcacgctgacgatcgccaccgcctcccccgcaaaaccgtcgcgccgactcactctcgccgccgccgccgccgccgccgcgagatccgatcgccatgacgatctcctagtccctcgcctcccgcctcggccccggcggccccacgaggtggagcccctacgcccgggcccccgatcccggccacggggcggggaggagctccgttcctcccggtggtggtggtaactcccgccctcccctccgcgtcgcccccgccacggcgaggctcctcggccaccccgcgcggaagggggccgcggcgccgcccggatcgaggtgccgcgcggaggcggaggcggaggccacagccgcctccgatgctgcctgccctaacccgccgcggcgtgggtgcgaagagacgaacccgaacccgaaccctaagagaaaccctaagccggcggagagaggggaggagccgcccgtccgcgccgtcggctgcggcggattcgccttcctctgcgccctcgctggccacaccgaggtgattattgtctccccccactcaactattttctgcgatgaatttgcgtcgattctataacctaatcatatgatgagtgaggattttgctatattctatataacctaatcatctgacgagtgaggaatttggtcgattctataacctaatcatctgatgagtgaggaatttgctcgattctataacctaatcatctgatgagtgaggaatttgctcgattctataacctaatcatctgattgagaggaatttgcgtcgattctataacctaatcttctgatgagtaattgtccaacgctgcaggctatcagtgggatctctctgcctgtgggttccgacaagctttactccggcagcgctgacggctccgtccgcgtctgggactgcaactctggcaaggtagctgggctctccgctctcggcactcccttcaggctctttacgcacgattcaagttgagtaaattcaagttgggggttgcatctgcgtcgattcctccgttgattgtggcggtctttgaagtgcttccatgagatcaattggggagtactatctgattgcttcctgtggtcagacatattggtaccaaatcagttttttctttgcaagattggggttatcggcatgccggaccgaattgttacgggaatcttttcgcctgcttgtgtactgttgatcagtatatcagggtcagtttgcgagcaaggcaatgaggctggtttggctgataagcaaggggctctctggaattacattacagttctctctggctgatggtccatacatggttttgtcaaaaaaaaagtagtgaaaaaaagaaagagaaagtaaaaaaaaaagaaaaaaaaagatgtgagatgattgatgattatattttcttggaaagagaagactgaacaaggaggaaaagataggtgtctggctgataaaaaaattctaatatttattacattgcattgttttcttaatgtttctgtcatagtgcgttgatgccatcaagatgggaggcaagattggttgcatgattacccatggcccatggatatttgttggaatcacgaagtccgtggaggtaatattttaatttcgttgatttttttttgtgggagtagtccattttgtgttacatattgcgatgttactattgtgcattgaactgttgatattgatccctacaatgaattgtaggcatggaacacacaaacagggatgaagtccagtctccgtgaaccttctggtctggtttgttccatgactatcaaggatgagatgttgtttgctggtaccggagatggtcgcatcatggcttggaaaattcctgacaagaagggtgactctggaccagtggcaatcctcagtggccatgagcgccaagtgatttcgctcggtgtctcagtaacaaggctttactctggctcacttgacaagaccatcaaagtatggtaatgctgcaaaacttgtgcaaacttgtgcttctgtgttggctactaaggagtattatgttagtactagtatttgaccataaaactctattcatcaggtatgggaccttaaaactctgcagtgtgtccaaacactctctgagcacaaagctgctgtaacatctgtgctttgttgggatgaaaaactattatcttgctctctggacaagactgtaaagatctgggctgcttcaaagtctggagaccttcaagtgatatatacccattctgaggagcatgtaagttctactctggcctgcatcctctgtagcaatggttgcacaagttttatagcattgaaatttcaggcacaaatttatttagctacttaaccagttaaaatagtcaataagatgacatttttgtgtatctaaactgcatattaggttgacatgttttttgaccggagggagtactattgtgcgtattttcttgtgttgaacattactattctccaacactcaaatagtttctggctgctaaatcacttagggcatttttatttcagatgatgtagtaactaaattaaacttagtttaagagttaagtcacattactttctgtttttaaactgcatttcaatgctaatgcagttatactatgttgaatgggagcactacgtagcttttgcacaattaaaaaaaagacactatgttgaaaccttctttttttggggtggtcgtgcctagcaccaaatatggtatataaactgcactgtttactatctactttacttttctatcttttatttatataaagtttttcttggcgtgttctatgcattgagcagctccttcctgttgtcgaatggcagcaaaatcccttcataagcacaattagttctcttaattgacttggaagatctttgctcaagagtagttttgttgccgcaattggtcttgtgttatttatgtctattaatgagtccatcttcattcagtcaagcaagggtaccttcaatatgtaggatttcagtgttctagacttattctgtactgtatgtaggggtggaaacgagccgagccggctcggcttgcagtggctcgcaaaaaactaggcttggcttggctcggcttggttagggaaacaagctaaaacttaagctcggctcggctcgtttcctggctcgagccagctcgagctggcttgcaagccttcctgttgaaacacctcttcatatatattttgtaattattaaaaaaagtaaaaacaaatcatcaacatgtaaaatttaaataagtttttatattcaattcttcaaaatcttgatgataaatttcaagttgacaaataataacactatataaagtaaaataatcaatataaacacacgatggcctaggctcgcgagctaaaacaagcggctcgcgagctagctcggctcagctcatttcagcaacgagctaaaaaggaggcttgggcttggcttgtttggcttacgagctgagccaagccaaccaagctcgagccaagcccgagctgagctcacgagcccgagctttttttccacccctaactgtatgggtggttcagtgttcttggttagctggtagtgaagagtgaacttataatgatcagcatatttcattgtggcatcaagaccaaggagagaccctctacccgttttctatttaatccttgtaattaatctccatattaatcggcttggagaaacgaaacgacgttactgccgctgcatgattgcacaggcaaggaatgttccatgctgcatgcagctcgaaaatcgcatggcctactcgatctccgtgataactagttaatccatccaacatgcacatgctaccagcgttaatatgctgatcaaatcggaatatctccactttcgttatgcgctgatcattatggaatggagggagtaataatttggttggctggtagtgaagagtgaacttaaagtaataaggactaaacatccgcttgggaaactttagaaggctgctcagttcatctggttcccttgaaagagtatcaataagggagtatgatgtaattgaggaagctattgatggaagtgtctcaggctctcagcaacaattgaatgatttgtacaatctgcatcaaagcatgaacaaatggggtcgtgaattgtcaattcttagttctggatattcttcttgcttttctgcccagtattgctaccaaccctctatatccaagtattctttaatccttttcaagatactgctctagaatctgttgatcgctttgggtgtttttgttgtggtgcttgttgtggagaaacattctgtatttattgtggtgcatggttatggaaaccatgtaagttcaatgctagtgtccagtttgcaagttcagttttctttggatgagaatgctctgcttctgaaccttactcctttcaacagtcttcagttgttcccctgttgctaaacatgcacttctgttgcagggagtacgcacgctctttggcatgcaccgtgttggaaagacgccagttctgttctgctccctccacaacagcaactgcatacgtctgttcgacctgccatcgtaagtgcataaaaaatctgtaggccatcgaagaacgtactgctcccttactggaagtctcaaaaatggtttggtcttggtctttcaggttcgacgagatgggcaagcttttctccaagaaggaagtgaggaccatcgagctcgcagccggcggcctcctcttcaccggcgacggcgccggcgagctgaaggtgtggaggtgggcgcccgaggaggagcctgcaaccccggcgctcgtgaaatcatcaatgtagaagcactgtagcgtcgttgagtaaagatagcagctcctgcgaattgtcgtgagctccatctcagaatccatgtagtaataacttatgacaatgctgatgtaaatatatttgcccaatcctgaggcctgattagcaatattatgttccattctcccatgcactgtctccattaattgatgcttgagttgcgtgccataccaagcctctacttcgaatgtccacaaatactctgaatgtacgacgacgaccattcattttactttagaaaaatatatataaatatgatttttttaaggtataaatattatttattttattgtgcctggtggttttatcataaaaaactataatattaacttacaccttcacatatttatagttttatactaaatttttaaataagataaattattaaacgttatatgataaatcacggtatcatatattcattacaggggagtatatataaatatgattattttaaggtataaatattatttattttattgtgactggttttatcataaaaaaatatagtattaacttacaccttcacatatttacaatatttacagttttatactaaatttttaaataagataaattattaaacgttgtatgataaatcatggtatcatatattcattacggaggtaatccatccgtttcaggttataagacgttttgactttggttaaagtcaaactactctgagcttgactaattatgtagaaaaaaatagtaatatttacaacactagcatagttttattataaatatataattgaataaatttttataatatactataaaaaatgtctgtgcgttgcaacgggtgaagtctattttaatcctattattgttatatggtttagttaagatgaaattcactgtgggagttcgcttggatatatatattttaagaaaatcagttaggagtccgatcgtctcaagttagcatgcacgttttttttaaacatatttcttatatgattccttctgaattatcaaaagtgaacgatagaactgactcaaatatggatatgtattttcaaaagcaaacgaacttaaaaaccgactcatacacggatgacgtaaaaaaatactggcaaaaacatcttcaatttttataattgtagagatttgtcttaggttaaaaatattactacttttttctataaaattaatcaaacctagagtagtttgactttgaccaaagtcaaaaacgtcatataacctgaaatggagggactagtatgtcattttcaacatttgaagtttgtacacaaatataagcatttcttatccaacttcatcttatgattttttgtatttactagcttattgcacttacgttgcaaccgggttttaatttaagaaaattattatcatatcttaattgttgtaaacatttgttacttacatgtgaaccttgttagctccacagttttttcctcccacaaaagtagttggtgggagtagttgacatgtgggtaaggcctggtttagttcccaaaacaaaaacttttcacccatcacatcgaatgtttgaacacatgcatagagtattaaatgtggacgaaaaaaaacaaattacacagttcgtcaggaaattgcgagactaatcttttaaacgtaatcgcgccatgatttgacaatgtggtgttatagtaaacatttactaatgacggattaattagtcttaataaattcgtctcgcagtttcttagcggaatctataatttgttttgttattagactacgtttaatactttaaatgtatatccgtatatttgatgtgacaaccaaacctaaaaattttccccaactaaacaaagcctaaacctcacatgtcgttttttttttaaaaaaaagaagatgggagttggcactaacactactctcttttataaggagtatggattgctacattgccgatgtatcaaaatagttttacctcagtcttaatctcttctaaaattgctataaatgattacatttgaactactagaaatgattgtgtttgtagatgaagggattgctctaccgatgcatacaaatctctgactgctagaaatgattatattaatttgctaaaaatgattgtatttgtagatgaagggagtacgctaccattataccaatacatacaaatctccactaaaactgctagaaatgattatatatttgtagatgaaggaatactctacctatgcacgcaagaaatggcatgctttggcaatgtggaccgtacactttgcaggtgcagtagcagcaacaccaaccgtgtggagctctcaaaatggctagacaaactaaagagcctctaattaatacaaccaatgttgtgtaacatcgctagctgctgcgttgctgccgaactcccattgaccccagccacatattaatctgacgctatgaaacaaacacgcccacagatcacacccacaaagcgatgtctttatctgttaatgacgcaaaggatcgattaattgtcgccgacatgatccatctcgtcgctgttcttgtaaacaaatgcaattaagtagcaagagtttgcatgttttcttgctcttgcttgtacggtcaaaatgttagtggtagtttattgcttgaaaaagaaagaatatttggatgttaactcgtacaatcaaacgataggctctagcctgggattgcgtataatcatggtaactaagtaataatctatgaccactggtatcttttatcgaggtcaactatatacggggctagcttatcacgtctggagaaaagaaaaacccaatgttgcttagctttgctggagtaaatctctctatatttgtgctcgaaaagtcaacgagcaaatggatgcatgtggtaaatgctgagcaaataagcaaaaagtcttgggtcaactattattttcttaattgcacagcacacaccactatacacgtaacaccacactcacaccccgcgaatgcatcccctaacacatactttaagagacggaaaccattaatacatcgttaatttcaaagtcagcgttgaaagctacttgcatgtgcgtaatatttgcggacattaagatttaaaccctggtgtatggagtcatatatccacgactccagcgccgccacaccacttatgcttccccttggggtcaactattatggttagcagccgacttgcaaatgatcattgccgatttagttacgtaacagccatgtagtttaatgagattcccagtaacatctacaagaatctcgtccatgctcatcatagatagagatgcatttttcaacccgtgtgaaacaaaggtctttgtttggaaggtgaaagtttcaaacataaaaatgtagaattgttttttctaacatgcacagtcctgcttataagaaacatatgcgctgctctcattaaatatgtgatcctcactaaatacgtggccacttattggatttgacaataagccccgtgcaaaggtttgaacacaaagataggatgcaacatgcatgtcatgagtttgaaaacaacggtcatgcaaatttttatcgactatgattaaagtttaacaataggatatgtggcgaaacaatgtgtctctatctattggtgtctggttttattttctcatatctattttttaatatataacaccgttgatttttaattgaccattcatcttatttattttttttgcaaatataaaaatatttgataataaattaagtcacaataaaataaataataattacattttttgaataagacgaatagtcaaatataatgtatttaaaaaatcaacgacgtcacacattaaaaaacagagtgaatactttaaaactacatactttgtaataatttattagctctttaaagtaaaggatggatttctcattatattttaaaaagtattctaccgcaataatgcacccacaaatttaccactatcaagtgtgttgtttctaaaatgtaatatttttttaatcaccaatcaatttagtctttgtactatgaattagggaaaaggagacccgaagtgcgggaaaaagtacattaacatgttacagcgatacgtctactataagtggcagttgtacatttttacaaacaaaggaacatgcgttaagttgtattactagtttcatcatcttcttttttattgcttgtaacccccatctcatccttccatcatacaagatgcgaggaggagctacacacttttgttttcaagtcacagtaactacttatcaacagtaagttctcgacaacattatgtttatttcattttttgactaaagttaaccgctgtaactaattaattaattaattaattaattaggcaacaattaattaattaattaatcaatcagttgaagatgtcctggccaggggagagcagcttcttggggtcgtacttgtccttcctctgcacgaagcgatcccatttggcgccaaaatgcctcacccagtcgccgcggctgtcgtagtgcgccaggtacgccttgtacccgatcccggcgaggtcgcagaacctcagtatcctcctgttctgcgcctccagcgccgccacgtcgttcgccaccgccgagaacagcagcgacaccacgtagaacacctcctcctccccctccggcgtcaccgccgacatcgccgcatcccacctacacccacccacatattgtacagtgcatcgtgacgatgatgatcttcgagaaaagtgacaatgtcggcgataatgtcaatgtgttgtgtttacttggatttgttgacggggtagatgatgagaggtccggcgatgtcggtggccgtctggaggatgcccttgaagacgccgcggtcgaagtcggcgatgcgggagcccgggacgaacaggttgagccacgggtgcgggacgcgccatagcccggccttctcgagggcctcctcctcgccgtacacccggtcgaggaactcctcgtaggtgacgtcgcgggagaaggagaacccctcctcgaagtggagatcgccgagcgccgccgccaccgccgcgtccacggacgacggcgtcgcgttcgcggcgtagttgagcgtcgcctcgatgctgtacacggcggtggcgttcctcgccgcggcgagcgcgacgacgcgcgcggcgtcggcgtcggagaagaacccgccggagctcttgagcgccacggcgaggccgcggccggcaaggtacaccgcgccctccacgtagctccatggcccgtgcgacccgtcgggccgcgccgcgacgaggcgctcctggtcggcggagaaggcggcgaagtcggcgtacacgaggcgcacccaccgcgcccgcgccggcgccggctcgacggcgacgcgcgcgcgcgtgatcacgccgaactggcccagcccgcccaggacggcgtcgaacaggtccgagttgaccgccttggagcacgtcaccgtctcgccatgccctgcatgcgccccgagtcaacgtcgtccatgtaaactttcaattaatcgcggaaattatttcaaagtcaaccccccttgttgcgagccgccaaatgtacttatcaaagacgtcgccggccaaccagccagccatggccggcgcagctagcattgagtgctggacactaacttgtacccactaattataagtaacctttaattatcatttaagaacaccgtattaaaaacacgaatattagggaatgacctaatatcaaattattagaaggggcaaggcttcaaaccaaaatcgtctagcccaccatcttgtggagctagccggaaggccctgggaggaaaaaatatgtatgtgggtaacaagattaaaattagttagttaacaatatgtaaaaaaaattctaattatgcatgtggacacattatttttgaacagattttttaaaaataatgaaaataatttacatctcctacctctattaatagatgtgtaggtaataaattagataaacataaaactcgaggttatgagacaaatgcatgtatcccttttgatcacagcatcctacttaaataccgaatagaaaacacgtagaataattctataggaatatcacatttcactctgatgtagtatagtatatttaaattttataaatgttgattgcacggttagttcttgatcacgaggtttgtatgtgtgaggattaattagctagcaaaaggagttgcagtgaggtgtacgtaattagctagctagaggcaggcggttgcttgctgtgattaccggtgatgacgtcgagctcgagcacgttggagatctgtggcccgtgccggtaagtctgcccgctgacgccggcgttggagagggtgccgccgacggtgaggtggaggtagtccgtccacgaccgcggcgccacgccgcgcgccagcgcggcgcggagcacgtcgacccacagctgctcgccgccggcgtccacgtacgcgccgtccgccgacacgttgatccgcggcgcgccgccgccgcccatggactgcatgtggacgacgacgccgccggcggcgagggcctggcccatggtggagtggccgcggccgcggaacgagacggtgaacggccgccccggggcggcgtaggcggcgcgcaggagctccgccacgtcgccgggggagcccgggaacagcacggccgccggcagcgccgccgtgatgttgccgaagtccatcgacgccggcacggtggcgttcgggtcggtccggagcttgccggacgcggcgaggtcgccggggaacgggagaggcgccgccgccgccaacggaacgccgccgccggcgccatgcgcggcgagtgcatgggaggaggcgatcagcgcggcgatcagcaggtaaatcgccgccattagcggcgcgtttaagctcgctaataccactttaattaatccgcgagatcgatcgatgagagtgtttggtaattagggattaataagggtgttgtgctcttgcacttgaacttgcacacctatatatatagatagatgatctatctaattatgcgtgtacatttatatccaggagattgttgccaaaattaaagcattaaatcacaatgggattctttgacgtataggtgatcttcagtttctatttctactgttgaccagagaaaaaaaaagtaatatgtatacgtgttgattgccgtagaatactggtatatataccacgtatttttacgttacatgtacatatttttaggtgtacacaattaatatttagctagatgtggatttggcagtatatgtacgtgtagttaatgtagtaaatatgtgcaataatgcactgaatatgatcgatgatcacattaatttaattttgtggtcttgtattaataggtatatatgactgaacattaattaattatttgtagaccagatacatcaaagtccttgtattaattgaaggtgccatatatactgcacaaataatttttctttgaaaaagcaaggagatagaataatatggtactaaaatttaattgcactgactttttttaagctttcatgtcactttaagtcatcttaacattcataagcaacgctacagaaaaggacacaaaattaacaacaattccatacctgattgtgacatatcctagtcaacaagtgatcatttattagatttaattacctgaggcaagaaaatgtgctcaaaatattccagaattgcagtcagttgggccgcctgttggatgacattttttttcagagactaatgatctggggtgttaacaagcaaatctgagtaaacattaattatatatagccattgctattaacgtttagttcatatacttgcctctggttttgcaaatgtactaagatgtatgactgcgtgtgcatgacacactcttttttgtccatttcagtaaaattaagaaaagaacatgttgatgactaggtgtggaattaaattgctagctgtttgactcttctgctgttttctcctagtaaatacttaacctacggtagatgtaaagaaaacacatattactttagcagagacgacatggatgtcaatttaattgatcaacactacataacaacatgtaatcgtaaaaagaacatcggttcttcggaagaatttcctacttggaattttggtgagcactcgatgacttaactattaagtgttactgatctgaaaaggacaaaataatatataggtcccagatcccttctgtaattctatatatatctagcatttttatgactttacatcactatcttttatagaatttattatattatcctcacaaaatttcgcaatatcataaacataaacaaaatcgtcaaatctagagtggtgtagttttaatatgtccaacttgggtaatttttacaaatataactagcacaaattaagtttatataactgttggtttgtactgatcaagcgttaaagataaaaggaaaaatatgtttagtgtgaaaatatatcttctagatgatgtgtgaagtgacatgaccaggttacacgatacacacgcgtgcgtgacgttttcataatattggaaacttctgaaccatgcatgtgaaaatttggtttaatttgcactaatttgacactttttaaagacattgctcccttgggtcgacagatgtatatgcaagtccccatcgatcagctaattagaacacatgcatgccaaagtacacgacaagggtttaattagatcaacatccacacgctgcaagttgcaacacgtcgtatctaatcaagttatttttagttatgccttacgttgcagtctgatcgatcgtgttttgttgaatgttgacccatattattccccttttgaatgtatgacatggttaatttttaatatacgtttgatgatttgtgttgttaaaataattagtgtaaatatatatgaatataagacaaaattaaattaccaataaaacaaatcataataaaaatagctatataattttttagtaagataaaatagtttgtcaaaaatcgacaatgttatatatgaaaaaacttacagaatactccctccgtccctaaatatttgacgccgttgattttttaaaacatgtttgaccgttcatcttatttaaaattttttaagtaattattaattctttttctatcatttgattcattgttaaatgtactactactactcaagtttttaaataatactcatagaagtttttgaataagacaaacgcttaaacatgtttaaaaaaattaacggcgtcaaatatttagaaaataagggagtataattaattatatactccatgaatacctgatcgatcgatgcacactgatcgatcgactggcgtatacgtgctgcctgcgtgtgtatgatgatcttggaaacatacctctcatcacgcgcaccgaagcaaattaagcagaagcagtagcgtgtcaggctatatagcttcctctgaatttctccatgatatgtacatgcatgtatgcatctgccaatgtaagctagctacatacaatgctaggtaaccaaccgtacgtgtgtcacccatgaagtttttttaggtcatcttctgccgtatttcagtcatctcttgtgcctgaagttttcagtcatcttctgcctaacgtgcgtgtcctcctagccgagatggtggattgattctgtggtcatagatcttagttgtttctcatgttggtgggatcagcatcctccaacatggcaacatatatatgcagtaggtttgtgcatcgaaagattttgtttctcgaaggttatattaaagatcttggttgaccatgaagggaaatgtagtaactttgatgaattaatggtacgattcgattatgatatatttgtagtatatttgtgcaatcgactttgtctttttacaaagactagtaatttttttttgcacattacaatggatcggaggtgtgatggtggagttgtgggtgtatgcatgactttatccatcataatttaaattctgctatccacgaatactatgcacacgtaaagtacgttttcaataggaattcaatgggactatggatatgtgagtgtgtgttaaagggtgcactcgtggatgtgtgagtgtggtctgtgtgcgtgtacgttaatacactacccgtgtaataaaaaaagaaaagtgttgatgtaaaatccagcctagttggcttaggtgagaaaatggaggatcgattttcatgtgggaatacctaggtttaggcctgttttcacgtgggagtgggttagtttttttataggggtggttgcacgctatggttgatggttaggaggggttaacatgtgaaattcccttttatcgtagcagaggtttatgattgattttctattatttaatatatcgttataattactatttaattagttaggtcatcaatttatcggatacagggagcaactttgatgcgtacgttacttgactagtggagttgagcattactatgtgtatgtgtccatgatggtgtgtgcatctttcatataattgaaaaaaaaattaatatgatcctacggaatatgatagctatatatctaagctaggcaaacgccgggttagataaacgtccctaagcttggtcatgttatactatagttatatacctagtctagtttaattacttcctccatcgtaaaataagtgaatttctagttttttctttaagtcaaactatcataaagttgaattatagcaatcttatactagataagagtattaagtatttaccattctaattaaatgagtaaactataaaattatatttcggatttaatgatgctcattcttttttttcggggaagagggaatatatcactcaatcataatgttctcccgcactaaatgcgagataaaattacaactttcccccaaccaaaatccagagaaggattcagctctagccttatttgccaaataatggctgataatattcttacttcggcatattttattaacagagataaccctctccccaaccaagagcaactttggtcattcgatatcctattttttttttaaatgtgacaaaaccaggatatacacatatttgggtctgagggagtatatatgtcatagaactcaaaaaggaaaaaaaaatacatatatcgatccatcgagtttataaagtgtgttattttttcatgacaagtttgcaaacactggtactagttgtattaattaattaatcaaatttgcattatcttacaacggggattgagtcgatcgaaggcagttacgtaacgaaatgttgaaaacagtgtgtggcgtatacgtacggcgcctacaagtgtacactagctagaagggcacagtgtcctagatcctctcttctcccaacttaaacagatcttgcagtatctttgcaagatattgatgaggacgataagagcaagtttaatagtatagccatctactaactccaattcatctatagccagtctaatagctcattcgtataataggtacatactacactattaatatctgatcccacctgttatacacacactgcgtcttggagttcgtgctacagctggctacaaatctatagcccgatgctcttctctctccttatttatcttcttaaaatcctgctattgtacctgctctaagcatgcatggcgatgaatcggagaccaggaatgcaagcaagctagctagacttcgatcagctcaattatattggccgtacatatatgcagacatcatcgtcgatatggtggttacattaatttgtgctgttctgcagtttgatcaagacttggttgaccccgttttaaatgtgaaattttgtacgtctgtgccgaatttttttagataatttgcgcctcaatgtacacttgcttcacaaattcgagttagtctctgtactttggtggccaaatccagggaatagtggctgactaataagtgtctcttcttgagttctttcctagcatatactccagatgacttaattaggtttagctcatgtttttttaacttttagtctatgttgcgatgcgctcaaatctttttttatacacatctaatcagtggcggagccaagataaaattatagtgagggcttctcagccttttaggccttctaataatctcagacaaaatctattttagccctcttccaatagatatatggatttaaattttaggggggtgttaatagaggctctaatgattcatta

SEQ ID NO: 51234 - DNA, 3966 bp, Oryza sativa
ccccccagcccccacgctgcctccgccactgcatctaatgcatatgttttataccaaactttcaataaaaaaagaaataaagttttttttcttcaaaatcctctggaatacttgtcttgaaatcttgggcgcactccaggaaaaaagatggagtaggaccaaatcagttctttttactcaaaacttaatttatggctatttgattgtctcgagatttgggcatacgagagcttgcttcgctagccagctggtatacaaaatacatataagttgcattctaattactatagttacatgtgaaagctttaaaaaactaacggatattgtatagctactctatttgtaagttaaagtgccttggaggtaaaggttgttcaaaacttaaaaaatatgctccctttgttcttagcttttcttttttaaaaaagtcaaagaaaatgatttgtgtttccagcctctatcgttaggcaatcaatttagttcggactttaatttaaaatatttaaaagatacgaggttatgtgacaagggaaagcatcctatatgcacataagctttctcatgtatatatcgtgcacatcaactaataaatatcataaaatattcttaaaaaatatacatatactttcaatagtactacatatgcgtatagtgtcacatcttcaaattcattatacacagagagagaaagaattctgacatatttatagtcttaaaactgtcaaaattccttttttaggctggaatataatgaacttaaggttaaaactttacacatagatgtaatactattgaaagtatatacatattttttttaatttattgtgatatttgttagttgctatgcaatatgcataagaagcttgtgtacacataatacatatacttccatgtgacaaaccccatctcccttcaaagaaatgagttgaactaataaaaagacatcacataaatttctataacagaagtttataggaactagctacgtacaccacctaaagtaggacgaaagactcttgatcatagatttattgcaccactgcataaagtatcctgcaaccctgtaataacaccatagatccagagtgaaaccaggtagaagaaatggatataacatttattgttggatagatcattttaggatgcatgcaaagtcgctaatatactgaatttttttgagagatttgaaaacaatgttagtagatttgtcaaaaaaaaatctttgatttacttgtacttttatttttttttatgaatatatgaataggaaaacaatgaaccaatgatcaatcattctcgctggaaaccttatatatgttctgaacaagtaaaaaattaatgcagagtatgtaagatagggagaaactattgaagcaattacttttctctgcagagtatgtaaaaatgatttttggcatctaccattcagatccacatgcaagcctgtgacttgtaaattaaaacgactgaggcgttttaaacttaacttcgcttgatttttcaactatacttaattgaggacctccattgttgtgacacgtgtataattacacgtagccgtccaatgtcgtcatttgggagattcgctgaggtatcgaagtctcttgactggctccaaagatacgccttcatctgtatctcccatgatgacgaactactaagagataattaagctaggctaatcagtgcctactaaatttaattgacgtcctggacagttactaggatttttcttgctgatatatatatgaccacgttaacttggtcagttatatcacacttcaacagtaaaaattttcaaaagaaaatgtcgctcctcgatcgtacgtacgtataaattttgactttttaaccagtttgtaacaaattccataaaaattccaccaacatcctcatcttatgtgttctatcaatttttattgttaaaatttatgtgtatttgtaaggatgagtatgcccatatgcgtatgtttatatgaatatctacgtttatactatattttaagaaaaatatcccccacagtaaattgatttttgcgaggcctcaacgagtagactaagagcaggtataatagcaggctataaaccagctataaacataatttaaagagataaaataggagagataagagcagcgggctacatatttgtagccagcagcagcacagactctaagacgtatgtgtgtataacaggtgggatcaaatattgattgtgttgtatatgtttatacgtaactattgtatgaattagctattaagttgattatagatgatttggagccagcagttagctatactattaaacttgctctaagtgttagagattaatcaagcagatatgatgttaatgaactgatgcatgcaaagccagaccgatcgatatcatatcgaaggtcatgatcatcaatatatgatccgaggattaaacacaaaactcaagatctcattaggtacaaggatcattagtgacaccgatcgatgaaccatcagaagaagccttctagcttgtttgacacggccaattttaacttctccagatctacgaagataatcgaagatctaatcgtgtaccgttgacgatctctcatgctgggactgtctgacatactattatataacgaactcgattatcatctggattaatacgcgagatttcagatcagaccgaatcgctcatgatgacgatgaggaaatattttgcttgacatgaatggcacgagtttcttctgtgtttttatgacagctggttcagaaatattgacttaagttgggatcgtaggaagaagtaggcacaacgtttttctggttggatggcactgccagtcacagctgcggccacattgtactaatcaatgtactggtcctatgctttgcatcaatgtagtccatttgtcatgcacatgtaaaaacaaaaataatatttttccccacaaataataataataattttgattgcaaatagtactacgtcatattcacagttaaatttgacattgcatattaatttatgaaatatatatcatgtattgatctatatgtcaatttttgttttagattgttttagctttttttacccatgtaaaaataagaagatatccctcgagggatgaatagattttccgcctgcatgactacattgcattttcatggaaagggtggtgattgtcaatgtcatggcaacttgggagatatcttccattgatcgtaaagttgacaattgttagcaagcaaatttagcttctttcaatgaactggtaccctcatgtatatgtatatatacctgtttggctgccttttcttctagattacaacacttttgccggccattgcctgcacaacaaggtcaaaggagaaagatgtatcaaatatttgcaagttcgtagggtatggggaattttttaaaattttgaatgtttctaaataaattaatgattactcctacttactaacttcctgctatttctgaacgttggcacgccagtgtgagtgacaatcacgacaataatgccgcggctatgatggtttggccacaaaactgtgggcagctcccaccatggcgaggcaacatggtgtgtatttcaaagtaatttcgaagtaagtttcgtgtgtgtgttttctttaaaaagcttaaaaaaattcctaagctatgtatgcacatgtatagctagttgatgccacttactctcttctcttctggcgatacatatttaggcccactttgattcaaaggaaatttataggaattttaaaggatttcattcctataggaatttttcctatatatccctttgaatcaaaggaatgaatcctatgggatcctatgaaattcctatggaatgcctcttcccatgcaaattttggaggaaatttaacatgagtttctacctcattttaagaatcctttgagtctttctctctcctcaaattcctgtgttttttctacggctcaatcaaacggtcattc

SEQ ID NO: 51235 - DNA, 7126 bp, Oryza sativa
tgcacatattcctatttcttcacgttttctattcctatggaatagaattcctctaaaccgaataaatccttacccctttgaatagcaggattgaaaaaaaacggagttataaaaaaaacacatgattctgatagggactgcaagtgtcaaacagaggattgcaaaacacaggaaaaacacatgaatggccgtttgattggaccgcaggaaaaacataggaatcagatgagagagataaactcaaaaaaaatttaccaagaggttagagtggatgttaaatttcctacgtttttcctctagaatcataggaataggaaagtttcctacatttttccttttctcatccctacgaatcaaaggcataaatagtgtagattttcaattcctttgtttttcctttatttttcctccaattcaaaggaggcttattaacatttaggatgagacttaatcaaaattcttggtcaaaagaaacagatttgatcaaaattttgaactttgattatcaatatatataactactcaaatgcttagtttaaaaataaaagaaatggtacgtgttgcctcggaaagcattgttatcatatcataaacttattagattttataaactaatataaaattgatgatagaaaatttaaaagctttaacccaataatatcctaaacgtgaaatatttatgaccagaaggagtaatagggaactcttttttcatcaaatagtgggggacatgtgttttactcctccctcggttataactataaatatttctagaattcaaattttgtatcacaatacaagcatttgtgtgtggattcccatgattctcattacttcaatgattcgaaaatcaatccaagtatgaagtatctaagcaattcaaaattcaaaaattggcaaatgaagtaactaaaaaggaatcatttgatctaacctctgctaaataatttagaaatccttatattttggaacggatggagtactagaaaagcattagcatttcttgtagacgatgcatctagcatcttattttcaaattcgcattcatttcattcatccgttgatgtctttctctattatgttttttttataaataaaaaatataatagagaaaaggatctgagctgagcccaacaaaataaaagaatcagagctgagccccaaaaaaatagaagattcagaggattaaaattattaagaagttcgcaatcttcacatctctatatgtgcgactatcagttcatatactactactaataagtgaactcatcacttgccaaaaagaaaatgtcaactcgtcaggtgtagtgacatatatatgcagggactagctagtaacacgttgtgcagtgcaaataaactactgaaaattaagttttatgcaccgaatttgacaagttaacttaattaacaaatctacattaatagccatggtcaacagctgatggagcatctccagttctccaccgtgattaattggctcaacacagaaaaaataactgcatactgtattaacataagggcgttggaagatcatatttttccaaggaacacaatttagttaagtttcagtttataaggcattgaccgtaaccgttccaacttccatttcttgaggaaatgacttcttcaaataataactcaggggagatgtaccacatctataagttacttgtccacaatttatccccatattttatcacgtcttccaatattcaagagaaaaatatttgattacttgttccttgagttttccataacatgtttttttatgttactcagagatcagaaaaatgtaccatttatgctattggttagaactcattaggatgtagtcagttaaaatatgtcataattttgaattcaatcaatcattgagaagaagaaaattagtccaataaatcatatcccaaagtcttgctgagtgctgacacaccataaacaaacttataacgatataaaaagaaagaagtatctattccttgcttttttttatttatctatatttccaattaagatgaataacatgtatagcagcactaggaaattcgtagtcaaccagtgaaacgtctgataaacaatatgcctgtattatactttgttaatctccagcagtttgactacatttgagattatactatgaatgaatagtaaataatttccttacatatataactatatgatccttttcttcatcatgttggcaaataaatgctaatctttgtacagaggatatcattttcttgtaccaatcagattatttatcccagtctaaatgaagggaaatagggcttgaaagtgtcagatgggcagaactcttggttatgcatctcttgcagagaccaagagccggtccttccattatctagatagatgtgcataagcgataagtctagtgtattgactagaaaattagcgtgccacattatagcccgtgtgtacttgctaagtagttttcaaaattcatgtctataaaaggttggtaaatgaaatattcaatggtgttattaaccgatgcaacaagttaagctaaattagcttccatggcacttatgctaaaaaaaagtaactattaccctttaagaacaaaaaaagtaactattaccctttaagaacaatcatcaaaaactggataaaaccatagataaatatatatttacatgaattcactaagaaaaaaagcctgatactaccatagttgtatacagtctttttttttaaagaatacagtcgtttccggtctagcttctagctacggcacaaagaagaaacacaacaatgtagttacacaaaaaaatttcagaaccatagtctttcacatattttaaatccggaggtcatgatttcgagcaccttgtaggcggcaacaatttatatctttggtatcttgcatatccctagaaatataaggaggtgaacacaaattagttggacctatactgactatagaaggagatcaagagcaagagacaaggttaagccagattgttctggtgggctagtggcacagcagcaaaagctatcagagacatggcagtaaaactatgactatttttagattgaaacagcagttccagatctaaaggaaaactattgtttgtcaattgttagttcttattatgggtgcattcaaatgataatggaacaacctgttgataggcccatcaaagtgataacatccacccaacagaacaaaaaggatgggggagagggatacagagaaaaaaaaaatctctttaggaaatattttatctttatatatttgtcagataatcgcaaaattccatgttcagataacactatattttttccatatatagagaatgtggatagaaatataacaagctcatgatgtattaacttaagaatgtggtcatcatgaacagttgcaatcgatcgcaacttcaaaatttctgaagtaatactcaggacaatcccttgaatagaacaattgcaagttgcaatgagcgcactaaccaattatgatgcaaatgtcagtaaattgcgccacttttatagatcattttcttttgtcaggaggagaagtactctcgaaataaactactgagcaggattgagaccaaagaaaaaactatgtatcaatgcagaattattttcatgattataaatgttattagaaagggtattcagaagaaaaaatcaaacttgagttttgtcaagaaccattcctgattatgttcttctagcgcattaatatttcttttccagattatgctaactgtatatatactaatagctctaactcatgtataattcgattgctgctacgatggaatcagtaatacataacttaactcattagtaatccatataagagtttcataacttagcatcaaattctgcaatttctagttgtgtgtttctcctggatttctgcagaagtagtatagtagcaatagagcaattaatacactatccaacaaaatagtcctaactgtgctatcaaatgcaactctaagaaagaacaagatatattctttcttggtcatttcatcgaacaccatgaatgcacagttcgcactacaaatcagcaaccacacgttcaggaaaataaattgaacaaacattacactgtagcttgctcaccactgccggccatggcgacgaccgataagcgcgctctgctggccgccgagaacggccatggcggcggcggtccagtcaccgtgtcgttcaacaccaatgccatcgtcctgctcgccctcctcgtctgcggcctcggcgcggtcgcgctccacgtcgtcctccagtgcgcgctccgcgtcacgccgtaggctgggatccctgtcgttggctcgccggcgccgttaccgggagcgggaggcgtcgagatgagatcgattggaaggggaagaggcatgaggtcgatcgacccttcaggagaggacgagaagctaacctttttgcattttactccttcgctagatcatattttacattttagcccttcgcgggaagagcgtatgcacgaaccacgcagcgccacgtggcctcgctaatcgcacgctaatctgcatagatttcgatatatagagatagagatggcttgtccgctattgattagcaaatatcatatgtatttcccatagaattgcacttaatactattatattatcactttcagtactaggattattttatataacacacatgaaatacatttccttgtcttactaaactaacagagaagaggacattgtagttctaaaaaaaaaaagaggacattgtacctgaaaatgggcctccatacactgtacatgaaaatgggccaccaaaattctgctcggcttgctacctcactatcttctggaatgacctgtagcactcaaaagaaaacggataaaaaggatatacattagcaacacagcattcagcaatgcggattcttgatatttcagtttgattcaaacagcaagcaaacacactacagctaaaacagatatgacaaacaaaagaaacattacagattagcagaactacatgcttttcagcatcttaagcctccaagcagaaaagggtactacaatggtgtggatataagatattgtgagcaaattcagaagtcaggaattatattatggaaccaatacaagattaccaaccctgatcaacagaagttaacagaccaacccactacatccaaatcatactaacagcaaaacaactttatacaagaaaaaccttcagatcatttttctccagataatgtgagaaattatagtagtagtagtatagcatcccaacaggctaccgggtgtcaatactgtctgactaaaatgcaggcaacatttacgcaccaaaactgaaaaccattttctccaaaggatggaggatgtattatcaaaggtatatgcatacaacatttttcattatcgatatcaaagaacataatatggtgatacaactcagaagctgctacaaaagtacatgctcaggaccttatgcaacattctatggtattggggaagtaatatataatctataagatttgacccagcaggccttttccatgctttctcaaactgcatgaattgggctgttgtttctcttatttaggtcaggtccagccattggtgggttcacatgaaaagctgattgtcttgtatttgtcggtccagtaagctgaagggaaagagcagagggttctatggagttagagctgccgtcacctatggtaagcttggacatgccaacaacctcatcagccttattgatcacctcctttccattcactggagtgggctttaggatttcatgatttgtgcctgattcacccacattagcaacatttggaggccaaagagttagtggaacaggtattaatgccgggtagaatgttggcattgtcagaacaaatttagtcttgaaaggtgcagcatggttcatctccaagtctagtgctgctagtgaaggttctgtgaactcagattcctcatgcttccttagctgcaaatccgacaggtgtctagcaaactcaggttccttctgtttcacaagatgtgatattggcaattgatttgagcttgtggcttcgtcttgagtactatggagcataagctgttctacgaccactggggattcgtccatgggctgcaggttgaagatgaaattcgaacataagatggtcgtgatatagaaatatcaggacacaatttaacatatatggagataatagacacctcctgtctcaagcgaaaattgcaagcaaaaattgcataccatttctgggaccatgtcaaacaagcttgacctcctcttccttcttgatgagtttgtctgtctaatgaagtacttttgagcatggctagccacctgagttggtgtcctggaaacaacaaaattacgagagatcccacgccagtctcctttaccaagcttctgcagacccattagaaacattctatgctcttcttcagtccaaggtgtacctgaagcacaacatcagcccttgagttgaaactggactgaaaaatcccagatggtttctgtgaaaaaataatccacgaccccatttttttagaggaaagatcattatattgatagtgacctggctttttcagagagccaacagtagttcaacaaagaggtaaaaccaactcacacaccgagggttacacccactggatcattccagctacggagtacatgacaagctcagccaaaaaacacactggaactgcagggaccagcactgtagcatactccctctaacaccagaatactccccattcactagcatgtattcattacaacaaagacaaagcatcaatcactacttttgagcttgactacaatctcaagctttgggtttcttactttgtttatatataataaccatcaaccttgatgcatctcaatctagtgagtttaatattagatcagtaatgctattctctgtagaataatatgcatgagtctataattgattcatctgattccatctcacaaacaatggacactccagaaccacaataatagctttgtaaagaagaaagggtagataagtttgccttctattcagtactactccctccgtttcaaaatgtttgacaccgttgactttttagcacatgtttgaccgttcgtcttattcaaaaacttttgt

SEQ ID NO: 51236 - DNA, 15827 bp, Oryza sativa
  unsure (1)..(15827): unsure at all n locations
aagtcaacggcgtcaaacatttcgaaacggagggagtaacatagttgaattctgggtatgcataatctagaatctctgttcaccaagatcaaccgctcaagcagcaggtttttccagcacaagaaaaatatgaaaggggaaaggaaaataactttgcctctcatcattaatacgattaagctctgaagctgcccaacttggatgtacatgctgcaagtcctccatagaaagtatggatatagactaaataatacagcatagcacttgtggtggacactcacggttcaaaggcctttcaatttttaaccatgtaaaaagaatgtccagaaagcatgacaaataactattggcaaattcattgccataaagttttacagcagaatcagcatgatgctgtcatgtagtagggacaggtgcttttgtttcaactaaagatgttgctcatacaagggaactccattgtgagttcccttttgagatttgttcttaattcttttagatagatggcttcatcccataaccactagcgccagctgattcataataatcaaaacagactcaggctctagcttggtctataagtaaactaggaattgcccctacagtttctttgaagccaagtgccagtaaagtctcttctacatgtaccaaaaaaatagcatatcactaccaaaccaaatacattaagaaagtacatagtgcacacctaggactggtcaaaccaactggaaaccaatgtggctagattccattaggatcaggtgattaaattaaaggtcaaagagacgtggggtccttagcccgggccagtcagtgtccctctcggaatgtgatctatacaggtcttcttgcgatgcacatgtgcacgtaacttaatcagatgggaaaagatatttagctaggttgattagtgtcggccattctggacggttcctatagattgcatcttcagcaatgatagcggccataccttgagtctagcgaacaaaatagggaggcgtgactattaaaacatgtctccgaattcattacaagaagatagcttgatcttctctacaaaattgtcaatcatttgttaatttcttgaatcaaattgggtctttaactctttgatatcaaaaggatacatctttttgtttctgttgatgattttccttatctttaatgttgctatcttggttgcataaaggatccgtgaaagtagaggaacataccacataccgacaaattaaaaggaacagtacattatgcgattcaaccacaaaattttgttttccttgcgcacaagttgcgatacctgaagcaatcgaactagaatattttatttcacaaaaaggaaacccatatttttccttgtcttggcagcaagaaatgaaaatagaaaagattcctaccgctcgctgagccgagcgtgctccatgaggcggtaggtgcatggaacgcgacgcgttaatcagaagcaaacaaacgcaaaacgcagcatttctacttgctcagttgattcaccaagcagaagagtatgaacagcgcgcagctgtacctctcgtcgccgcatttcatttcaccgagcacgcagctagcatggacaggatgcaagctagagtgtatgtttgaacggaattacagaaggaagaagaaagaagaaaaaaggaatctaacctttcttccgctcgccgcggccattcgtcgagcaggaggcgtgcgtggggtcgtcggacgcgtacccggccgcgccctctccccctcctcctcctccccttcccgttcccgccggcgacgaaccccctgacccaccgccactcccgagcgacgacgcgatgcagctcatgctcgcgctcttcttcatcgccacctccggcggcgacgtgagccgcacgccgaacagcctcaccccgcctccgcctccaccgccgccgcgggcggggcaggtccgcgcgttgtggccgttgttgctgcagtgcgagcaccgcctcgtcatcgcacacgcaccgtgacaccacgagatcaccaaaatgcgtcgcctcgtcgaccctcgccgccgccgccgccgcgcgcggtgggttttctccttctctatctgtcttcttgttcttttccggggaagatgatatttttggccacttaaaaagagcggcgagttgaagtgaaatgacggaaaaggacatgggctgcggtggtggggggcgggggtattttgggaattggcggcttagctgtggccacgagatggacaggaagcgacgggggcgagcgtttcaccggcgagtgaagcggaggaggcggacacgtggcgcctcccgccgccgcctacgacaaagtacgacgcttaattaaccacagtaaaactgcctacggcccgtactcgtaaacacaactttaactttttatttctataaaaatatttattgtaaagtgatatatatacttttataaaagtatttttttaagataaatctattcatatattttttatatttttaaactcaataatttaagagatattcatgatttatattcctaaaatttgacttaaacattatcttaaacgacttcctttataaatatagagagagtactttctttgtaaaaaaaactaacttctgaaaatgagtctgaaaaattatttatctaaacttattcctaaaatgttattttttttaatgaatggtgcattactctgtcttaaaaaaaatcctacctacgaatctagataatacgttagattcataaataagattagattttttttatggaggggtaggtagctagcttgatcacaattaaaacggtactccctttggttttaaattggagtacaaaatttttaagctttggctagtctctgtttcttaaacactttaattaatattgtacgttttagccccttcatcccaaaactctctccatttcttttttatttggcattgcttagttaaaaaggaatgaagggatatatgcatttttagattcttagcaaacaaagtgttctaatctctacagatagagctagctacttaattcttcatttatagtgagcatgtttcccaaattgctaagcggtgcaattttttaaaactttctatatgaaagttttttaaaaaatataaataagttaatttgtaagtttgtaataattgatacttaattaatcatatcctaatcactcaccttgttttgtgtgcgaagaaaactctgcaaccaaacacaccttcgaacgaagcctaagtttaacagaagatagtttcttttagtcattttagtggtaaaattttgaattctgaatagcttatgttccctttccaagcatctcactggctgaaaatgcataaattccatgcatatattgaaatcaatgtcccagaaaatgctatattatgatataaattttaaatcttaaacatacttatattttgaaacatagggaatatcgtaaatataatcagaaaaagatactatatatacatactaatttattcttatagaacttttacaaacactaatgtgtatatagtgttgcaagtacatctaattaaattctctataactctcatattttatatagtaaaattaaatggttgagattattgtttggaagagttcttttagtttcgtgtagaaaaccatgacgactttcattaatagtagttttgatacgattaatatatagtcaaccgtgacaaatacatattaggatatactagtaacaattgtacaatgattttacatttaattagcatattgacttcttgattttaattaaccgcggctgttacttgctcctgcatcttcttcttcaccaagacaacaacacacctctgaattaattatacagtagattctgccatattcactgcatctcgttgtgtgatgaaggtattgcatgcattgcatggagatctcggaatgaacgatggctagctagctacaactccagcttaattaagccattgacttgatgatagttcatacctaggtatagcagcagcagctttttttttcctctcctttttcccctatttttctcgacgccgtgaacgcacgtctcttatcttgtcgtagataaagaagaaaagaagatccatctatccatccatgctacgaaacagaattagaaacgcgtctctctctctctctctctgacttccttgctagcttctcctaccactatgaactatcctatacgctatagctactatcagatcttctattcatgaaagtcatatgatctttcttttttagtttttagatatatttatgagagtgtgatattttttttatatatatagataataatatgagtgagatttttggatgttttctcttctccatccatctcttccattgcatccatgcatccatgccaactaattatactcactagctgctagctatctagttcctgtctacagaaaagaaaaccttatcttcctctctcagcagcttcgtagcaagctcacaattcattcattttatgcatgccatggaatgttccagaaacgtacgtgaacctcatggaaaattacacgacctgctgtgcagtcaatacgtatgtaatacacgctcgtgctattactttaactcaccgctggaatattattacaggattaagggagcacatcatgttcaacttgcagaaaaaaaactgacttaatcggctccacacaccccaattcttcagataaaacaggtataaattaccgatttatctctctgcgtgtgtactgcaaattcagatatataagtgttagctcaagagcataaacatgttcttgcatacttttgactctgaattatttatttttcttcagataaaaagggggcaagaaactttcggtatctgtctgaaagagctagctagctccaaagtctccaaagtaggtcaggaacctctctgcaactttggagcatctaggatagcaactcacttgctcactccagacgtccatgtcgttttcataatcttctatcttttattttggatctcatgtataatctgaactctgtatgcactacgcaaagtgcctgcatgctgcgtctgtcatttattttatcttatcttctctgcacaggtgttcgttcctagttaaaattgacagtttgcaagctagtagtaaacaaatgctaatcattgagacgcaaaaaggctcagatcgatctcgatcgagcaagtagctagggaatcgagattaattactgttctaaactgcatccgctgtatcattagtgcgctgcagaatctgatttgctgtcaggagcgttcagtttaccggtttcagactttcagtgattctgcttgttatattctggcttagaagagatgctaaatcaaaaggttattatatgtgcagattttgtcttctagttccaagaattgccgaataagtaaacatagtttaattaatgagtgaactgattgatggttaccgaaaagattgggatgctaattcgatcaacagctcgatcccctgtagatacagttgcatcaagccgaatatattacacgaactgttttacaaaagctataacattcagtgatatttgttccattaattgtcaaaaggaacattgatttgtcaaatcaaaaggggggcatcagttcatcactgaagcatgcatgccttcacttaaattagttctcatgtatatattcagttcaggaagcccatatgcatcttttctttatccatgtgcaggccggtttagcaaagcaaacaactaaagctgggtcagctactgggcaagtgtggtcacgtgttctttgccttatcaactaaggcatggactgatcaaacccatgaaatgataaaacgcatgtgcttttgcagttgcagtgcctgttcttttcagcttttcagtaataggaaaaaaaaagatgagatttgaagggagagacgtccctccaaatatttttttaaaaaaattataagcgtattgaggattgaacacaggagttcagagttgaaaccacacatgacacaatcgagtgcatctctagtagtagaaaaaataaaaaaaaatatgaaggaaagagatggagaaagtggcggtgtatgtgtgcgattgctggagatttcggcccaggtttagcccaatgatacaagagcgacccaatttgccaaaattatgaagcccacctagctatatccaggtttacaaaatgcgataaccacggttattattaccgatgaaaatcagcgaaattcgataaaaaattgccaaccatttaaattttgattttacatctttctgggctaaatgcctgtctacagctagaagacctgcttggccagaaaattggccacggcgtcgaggatgacgtaggcacgactgtggtgtcggatcgctgtcatgagctgggaaactgttttaacaaaacagctcgagtggatatatatacccatttattatatgtcatctaaattgttatgaaaaaatagaaaaaatatgaacaagatagatcaatatataatatatcaatgcacaaatatgcaagttaaaattcaacttctacaaattgtaacaaaaataacaaacaaaactcaaattactatatgtatatttgcaattaaatttgttgtttttgttataacttgtagaagttgaatttgaacttgcatatttgtgaagtgatatattacatattgatcaatgtttttgaaaaattttcgtaaccatctagttgacatgcaataaacgggtgaacgtccactcgaactagaatccatctccgtcgtgagctctccctacttgctgtacttgaggctgaaagccgttaggggatgacataggggccccacactatttttttaatttatgtgatgagtggtttgccatgtggactcaacgaaaaccgtctaaaaaacaattgagggagacgtttgaaaaggttttaatagttagtggggtgaggatatccggtttttagagttaaaaggataacagtaagattttggcattctaacctatattgagggactcaggttgaactttttgcaatccgaatcgatttgatagatcgagtccgaattgtagcggattctcaaggcccgcaaccatactagcccactagtccgagttgctagaatttgttgactttcaggcccagtagaatctggagatttcaacacgagctaagcccaaaatattgcggcccaaatctttcagctcgatagactggccccaaatggaaaacgtccactttgactcccttaaaagtaggccgaatctaattcatacccctcaactgaaaaaccaaatgaaaaaccagataagataactcctcgaactattgaaaccagtgcaatttgactcccttagcggttttgaagggtggttttgctgatgtggcgctgatgtggtggtgttgacctggtcttcatctcatgtgacgcctatgtgacaataaaattaaaaaaaatctgagagacccatttgtcattcaaataaaaaactattgtggagcccacctatcttcctttctctctccaacctttcttcctcctccctctctctctctcccttgtctctctcttttctttcctcttccgtggtgacggcggcgggcggcgctacccctgcagagacagcgggaaatggctcccactgtcggggggggggggggggggaggtggctggcgttcgggggcgtcagtgccgtccgattttccggcggagagcttcgacgaccggcggcagaagcaggtgttcgtccgtggccggatgcccagcgcggccgccgtcgccgggtacgtggtcctgtcggtcatgtccaccattgttgtaccgcgcctctacactgagctgaagtgccaccacgtcgccgtcgcctgcatcgtcgcgctggtgctcgccttctgcaacacgtacgtcaccagcgtcatcgacgtgaacatcgcgaccaccttcggcaaggtggtggtcctcgcattcggctcgtgggtggggctcaaggacagcggcgtggtcaccgggctcgccgcctacggcgtcatcgtggcgaccgtctccaccggctccgacctcacccaggccttcaggacgggctacctcaccctcacctcgctgcgcgccaccttcctcagccaggccgccggcatggcgctcggctgagtcatcaatcacgtcatcttctgggtgttccacaacggcggcggcgacggcatcgccatgctctgatccgaagaaatttggtgtcctgctcctgcgcgtgagcgtaacgacgtcaggaaattgctcccggatttggagcggattcttgccttgtaggaagatcctaacctatcatatcttattctacccgagctttgcgagcgtttcctgaaatcttcctgtgcatcttcaagaagtcatttatctctttccctaaaacgcattcggttccaaattaaggctgacttgtataaacgctactataagcccgtaataacacggtaattcttgtttggttcaaaatcttgggtaatgagtagtagcaagctcgccatcacgaggagacgtccgcgggactccaccaggtagcggacaactcggatactgctcgcctcgccggcaaaacgggtccacctcgacctcgccgtccccggccatcttccccgcacccccgcgccgtccttggcctcctcctgcagccgcacccgtagtcccgccccccgccgccgccacgaagaggaaagaaaagagagagaagagagggaggaggaagaagggttggagagagaaaggatgataggtgggctccacaatatttttttttatttgaatgacaagtggatccctcatatatttttttaattttaatgccacttagacgtcacatgggatgaagagcaggtcagctctaccacattagcgccacgtcagtaaaaccactcttcaaagccgctgagggagtcaaattgcactggttttaatagttaggagagttgtcttatctggttttccggttgatggatacgaattagattcaggctatttttaagagagtcaaagcggacttttccgccccaaattgcatctgtttttaggtgggctagctactcgtctgaatcatggatgctaaagattagcagagggatcaagcacactaatcacgttcatttgtgtcggaagacacgacaaatcaatttttgttgattgttattatccatcgccacgtgcagagtgacgtaacgtgaatgcacaggagactggtgtttggcgtagcagcatgtgattagttagttagccgtcgggattgtctacactactgctgatataatagcaaacacgaatatgtaaattcgaattcatatgtcaaccactgttgtcgcgtcagcaatattgcataggatttgcatccaaagttggtgatgaacaagcctcaggtacaccctggatcctagagtatttggtactacaagcagatgcagttttcgtttcttacttttgcaaagtcggaaaaaggaggagagtacttttggggttacaagtcaacatgagtcaacactactagagactgcgcacatgacaaaggtgacagataagagagaacaaagaacaaagaaagttcccctgcccatccatagttgatcagattcggacgtgacactaaaattcacaagaagaaaagaaatctataaagttcttaataagtactgctagtattctctctattttataatatacatatattataaatcgtttgtctttttcctattaaaactttgttaagtttaataatacctttttaaaatatattttgataatatgtttgttttgtattgaaaatactatttatttttcgataacttgatcaaacttaaaaaatatttgattagcaaaaagaaataaaataatttataatataaaacagagggattaataaagaaaaagaaaaacacaaatatcaatgaaataaccaaaaagaaaatccagaaaggggaggaatttttcttggcccaaacaccctgaccgtccgaggccaccaagaaagaaagagagagatccctttttgctttgcgcttttgcaaacccttttccaattcttcttctttgcgcctctccaaccttcctccgtatatatcaatcatcgcccaactccagctcccaactcccttccctctcctctcctctcctctcctcatccggagacgccacgccgacacgcagctgcgtgtgcgaggaggaagaaacccagaggagcagcaggagcgaagcaggaaggaagcagaggagagggaatccaaggtgagggagggagagcatggagtgctccatctcgaggacgaatctgaattgcatcagcctgggtgacccggacaccaagaaatcggtcgcgctcctcaagcaggtcttcttcccttcttggaattcgcgattttctttaggctgtactactactctggatggatggatggatggattgtcttgacactctggataggatagcagaaagcctggagctttcttcgttgagaattacgatcatcgctaaatttcccatctttgtgttactgctatgctagtttcttatctgtacctgtccagggttgtttttccacctccataaaacgttcttcgattttatttttctaataacaacaaggtactctagcatctaggaatctgcgtgttacaaccgtttcttttttttttttgggtccatgtagcagttcattgggttggtccgtagaagtagatttctggatttcagctatgtgcatcggttcaacaaagaaaacgtgtcctttgttattgtttactctgcttggtttagtagagttatttgcactgatttgtgctaccctttgtcaactgttgctttggcctggatgctaatacctcgtccttagcatgattgcaccttaaattaaggattagtagtactaaagatttgctgaggtgagatgagagtgacatgccatggcctgcctctctgatctactatccaactgccatggaagcaccactgaagactggcttctccgaccttccacccgatcctgggcgatcccggatcgagccagatattgcctggaggcccttctccctatgtttgactcatcctagatgggttcacacttgtcgattccggtcaaagaaaaaagctttttcacggtcccatcacaccaatctacgcaacttgcagtcgtcgagcttggatggaccatgttcggtgctacttgtttggtgtagtcatatcattacctggatttgtactacattcattttcgatcacaattccccactgtgcaaatttgacctcagtttctgttacatatgcccagttttagaagaatatcaaagtacaacgcgttgcgtggaattattctagctgtaccattacattagttatctcatctattagtcagttaatctgtgccatttgtctaaactattaatgttcatcttacctataggaactgaatgagaataagatggcactttgcagtcatatgcataaacttctaacatcatagtattatattcctagttctactaaaactgtccaaggactaccatttgtgccttgagaaacattttacaaggttagaagctgatatagctaagttttctattatcgtcagatgaaaaatatagcaactgaattacatgttctatcagtgctgtaagtgggtcattaggcatgtctttgatgtgaactttcagacttcattgtcactgtgctctgctggttctatgtattttaatagtttttaaccatattttttcctaaacaaatgtttcatccttcttcataggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggtaataatatttaactcctgcatgtgttgtttattattaaaattgcatgtcatgatgtactgacatactcttggttttgagattattagcaagctattaaaattggtagcaacagtacctcccaaagaaaagttgataaaaaaaaatgttatgcatagacagctgccttgagtaaacctcatttcattttctacagttatgtagtttttcctgctccaggtttcatactattcatacttgtgcattttcaggtgactacaaggaagggtattatataggtattgagataccagaagatgatccacaagcaaacagaccattctatggtccaaatcagtggccatccgatggtgagttgtctttcttctgttattagaaaaaagaaaagatctcttccaaaactgaatgctaatgaataaaatacacactgtctaagttattccatctatactatgctgttatgaacaacagtgcagtgaacaatatatacatgtcgaacttcaccagctcaactattatactcacttcgttacaaaatataaggtattttgattggatgggacacatcttatatccaaattcgtagtaccaagatatctctcatccaaccaaaataccttatattttgggatgaagtgagtatgttggtgtggcagtaaatccaccgaataagcttagcatccattagaagtactaaccctttgatctacaattcttatactttggtacttgataggaaggaaagttcctcggaattgcatggttttatttacttattttgcaaaattttcccttgcattatttcagaagtattgccaagatggaggaaggtgatggaacagtatcatagcgaggccctgtaagttttggacatgctgaacacacaatcaaattacactttgctatatatggatcagttcaacaattaatattgtcaagtgatcagtgatgatcaattaggtttaaacacttatcaactagccgttctctaaacctgactttgcagcaagttttggtgatgctctttttgtatgatttattactgtaatgatttgatttgcattctaatgaattcaggagggtggcaaaatcaattgcaaggattattgcccttgctctaaacctagaagaggacttctttgataaaccagaaatgcttggcgagcccatagccacattaaggctcctgcattatgaaggtggacaaaaaacaggtcatgcattcttgccgttcagtattttattacacaagaaacataacgaattctgtcgtttgatgttccttttttcatcaggtaaagtatcaaatcctgcagagggagtttttggagcaggtgcccattctgattatggcctaatcactctactggcaaccgatgatgtagttggtctccaagtaaatgcatcttgaatcgacaccttatcaaatgtttcattgattttcgtgacttctaataaaatggtagttttccatctgaattatgcagatatgcaaggacaggaatgctcagcctcaagtatgggaatatgtagctcctgtaaaagggtgagcttgctaatctaatcacttagcaatatttatgccaaattctgatttctgtgttggcagtataaaattgggatgtatcaatcataaggtattctacggcctatgccaactgttagtgaagatccttacatgttttccctctattttccagaggttttattgtcaatcttggcgatatgctcgaacggtggagtaactgtattttcaggttggccaaaccatcccttaaagcatgttctttggagtcattgtttttctttaggagaaccatcttggtgtcattgttttttttactaactgttactgttctttattataatacggctgtctgcatacctgtaggtcaaccttacatcgagtggtcttagatggacgagaacgtcattctgtaagtttcttctcatacataaatcttcatacaagatgagctaactcgttaacggcgctgcaagcctctacaaatcttacaaataaatcgaatggctttaattactccttttccaattcttcaaacagattgcgttctttgtggaaccaagccacgattgcgtagtcgagtgcctgccaacctgcaaatctgaatcaaatcctccaaagtaaggacacattccctttgatgatcacaattcagcccatgtccataaccattgttcatcttcaccggggcgagaaacataatgtgtgttccattgtccaaccaggttccctccgatcacttgctcggcatacctatcgcagcggtacaaggatacgcatgccgatctgaccgcttacagcagcaacaaggcctagaaggccaagcgccattttgatctcatccaagctctcagctgtacttaagatgtacaacctgcaataataatcccttaggatggattgatggtgttctatactaattaaattaatcccagtgtacctgtaaccccagtctcatagtgatatagtagtatactagtgatagtacattgttcatgaagtgaggagtgagcagtggcatctgtttttgtactaccatatgtgtgggtgagctccagggctcatgcttttcgctgtcgatttcccatctgctttggggcagatatagctttcgagttggatgtgtggataattctggtgtctgcatctgttttttggatggttggtaggttggtccggtccccgtttgtggttgtggccgggatatgcgtcgtgaacgcgtggctgcgtctcacgccaggaactgtgcgaaatgcgtagcgtcacggtgtcatgaggcgtcgagatctgggtaggaatctgccctttcttttggatcaataatttccagttgcacgctattgagcttgtggtgtgtgcgagagtaaacggaaaggatgactacaagtagaattgacacttctatttgggaatttaccgtgtacagtacttgcatgtgacagcgatttcagggtcactaagtagtagaattgacacttctatctgggaattcgatcagtagctgtcgtagttatttcattgatgtacacttctatttgggaattcgatcagtagctgtcgtggttatttcattgatgtgctgcaaatcgtactgatcatgcaaacggctcgttgcttcaaaggataaggatgttcaattttgattagttatatctctctttctgttaggtgccttaataaatgcttctggtggtagcagaaatcaaacaggtcagggaagggcttttgctgttggggaaaataggagatttgcggcccattacaatggggactaaaactatgtgcttattgcactcattataatcgatctaaagaatgacaaacactggtggtacacatggagattgcttccataatgttacaactgatgatttatatagacagataaaatgccttgcagcagcagcaacggcgacaatggcaacacaacatagcagtatctctactgcattggagacgagcgaacggagaaggctgcgccgtcgttgagaggcagcaagctataataggcgccatctttgtcgatgcagcacgcatgccacttcatcttgtatgaaccctgaggaaattcagacacatccagcaggcagctagagaatcccaccccactgtcactcgcttcgaaacgcgcaaatgctgtcaccatatccttctgctcaacatggaccttcttcctccttttcttctccctcttctttcccaaatcatcctgtacgaactgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51237 - DNA, 10602 bp, Oryza sativa
tggcatgcgaggtttccctgaaccgactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcaggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgcgactactgggtaggtccgtcgatttggcatgcaaaccgaggccaagcaagttaagtgtgtgattctataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatgcgcaaacaatcgaaaacctaaacaaaggaccaaacgaaagatcctatttagactaattagtagtgccattaaatagatctcaattttacggaattactggaagttgaacggagtcaaacggaagagcggttgagaagatatgaattttggaagtttaattggagtttctggaataggagaaatggtttatggaattttatagaaataatattctcaagaatattattgacagtcactgacgtacgggctcgaggggacgaattattggaatctccggattaagaggatgggtttatggaatttggaatataggaaatgatttattgaatttctagaaaagagaaatatgtgtggagtattgaaaaagatattcccaagaatatctttgactcattgacacgtggggccaacaagaaggtgagagagagaggagcaattggagggagtaattgtggacttttagctcttgggtgatgtcacaccccgaagttttcctcccaagccaaaaattgaatttacaaatgaccccaagaaaatgcaggtgaaatcaggagaaaaccctaagaaagtaatgcaaataataatcggattggacatgtggaatttttcttgagttctacatgtcgaaattcattaacaggatttttagtggaattttcagagctctagaaataattttcaaccaattaaaattgagcaagcaatattttaattccagggaaaaatcctttttccttttctttttcttttttcctttctttttcctcctttttgtcaaatgggccgtcggcccatttcccttttcctccccctcctctctactgggccggccacaggccgaggcccagcccgaccagtccggcagcccaggccgcccgccgcctcctctctcggggtcgccgacaggtggggcccacctgtcggtcccgtctccctcctcccgccgatcccggcgcgccgccgcgcccgaaaccgccgccgcgccctcgtctccgccttccccgggccacgtcggccacgtccgcgcgtgcgccgcgccctccgcgcccattcccctctctctcccgctcgcgcccgcgcccgagatggccgggattcgaaaaccgaatcccgcctctctctcctccccactcccccacgtcggccggcgaatcccgcctcttccggccacgtccggccctctctccccctatttaagcggcgcagggaccctctccgctttttccccatttcgccgacccctcccgagctgccaatcgtctccgcgccttgcagaccacccgccgccgccgtttttgccacttcggccgccgctagccgccgctaggctcgccgccgtcttgcgccgtcgccgccgttagattcgcggggtcgagatctacctcggccgccccttcccctttgaggttcgccgccggagacccatccccgtcgtgcgccggtgagtgacgccatggccgccgccttcggccggcgctctcgctctctcgcgctcttccctctccctctaatccctctccttttgttcgttaggaggttccggagctcgtcccgccgtcgccatcgtcctccgtcgcccgccgtcgtcgaccgttgtcggtaaggccctcctcctcgttttctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccatgcccgcgcgcccggccgcgagctcccaccgccgtccgatctacccttgggtagatcggggccgtcggttcggccgccacgtggcgccgccgccccttccatctcccgtgccgctgacagtgggcccgcgggccgacgcctcctctctcctccccgtgccgctgaccggtgggtcccgcatgtcggcgccgcacccctccgtgctgacgtcagccctggttaatattgcgcaataaatgatttaaggtttttcttttatagtaataaacacagtgaatcttctaaaaatcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttcttccgacgctccggtgtacttcaagatagtcgccgaggtccctccagcagcagagcaaggcaagtcatgcttgtcacttgatcatattgatcctatattgcaaatgtcctaatgttttctttcaaataccgcatttgttttgcaatattactatgggatggttacctattattacagccatactattttgataccatgctcctttgttagcttgggtcataacatgattagagttaggactagggtttgcttagccatgcttagttcaactagcacacaatggggagatctcatttaaaacctagattataggtttatatgataatgttggattagtaccaccgctctggtgttggttaattaaaatgaatcacatggtgggctgtgggtgcatggttttgctggtcgcacccatggcagttaaggaccggttcgcgggatgccctagaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgccggcgcacggaaacgtgtcgtggggctgtgtcttgtgggtacagttgtacacctctgatcagagtaaaactattcgaatagccgcgcccgcggttatgggcggtcaaccagattcaccgtgattagtctcaccctagtgtaatctgttgaacttggatagtttaggtggatggttgggcctgtcgcaacgtgggttagcgttggacagcggatatttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaggcttagctccagttatcttttgtttccgctgcatttttgtaagacttttatgatatttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcgagggaaaaatcttgtcgcttgtttaagtgagttgttttcaaagcaagtcagtttagggttttagtaaaattattgggatttattcgtcagtcagttggggtttgatgggtgaaatgcattaggtcctagctctataacatgggttgcaaggtatttatgctttgttcgttattattaatatgtatctaatttctcattactttgtcgttatatgagtctgtcttatttattcgctctcatgcaaaatgacctatgcataaaattttgttcttgttcgattctcttatttgagtcttttattgctttatttaaatttggatttgagcatgcattgatcctactcctttgtcttctctagatggccggtcacccacccaaccaccgcggagaaggcatgatcgacttcgtggcagagctggcacgcatgacactggtggtgggctaccccaatgcgccggagtacacgaccatcccaccgctcagtggcgagcttcctcaccgtgtccgcttggaggtccatggctacgtggggacttgcctcgctaacatggcggttgaggcgtcaggaggcacagcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaagagaatgctcagttgaagggtcttccagcaccaggaggagtccggatccgcactacgccccgtaagaggacgactgcacccgtgcgcatccagcttgcgcccaggaacccacctccagcagcagcagctccggcagttcctccagctccagctccagctccagctccagctccagctcccgctcccgcgttcactctctccttcgctccagcatcagccgccagaggaccagccagtggtaccggaggttggttgtctgctactcccagtggcagcggcgagactgatctgtcaggctccaggagtcgctcagagggacctggtgacgagcaggaggacgccttcgactccaccgaccgcaggagccgttccgagcattaggctcgttttcccattagtttatcgattgtctagtttctgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctttataataaagcttagctcttgagcatctgtttttcttcttctcccccgtctgctttcccctccagatggtctacaccaggactggtagccgcgcaacaggcgagggcagcaacggtgaagaacgcgctgatggtgtgcaccccaacagtgagtccggcaatggtccgccaccacttcccgagaatccgacgcttgcccaagttatggcacatcaaactcagatgatggcagccatgatgcagcagatgcagcagcagcaccagcagatgcaccagaggatgatgcagcacgccgaacagcagcatcaacagtttggtccccctccccctcagtccaagttgccggagtttctacgtgtcaggctacccaccttctccagcaccaccaaccctatggaggcaaatgactggctccatgcgatagagaagaagctgaatctcctgcagtgcaatgatcaggagaaggtcgctttcgccacacaccagcttcagggtcctgcgtcagcttggtgggacaaccacatggccacccgcccaccgggtactgaagtcacatgggcagagttctgccgtagcttcaggaaggcacaggtgccagatggggtcgtggcacaaaagaagagggaattccgggcgctccatcagggtaacaggactgtgacagagtacctccatgagttcaatcgcctcgcgcgatatgcaccagaggatgtccgcaccgacgccgagaagcaggagaagttcatggcgggtttggatgatgagctgaccaaccaactgatatctggggactacgttgactttgagaggctggtcgacaaggcaatccgccaggaggatcaacgcaacaagatggacaggaagaggaaggccgctcagttcagggcaccccagggaagtcaccagaggccgcgcttcactcccgggcaacagggtggacctaccaccatgatcgtccgtcagcaccgcccgttcaaccctagcaacttccaccagggcactagtggcagtcagaaccaccatggaagtcagcccaaccgcggtacagctccacgcccaccaatggcaccggcacagtcaggccagcccgcacaagccaagaaggagacgggagcaaaaccagggtcctgcttcaactgtggcgagcttggccacttcgctgacaaatgcccgaagcccaggcgtgccgggccaaggtttatccaggctcgtgtcaaccacgcgtctgcggaggaggcacaagcagcaccagaggtcgtactgggtacgtttcctgttaactcaatccctgcaacagtactttttgattctggtgcaacgcattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctagatgtcattcttgggatggattggctgaccaagttcaagggagtcatcgattgtgcgagtcgcacagtcaccttgaccaacgagaagggagaaaccgtggtgtacaaatctctagtctcgccaaagaaaggggtctcgttgaatcagattgagacggaaatcccagtggacaccgtagagaagaacttgagaaaattggaagatatacccatagtctgcgagtatccggaagtgtttcctgaagacctcactaccatgccacccaagagagagattgaattccggattgacttggcaccgggaaccgctccaatttacaagagaccatacaggatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcgaatcgacgatttatttgatcaactaaaaggagctaaagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacattcttatctattcaaagtccggagaagaacatgaacaacatctccgtctagtactcgagaagttgaaggagcaccagctatacgccaagttcagcaagtgtgacttctggttgacggaagtcaaatttctgggccatgtcattacaactcagggtgtggcagttgacccatcgaacgtggagtcagttaccaaatggaccccacctaagaccgtgtcgcagattcggagttttctaggactggcaggttattaccgccgattcatcgaaaatttctccaggatcgcccgacccatgactcagttgcttaagaaagatgagaagtttaaatggacagctgagtgcgataagagttttgaggagctcaagaagaagttagtatccgcaccagtattgattctgcccgacccgacgaaagacttccaagtctattgtgatgcatcccgtcacggacttggatgtgtcctaatgcaagagggcagagtggttgcgtatgcctcgcggcagttgcgtccacacgaaggaaattatccaactcatgacttggaattggcagcagtggttcatgctttgaagatctggaggcactatctgattggaaaccgctgcgaagtatatacggaccataagagtctgaaatacatcttcacccaaccggatctaaaccttcgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccacgaagatgagcatggcaccatctggatgggagaaagattgtgtgtacctgacgacaaggaactgaaggatctgatactcaccgaggctcatcatacccagtactccattcatccaggcagcactaaaatgtaccaagaccttaaagaaaaattttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgactcaccaaggtggctcactttatacccgtacataccacctatacgggaaagagactggcagaattgtacctcgcaaggatcatgtgtttgcatggggtacccaggaaaatagtatccgaccgaggtagtcagttcacctcaaagttttggcagaaactgcaggaagaattggggacccgtttgaatttcagcacggcctatcacccgcaaactgatggtcagaccgagcgagtcaatcaaatcttggaggatatgttgagagcttgcgctcttgattttggtggagcttgggacaaaagcttgccatacgcggaattctcgtacaacaacagctaccaggccagtctacagatggcaccgtttgaagctttgtacggccggaagtgccgcacacacctctcttctgggatcagacaggcgaacgtcaactgttcggaacagaagtattagcggaagcagaagagaaagtcagaatcatcagggaaaggttgagaattgctcagtctcgacagaagagctacgcggataaccgtcgaagggagctcatttttgaggcaggagattacgtgtatcttcgtgtcactccgctccggggagtacaccgttttcagacgaaaggctagttggcaccacgcttcgtgggaccatacaaaatcttggaacgaaggggagaagttgcttatcagctagaacttccatccaatatgatcggcatccatgacgtgttccacgtgtcccaattaaagaagtgtttaagggtacctgaagaacaggctgattcggagcacattgatatccaagaggacctaacatatgtggagaagccggttcgtatacttgataccagcgaaaggagaaccagaaataaggtcaccaggttttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctctccaagccaaagattgaatttacaaatgaccccaagaaaatgcaggtgagatcaggagaaatccctaagaaagtatgcaataataatcggattggacatgtggattctctcttgagttctacatgtcga

SEQ ID NO: 51238 - DNA, 4893 bp, Oryza sativa
tctagtgaactgttgtttcgtattcatgtattagttgtagatctccatgtattgattccacaatgcagacggacgttttaaaaccttactgcattgtgtcatcccgagtagggactagggacctcgtcaatctcctacccaaaaggactaatttgcaactttgctttactttccactacactttgattgacttttaggttttatagcaaccttctggagtaacttttcgcctttaaacccttttgtgttttctccatgtcctctctagctcatccccacagtgtcacagagacaagctcaaaaagactcaaaagcttgggcccgggctagcagctgtgtgcgtagtgtgggaaaggcacgcaggcagcaatgcacgaggagggggactgacactcccactcctcttgccactgccagtcaaaccctaatcaatattcccctgctttgctttttaacccccccatgaatccaagtgtgcaatcaggtaaagagttttttggccactggtgatgggatttggcaaaagatactgtcccttgcatgtcaaagtaaacctccattttgtattgtgccatttgccaaggacattccattatgctacacaagaaagtatttacagatgaatttcgtcagaggttgaacataaactccaaaaatgtaagctttgttcttcacttatgaatgcacatttatttgtacatagaagcatgagaggcaaattaaccaaacaggatttggaatcacatgtactcatgggattaactgtcagcatgggagtagtcactagtcagacagtaaaatgtttggaattttcccgggggactgctctgtgttgagtctgcggcaagaaaggaaatttgcagcagcccgggtccagtcgtgaactgacaatgatcggtccaaggacatggatttaaaattctgtcaaggaaatctcgtcgttttgcttattcgtgaaataagtcaaacggtatatttgcaaatgataagtaatttatgaataaaacttttataatgtattcttagcgatctaaaagcaaagattgaaaaataaacttcgatgataaaacccaaaatcagctataaatttaaggttgaaaattcaaatttaggctgataaatataagcataagcgaaaagatgagacccgatccgttcgtcctataaatactgaatatgacgtaacatccagatttattgtactatgttacatcacatccaattttagattaggttttttgagatggaaggagtagacatctacgttaatagcgcatgtttggaattgttatgtgatgtagagtagtacgagtactcgctttgtcctaaaatataaagaattttaaatggttgagatatattctagaattatgaatatggataaactcgttgttcaattttattttatattttgagatagagggattagtataggagtacatgccgtacgcatcagtattcttcatgacagtgatcatatattcagaccactactagcttacagcatggctgcattacctcacactctcaaagcgtaccaacacaacaaatcaactccattccaacttccataaatgttaatcagatccatggtacaacaaattactactacgggcttaatgaccttcgtcagaaaaggaagtctatactctatagatatcagcatatatacccggtccatacatcaaacgactacgggctgcgtcggcagctttacaatggcctgatctgatcatacttgtccagaaagcctgccccgatcatccatcccatggactgcaccaggggagctacagtacactgcactgtgcatatgcattcagctgcaagcagagcacatcatcatgtacactcagattgggcggtcaaacatcgtttagccctgtgaggctgtgacctagcccatcgaccgtactccgtaggagtaagcaaagccagaactcagaagacagtgcagtgcagcaacgaacaagaaacaaatgaaatgaatcgagaagctacggctgtgtttcctttaaacttcccagctttttcattgcattaaatatttaaacacatgcataaaacattaaatataaataaaaaaaccaattacacagtttacatgtaaattgcgagacgaatcttttaagcctaattacaccatgatttaacaatgtggtgttacagtaaacatttgctaatgatggattaattaggcttaataaattcatctcacagtttacatgtggaatctttaatttgttttgttattagtctatgccgaatacttcgaatgtatgttcgtatacttaaaaaaaattgccacacgaactagaacacggccaagactgacgctgctggctacatccatggattgaaaaattttgttgtgtcacatcgaatatacgaatacacatttgaagtattaaacgtagtagctaataacaaaacaaattacaaatttcatctttaaactgtgagacaaatttattaagcctaattaattcatcattagcaaatgttaatgttactgtagcaccatattgtcagatcataaagcaattaggtttacaagattcgtcttataatttacacgcaatctgtatattagttttttctctaattataatatttcatacatatataacattcgaacatatataacattcgatgcgatcgtgcgaaaaattttgccggcggatctaaacagcccctcgcaggaaaagaagggtcgacacaacctcggaagtcgtgcactcatatctttattattattcgctgctgcggcatggtcagattatgagatgtggttgctataccgcctattcggcggaagctttttcttcatctcctctcctctcctcgccggattcgagttgatggcaacggcattggaatcgcggccgttgattgttccgtcctcttgagcttctcagaaccagcccggtcccgccaccagctcactggaagatggcagggggcatcttctctgacgcaggctgactggtggggtcccggacaatgtagggccacaaggagatgatccagatttgtttaggtattaaatatttttgtcttggactgctgccaccggcagggcccgtggacgttgatgcacaaattggtacgtgcacttacgggtgaaacggtcgcggaaattcccgatcgacagagcgcagtttggtataagggtaccctttccgaccataccatttttaagttatctataattcttttttaataactttctacatcgaattaatattgacactgagtagtttgaatgaataatatggtctattaatgactgatcgagcgtcgttttcgaagatatgctaccaattccgatcgtttttcacgtctatgtacaccacaggcctagttacacacttagactatgttcggcacctgtgttgggaaaacatctattatgcacggagcagtctattagtacgtgattaattaagttttagcttttttaacaaatggatcaatatgaattttttaagcaactttcgtatagaaactttttgcaaaaaaaacgcacccgtagctgtttgaaaagtgtgcgtgcaaacacgagggagaggagttgggaactatggctgccgaacacaaccttacacttaccgtgaaatgaaaaagataaaagaataagggtttgttcactttgatgtcaaaaaatgagagagaatctactctataccaccgagtttgttcgagttcaatgatttactatcgatattgtatctttctataacatactggcgactttaaccattgttctacgagatgtcttgggctggaccttcttttcaaaaacacccaaaatatctttagagacatacaagataaacaatcgatttatctcattagaagttttaaaatagcatatgggtcaggatggcatatctgaaatttagcaaaattataatggcatggttacaattttccaaaaaaaatactatgaaaatttttatgtgccctccttacacaatatggaagtttgtatataggttttaattttttttccggtatatttagtttttctttacgtgtatataagtgagaattttcttatacaagagatgatagcataaaaatatcttatgtagtgtgtgaaagatgatttatattaaaaacaataataataaagtatttttatataccatatagtaaaaaagaatttgaaaacatgaggttaagactttatggtaaaaatcatctaaatatggaggaattttcattttcatatcatatgaattttcatttgcattcaatttctcccgattttttttccaaaaaatccttaaatccaaaggatccgttatcggggatcagcttccatacacgaattggttttcggtggtccatcgccttaatttgtatgcgtatatctatatatggtatgccatatttagtacattaaaaagctccttcctctaacttagaaaagatatcgcacggtagattcgtgacaagggaggatagcaatttatgaccaaatatcatagtagtatcatttattgttatctaaatattttggctaagaggtgcttttttttttattctcacacacaccatgatgttaatttgaatgcctcaatcgtttgtaaaacaactatatatttttttagaagcgcctccgatatatagcaaatcatgttcttttttcacataactttaaatttagaaaacagtaaagcatgtttaagcgtttatttctatgaaagaactagtcctcctcaacataaaaccacccataatagtttatcatgctttgatctactccatccgtctcaaaatatagctacttataatgttcaaaatttatttcaaatatatcaactttatgtacttacttactctctaaagtaattataattattttttaatctcaaacttagtttc

SEQ ID NO: 51239 - DNA, 3738 bp, Oryza sativa
  unsure (1)..(3738): unsure at all n locations
ccgcgccgccgccaacttctccccctcctcccctccacctcgctgaagctcggcctcctctcgcaggtgcggtggcctgggaggaggcgcggcgcccaacgagaagtgcggaggtggccgacgtgggtagtaggaaaggaggccggcggtgtgcaaggccacgacaggtggcgcacgaggaggttgggcggcatgcaggtggcgcgaggccatggggaacgcggaggcgacaacgcgcagaggggggcacgatgccgccccacacggcgacttgtgggacgactgccctcccacgcgacgacgatggcgcagcggggcgagcctgcctgagctgtgtgtggtgggctaggcttggcggctagagggacgacgtggttgtccgacgacatacgttgtgtgggtgggttgtgtggttttggatgaaaatcgctggtgaaagccttggctagcctttggttggcttgacgacggccgcccttaggcgtgcgtcgttcccctccttagaggtgtcgttatggcattttttctccctcactaccaagaaccctgcctgtgcaacgatggtcgttagtggactctcgcgtcgaacctctgtaagcctagctgttcagcgaggccttcgtctcctgggtttcgttcttggatgtggcgagcatctagcattcttcgttttctactaggtgaagtcggagctgcttcgttgggtgcgatgaagctcggcaacaataacacattgcagtttttgaggagtgttggtgttagctgtgtacaagaagtggtgctctggcggcttgggctgatgttcaaagtggacaatcggtgtcttgctcgtttctgcgatgtctttggcaatgatgatctgatagccgtggagttggagctgttgtgtcgctagtcgacaagctcggcaacgataacatttgcctcacgaagtcgaagcctttatatcgcttacaacaagctttttgtcgatggctgctttgggctccgcctttgtccttttttcttggtcttggtagcttaggttagctaagtgtgttgtagttgtggttttcgcataatttttcctaattaactgtgcattgtaaggtttggttctgttttctttttaaaatgggataccttcttctttatataaaacgtcggcaacggcctgaccatacggaaaaaaaaaacattactccggccggtgaccgtcctgaacaaaaacacagaacgcctgaggctgcgttctttcttcttatgaacagtgattacggaaaacggagcgatccattagcacatgattaattaagtatctgctattctttttaaaaaaaatggactaatatgatttttttaagtaacttcgtatagaaacttttacagaaaaatgcccgtttagtagtttgaaaagcgtgctaacggaaaacgaggaggactttgctgaaaagaacgcagcctgaaggaatgtgtacacttcggccggtgaccgtagagaaaccggcgtggagaagagaagggtggaactagacatgtgggaccgaggcctgcatgctgcggaccgggggaatctggcagaactatcacgttccgagggaacggaaggtggtcagagtccggactactcccctcttggatttacgcgaatatcgtgggaaaccaaaaaaacccaacccgctctggtgaggttggcttggcttgctgccgctatccacggcagcacagcgctcgcccgcgaggtacgactagctgcagaagaaacagcgcccaatgcccacacatgatgagcgttgcagaagcagagagagatcgagagagagagagagagagagagagaggagatcagaagatctcttgcccgttctctacgctttcggctccggattagacctctgatgagcatatctcgtccacagctctcctaatcatgacgctgcgccgttctcggttctcacgatcggacagatagtctacattaccgtagcttcctcttctttcacttgtctactcgtagctgcctggtatacctacgagtagtccagtaggagtacagtactagtactgctccagataaaaattacgtgtacagcatcccggaaacaaagactgtgccggcctcgctgtccgctggttcgctccatcccggccgatctcttcccttgcatgtgagcaaaaggacctgcatagctgtaactgcctttcacatctttgaccctgagagatcacgcacgagaggtggcaacaagcagcaggagtagtactactactacaaaagaagaacgggngaaagnagnatncanncancgcncgnnagcncgnanannaggncnttncnncctnnttnnccggnactnntgtcgtccaaaagatcgttggattcttgaagcattatcacggtccaggggtcagcctctcggctgctgctacgcaccgtactatactccagtaccgagtatgtacgttatgtggtggtagtggcgacgctgcgttacatctgtacagaaaacctgatttgcttgttcgattagttgggcacacggtggcttgcaccaaggtttaacccacttgggcttttgcaccgctgcggaattagaaccctaaccttgaccgcgagaacagaagaggtgagctaactaggaagctaaacgcgtcggattagaacagcaaaatggtcgtcgtcgttgcatggagtcgcgttggcgtttgcatgcgtgctgacttgactagctggtgcttgttggagaagaggcggctgacagctgctgctgcgacgacgacgacggcgcgacggtcaggcttaggtcgtcgcactccagcacgaggcgaggcttcgtggccggcgacgtgggcgggtgctcctccggcgaagacgctctcttgctgccggcgccgcacggggcggcgcttaggtgcacgccgaagagcttggtcggcgccgatgaccgagcggcgctgctgttgcctgcctccccgccgctcttctcgccggctagatgctgctgctgcggcggaggggaaggctcctcggcgatggtgagcgagctgctcgacgttgtgctcccgcctgagttgttgagcacgttggcggcggcgggcttcttgcgcgcctgcatgccgaggccctgcaggaacgcggccgccgccgggctcggcgccacgggacgaacgtggttctgcacgaagtagatgatgtcgttgtacagcttgcgcatgtgcgcaagctcctgcagcagcgccgtgttgctccgccgcaggcgctcgttctcctccatcagcaccgcggcggtggcggcgcgcccggcgccgccggcctccgccgacgacggcgacggcgcgggcccgcctagcgcgagcaggcgcgtcgcgaccggcaagttcggctcccgccaatgcggctgcgggaacggcatgccgatgccatgcgccgccacaaccccgtcgtcgccgacgaacgcgtggtggtgctgagccgccgcgacgccggggtggtggaacagagggaagtgcggcggcgcgaagaacggcggcggagacggcgacgccgtcgatgcggacgacgtcttcctgcggtggatctcggtgagcagctgcttctcccccttcctgaagaactcgttcgcgaactcccacctctccggcacgaccttcctgaacccctgcattgcaacgacgtcgttacttacacgcatcaaaacgcacgagagaacagaactacagaaggtggcggcatggcgctttgcttacgtaggtgttgag

SEQ ID NO: 51240 - DNA, 5473 bp, Oryza sativa
accttttcttcgccactttctcctcttttcacccggaacgtttttacggactcgtagtaacagcgtgagaaacggtgaagtgaaggggatcgatctttaccggtccacgccccggctcctcgtgcaattcaggaaaggtccctgccggacaagccctgctacagttttggaagcatctcaaatccgatttcttttttccgttacagagaaacgagagggaagccgtgccagccatccctattggccggtcaatgcatcttacactgttctgcagttcaaaaagaataatacggagatactacaccgtgactagaattagatcaagtttaagtttaatagtatagccagctactaacttcaattcatttataactaatttaatagccaattcatataatagttgcttactatactattaatatgtggtcccacctatcatacacacattgcgtcttggagtttgtgctgcaggtggctatagatctgtagcccgttgctcttctctcttatcgtttatattattaaaatatgtttatagctgactaatagtctactattgtacctgctcttattctgtgacgcgtgacctcaacttgcattgagatgatagaaatcatcgttcgagaggagatatttggagcggttaatcaagatcactcatcgtgaggtatgaaaggcacatcgagagtgaattttaaactctcgaggggatgtcctatagccgacgcttttaaccgaagaaagagacaatctttcaacagacaaaaataatataatgttgattactaggagtaaagatgaaaaaaatatgcaatatgcatgctttactgctatatctttactaggagtgtaagggcatgtttaatttgatgccaaaaaaaacttatcaaattttggcaacttgccaaaattttggtaggatttcttatatagttaccaaaatttggcagcaaactaaatgtagccactttttttggcaactttaccaaaatttggtaaggttgaaaatggcatcaaagtgaacaggccctaagttttcatccatcaataaagcaccagttaattaatttagattattacaaagattattaatttagttataaggataaattaaatatgttaataaataaatttaacaaatgatttaaaacaattggtcttagcaaagcagtagcaaaagaaagaattttgagaaaacattttttttttcaaaccatggaataaataatatttattcattctcaacttattcactggtttactgaaacgatttttttttaaatctagataataacaccctcaactcaatagcgagtttgtacatgttttctcatttgaaaaaagtagtaatagtacttcctaagccaattatcaaaaataatttggacattataggatggagggatattaaaaacaagaaacacatatccaggtaaaatgagtaaagtagcgcacaataaaaaaacatactactattgaattctctcgtgtgctactttagtcagtcgtctaaatttttataatgttatctattcataggcaacatattacgtacttgccaaacacagaaatgatagccacatgcacaatacgtctacccacactactataaactcaatcaccggaagtccttttcgctgttgttgttgctgagcccttttcacagctcctctggttgctaccgcccctctcccttcactgtcatagatgagctcggagctcaccttgggtggggtaaggaaggaagggagggagggagggcagaggcaggtaataccgtcggtccatgaccctccacgacgatgggtggtagccttcacgaagggattgaggagggagagagagaggatctaggagggacttagtggccgccaaatggggaaggtttttttgggcgattgaattttcacgggcggcgcactttagctaatttttacaggcaaaccatttttacgggataattttaatttttaattgacctgcttaaaaaattaaaaccacagtgcttgaaagaaatcgtttgtagtggggtgccaacagcctcactcaagaatggccacctgaaatgagaggtggctccccacaatagccatgcgttattcctatccattgacgaaaatacaacgtttcgcgtcgcataccgtaagaacgagctgatctaagctagagacatagatatactccatctcactagcgctggtttctttttgtttagcaacaaacatcgtataatgatcgagcccaagacaaaaccagatgtcttctacgatcccgtttctacacatatgtatagcgtgcctccggtgcatatatatcgatcgatccatcatcctggatgcatcttattggtcacagctagctgtcgcgcccagggctcggtgagcctcgagtgtacgcatgacgcatctcgcgcatgcatcacccgatctctcgccgcgcgcgtatgggattcattaacgcgaaacggcacgggcaagtgcaacgccagcgtgcgcaggctgcagccaaggcaaagcccgcggcactaagacgcacctggcgcacgccataaatacgtgtttccgtttgtgggggtctgggcacgctcctttcagtttcagccgtgacgaaccgcgcgagcgcaccggccggccggcctgcgctctcgcacgcgactggatatgtgggtgtatatcgcacactactacgatcttaggcatgcgcgggtggcagcagaacgcagctagctggccgtgggccgtgggcgcgcgagcgtttatggtcggcccctgccgtgttctcgtgccgggattcagcaggggcgcgggcgccgcagcgggtgtctttttcgttgttcgctctgctggctttggccacgtagcgcgccgggcgtaatccgcaggcgatatatggacgcctcacgcctcctttccctgttcacactggtcaggatccttatttggatatttgtgggacgtacatattcaaatgttgcaaaaacgattatcctattgtttgctaattcgttatttggctctacaaaatatcacataatcttttatttgccaccactcttggtccacgtattagtaagacaatgatcgtaccctggtatttcatctatctttttaatattgacgcatagcgtgatgtttgattatttattttatttaaaagtcataaatattatttattttgttgtaacttgtttaattatcgaataaactctaatattaccttataattttttttgcatatttacactaattaaatgttcgaataagacgaacatttatacgaaaaatcaaaggtgttatatataaaaccacgaggaacgaaaattccattaatttctatatgtgaacgttcacccaaggaacgaaaatttcattaattgagcgctcgtcaatgggtgcgcctagtgcacaaccaatctcacgcgtctgagtccacgcgagtacgcgacagtgccttgcctctcgctgagtatatagtccatctattgtttgccagttggtttcaatcgaattttaaataaataatttcaaaaaagaaaaaataactaaataaaaaattattgtacatagaaatattgtatatgtataaactttatacataaatatatgcattgaaaatttatttatataaagtttattatgtatatgaacttttaatccaaatccaaatctaatttagttgtataaactattaacttatcaaaaaatggaaaaaatgtggcgcaaaaaaaggaaatgtgattcaacacgtgagggataggcatgcgaataagtctttttgcttgacaataagcccaaatggccatccaaggtcatatatgatacatggatccacaagcgtcaaaagtctaagaatactcttataggcgaagaattgaaattgatacctatcgggtcatatatttttctccctctgcatgtccacaattttactacaacaaatcgagtctaaagaaagaagcacccaagccgagagctatgcgtgtaacagttgtgcatgtgaccaaaagtgaaacaaaaatatttaagagtaggactcaactcgcttatgtataccttgaatgctacaattcatgcatacctcatccgttccaaaacataacatattataatctagaatcggatgggaatttagagatggcagtcggcacgggtagtgactacccatacccgtgcccgtgaggtaattcatgcccgcgggcatacccgttactacatgagtacatgacgggcaaggaacactacccatgcccgttgctcgtgggcgccatgtacccgtgggtatgcccgtttacccgtcacaaactcatagttcaacatttcaaccataaatctccacaagcaaagagacattatcatagtttaaagaaagtgtacagttgtactaagttcaacaatacaagcgttacaagtacatcaatacttgatggtggcatttatactaatttgattgagggaccacattgtcagttgatttttgcgggtaaacaggcgaagcgggcatatgtagtgactacccatgcccgagcccgtatgcccgttgggtataggttttgacccaataaaaactcatggggtactaaatagagaacaaacccaactctattagagtttttacccatgggtaaacgggcaaatgggttaaattgccatccctagatgggatatatcctaaaattatgaatctgaatagcaagtctatccacattaatgggtgtgtttgcaagagcaagttctcaacacttctctctcttttttttcgtgcgcacgcttttcaaactgctaaacggtagattttttacaaaaagtttctatacaaaagttgtttaaaaaaatcatattgatccatttttgaaaaaaaaagctaatactcaattaattatacgctaatggaccgctccgtttttcgtgcataggagatgggttcccaacacccaccttcaaacacagagtactaggataagtcacaatcaggttttaaattgttatattatattagatggggcgattaaaatttatgagacatttatcaactcgataaatatgaattttcaactctaaatttagagttgatttttagtttttttttccacaaaatttattattcagactttgtttttatagatcattaaaaacatgtatataacattaaaatttttatatgaaaattatttctcgttcgtgaataaacgaaacgatgggtcgtacgaatgacaactccacctcctgtcatccagcttttccaaacgtactagtacgtcggttacaggccacagcaaattcactgaggagactgacatcagacattaacatctgaaacgattttataagcatggcgacacgtctagaacttcgcgttccactgcagcccctgcaaactgtttttctccgtgaatgtgctgaatggcgtcaatgtcgatcagatagccaaatgaccttgttggacatcacgtacactttgcattaaaaacactaat

SEQ ID NO: 51241 - DNA, 2509 bp, Oryza sativa
tctggtgcaggcgctgccgctagctcccccccatctcttcgatctcctagctgagctgatcagatcagctgatactgctagcttcctcgccatgattgtgcagtgctgcttacacgtgaggcctccacagggcaccggcgctgattggaggcccgaaagcaagcatgagagatgagagacgtactgtatatgattacggtaccgagtctccgggcagccggtatataaagactcatttttgagtttgggttactttacgtttttaagcagtgagttatagttcaaaatatcttgaccgtttttagacgtgttaggattttaacgctttacaaagcacttgtattttcatgtacgtatgtatgggcttgttagggtatagtaccaaagtcttggtaaattatggtactacttcctccgtttcacaatgtaaatcattctagtatttcccacattcatattgatgttaatgaatctagacatatatatctatttagattcattaacatcaatatgaatgtgagaaatactaaaatgacttacattatgaaacggaggaagtaccaatttttgggtaaggtagagttcataccatatacgatttgctaccaatataggagtatttgctatattgaagaacgtcctagagtggcattaccaatgctttagctctatgtcccctatccaaatcaatcactgaatcacactactatttaagttaccaaatagttagtagggtatattttggcaccaatccaaaatgatcctatatgaactagaataaggatgagcccgaaattcatctgcgttagcagggcccctatattgggcacattgctattgtgatagcctaaatccttaacatcttctgaattctagggcttatttgatttggagtcatttttgccctaccaaaatcttggtagtgtcaaaaccattgccaaattttggcactaccaaattgggtaagtattcaatttaaactattgtgggtaaaatttagtagcaaaccaaatatgcacttgctactattgaagttaccaaaattttggtagggtaataaattggtaccaaactaaacaagcccctagctatctttttgtgggccttttttttttctcgacgagtgatcgaaactgcacaggctatgttttatatgggccttatcaaacaattgacccagaaggactcagagagaggaggcccacctagggtaagaagagaactacagccccaggcctcacacatggatggccctcaataacagcccatccaattcatacaggtggatggcccgggattgaggtccaaacaaggccctctatagatttcgttgtaaagactgtcaagcacacgcacaaagcatacacgcatcacatcgaaatgggactatctatatctatacatttaacgacaaaattatgtaactacaatacaatacaactcatatgtaacttctaaaaatcacacggtaacatactatttccgcgatcagcaagcatctcgagatggaaacccctcatctgtacacatgttgtgattttttttccttacccgcttgctcgaatcttaaaacaattctagcagttcaaaattatgtgaaagttacatacaatataacctcaattatatataagttactatgtaattacactataattatgttgtattatttgataagttttttgaagaaaaaaatattaacaatgtatagcaaaaccatattgaaactttgcataggctaaggaaaagattggctagttgctaacaaatagttactacttaggactagtttggtttgagatctaaattaggcttatcaatatttggcaatttcaatagtgtttagtgtctatttggtttgaagccaaattttggcatgcctaagaaaatagatcatttcaatagtgaacttaggctattttggtttcaatccaaacacaactttgccttaccaaaattagtcatgccaaaacttgccaaaatttggcactgacaaaatttagtaaggcctatttatgccacaaaccaaaccaacccttactcaaaccttatcggttgatctaatatttgactgtaagccatacagtttattaaaaaaataatttcagagtaaaagtttatatatgtgttcttaacaatttaaaaaataataaaaaaagtaaactttcatgaaaaagaaatcaaaatcaagcacttcaaaattaaaattttggtagcaagctgtagtgcaaaagatgggagcctcaataggagaactccggcttgacacatggccagggtaaaaagtcattattaggtcatataatacattcattttttatatgacccaaacgaatatatgtccatatttattttaggttcgttttttatgtgtttgagggagttgtttctaacatactagctataacatataatgcagtctatgatcattaattgtttagcaagatagtgctagcatctcgatctggacaccgtccatttgtacactatagaccagtcccgcattaaa

SEQ ID NO: 51242 - DNA, 2576 bp, Oryza sativa
agctaggcaatcttaatcctcttaatttacttgactaattcagccagcagcatcagtacaaaatttagcagaggacacaccagtatcttttccggctgcactttaactctgcggatttgcggtgggccgtaagcttgatctgattctttccggcaagagcacggaagcctgtctgtactcccgtagatcgccgccacgtggtgctgttgctcgcggtcggatcgtgggcgagcaggccagggtcatttatagaggtaccgaacgccaaccgaccaactgaggccgttgaccgtgttgagagctgatggcgacttgcctgtctcagaaacccgtgtgtgcatgctttgcttgttgtcggtccattgtgtttctactacccacctttgactgaatcaaaggtgtatatataactagtgcagtaaaacagatggcaagaaattagttgttttaatttagaggcttggattttctttcgttaaacaagatcgattgtattaaaaaaaggagaatgaaaatctttgtctaagaagaaagacaaagatgaggtggatttgctagatatcattcgacggaaaattgaggatgagaacttagtgattttgaaatgttgaggctgacttgatgacttgtgcactaggcttctactcccactctggtgacccctgtaactttaatgatctctccaatagtaaggatgtggtaacgagtagcgaccaccttgttagtttctaggctcaggcttgggctgtgaaagaggggagggcatcaagaaggtagtagttaagtggatgtgtattattgcaaacaatgacgaaactagaacaaaaattattagggtcctatagtcgataattatgtaattatcgacaagtatactaattaacatgatataaattagctagaattgaataatatacctagtgtgctgagacctcgagagagtgtatgtaggaacgggttgcaaataaagaaggacgatataggcccggattaaagaaaatgatagggctggtagtaatggagatagaggactaaagggatgaggttagcagtattagagctagccggttgggcttgatgccagtgaggtgaagtgggatagcgcaacgagaatggtaggaagtggcataggattaagttggcgagttgcactagtcgggatgaaggctagctagtggagattagtacactactagataactgatttttcgacgtggtacccaaaatcacaaatatcttggttagattaaaaaccggtactaaagatactttagtaccggttctaaaagtccaagtccctagaaacatactaaagatggaggatcaactggtattaaagatagtggttctttagtccgagttggtgttatcaaccggtactaaaaatgcattttttgtaccttttggtaataccaaccgtgactaaggatatttttagtactggttggtgcctctagggttagttcaaaaggaaagcatctctatttaagtcagatgtgtgtagttggtggaatggtttcgcgcgtgagggttgagtgagagatcttaagtttgaatcctacattccacatatttttttcacttgctatgcatctttagtaccagttctctcaaccgatactagtaaagggggttgtaaaccgggactaaaaatcttttcccctataatgtattgagaggagggtagctctcatgtgttggactctaatttgatggtataaaagtcgtaagattttgagggaattattacaaatgcagtagtttcattgagaggggaatatttgcagtatgctaacctggtttcaatcgagctcgctaccactctctctttctcttgttgtgccttcaccctttgtttttcaggcaagcttcacctcctcgctctactttgctttctctttcttacttaccacaactctgacatctcctttttcccatgcaacgatcaacatttggaggtgaggatgaacaacgtcaccaggtaaggaggagggagtgtatgtagtggaggcttgatcatactacattaccatggttgattgctaattaggcttaaaatatttgattattagcatgggtcctccaaagaatggaggggtttagatgtactacctttaggttcaatgtgttggttgatctcgggagtcttgtgatgatgttgtccaccctgctcacctatgcatgtacattgccaaccacccgtgccacaataggaggcgtaccgatttctatttggaacatgtccctgagtccacatcgctatataaaaccaggaagtccggtcttgtgcaaaaggtatagccctcccccgataaaccataatggtcccgacgctaagaagtgttggaaggacctaaaggagcattcctggcctgagtaggtgactcctggagggacgctgacatcaacaaaatgatcactggcaacaatgactgtgccatcaaactgacctcgtacatatgactactgctatcactgcattgacataacaaaaggagaaattttgattgggcatcaaggacattcatggcttcttcctgatcctatcaatttatcacctcattccacattataat

SEQ ID NO: 51243 - DNA, 2667 bp, Oryza sativa
  unsure (1)..(2667): unsure at all n locations
atacccaagttaaaaaccctggacccgcccctggtgaccggttttggttgacatgataagtgggatgcacgtgagccccacatgttagtggtcgacttttctctctcctctccctcttccctctcttccccatctctcacatcctcaagcgtttgagcatggtggtcgacgaggaggggcgcgacggtccgcatcggctagaggagacccgacaagacgggatccggcgatacctaggtccagcagtgaatggaggcggcgacgcgtcaacgatgatcgtgagaccatcgagcttgagcttgacagcactggcgcttgtggaagggaacgacagggcacagcgcgcgtgcctctatctgcattgctggagttgttttagtctcgatctgctcaactaggttcgtctcatgttggagtgtataaagtgaattgcccatctttccctatcagcttaggcttttaggtgcaactggctggtgcatgcaacttaatatggtatcaaagcnnnnnnnnnnnnnnnnnnnnnnnnnnnnnnnnnnnnnnaaataaaataattgtagcccactccaatattccacgcttgagacttgagggggtctcacgtgagggggagtgttggagtgtataaagtgaattgcccatctttccctatcagcttaggcttttaggtgcaactggctggtgcatgcaacttaatatctcaggccccaaaattcttgcttgcatcacctacgtctagttctatcgtgcccatcgctagtcctcgatcctctttgttggctatagcaatgatttatgtgatctgttgaagctaagtgtagcacgttgtgacacttttttccatattatcctttgatttttcaatctcaactatcgatgtgtttatctgagttttgatgagtgattagcaatttgtctgtggccgggatactgtcggcgagaatccactaccaagcacctccgctcgttgtccgccatcgacgccttactggccctacagctagcagcaagtttgcgacgtcccccttagcttccttcgcgcatagctccaccactaggccaccgccacataactcaactgagaggagagattgaagagatgttgctgatggaccgtcgcggccccctcctcgttggccaccccgctcgaacgctttagaatctgagagatggggacgagagggaagagggagagggagaagagttggcctttgaaatgtggacctcacatgggcctcactcaccacattagacaaaaccaaccactataccacaaagggaccaattttaacatgataatgtgagttgaggatatgctatacctgatatttcagtttagagatgaattttagattcgtgacaacaaactagggacttaaagtgcagttattccttttcggttttagcccactagccagccagtagtaatggaccaggccataatagaggtcaactcctgcaaagcctcaaagtgtgaattttccttttcttttagagttaccctggtcttacagtacatcacaggtaaagcctgtcactggatgcatgtggatgtgcatcgacaaaatatgcattttccttgttgtattctggcatgtggatgtacttttttttttttttgcttcaatctgtacacattttcatcacacaaatctgctggagcctggggacattggggaaaaccgcggtcagccaaacctggggtcaacaaccatcgtcatgcgggaactggccgactgacctgtagatgagctacttgtttatatgctactttactaccaaatgttaactcgtgtttttttgcccataattgaccacagaactcttgaatttctgaatgaacagcacctgttctgaagaatctgaaaatggatgccatttgactttctgcaaaaaaagtcccaaatctgcactgatccaattccgtttgcttagttgctctagtgctgaggatagtagtcaacgtactgcaactgcctacggcctaataaccagctctgtttgacggtttcctgccgcagttgccgactttgcagtgccccgtgccaaagcaccaaccgaagatttcgctttcaagctggctgcacggcgagcaagtgtgcaactcgatccactccaccgtttgtcttaaaaaacggcccgatctagaagaaaacccggcaaatccaatccgggaaaacgctatgccgcgagctatggattccgaggcctaaaccgcggcaaaaacgtgcccaagcccaactcccgcgcggcgccgaagcagaggtggcgattcccaactcttgctgcgaagtcagcgctcgcgatcgcctactcggctactcggctactcctcctcctcctctccccatctcgtgccgtgcgttggtacgcttcatgggcgcagatgcctccctcgagatcgctcgcgtgccttctgctgccgccgctgctgctgctgctcgagtccgtgcgggacgcggacgcggggcccctggccgtggagatcgtgcggcccagcttcacggcgactagctacgactacgtcgacaccggcggcgcgttcttggtgtccaggaacggctcgttcagggcggcggtgttcaaccccgggaagcagcaggccagcttctacctcgccgtgctgcacgcgccgtcggggacgcccgtctggtcggcgaaccgcga

SEQ ID NO: 51244 - DNA, 5813 bp, Oryza sativa
ctgtggcggtcgttcgataacgccaccgacacgctgctgcccgggcagcagctgctcgccggagcatacctgtcgtcggcgaagggcgctaccgatttctcccagggggactaccggttcggcgtgatcaccgccgacgtgctgttgacgtggcaggggtccacctactggcggctgtcgaacgacgcccgggggttcaaggataccaacgccgccgtggcgtccatgtcggtgaacgcgtcggggctgttcgcggtcgccgccgacggcgctatggtgttccgggtgggcctcgcgccggcggagttccgcatgctgaagctggggagcgacggccggctgcgcatcatcagctacgcgctcgtgaactcctcggcgccggtcggcggcgacttcatcgccccagccggcgactgcgacctcccgctgcagtgcccgtccctcggttactgttcaccggcgggcaacggctcaacctgcacgtgcccgccgctcttcgccgcatccgtgacagttgccggctcgtgcacgccgggggacggctcgacgctcgcgtcgccggccgcgtgtcagaacaacgacagtagcagcggcggcgcctccgtttcatacatcgccctcaagccgctgacctcctacttcgccacgaagttcgacgccccgacgaacaccggcgtcaacaagacggcgtgtcgcgcgctctgcaccgccagctgcgcttgcctcggcttcttccacgacagcgtctccctgagctgccgcttgatcggaggaaagcagctcggctcgctgtacaagggcgcatcagatacaaacctgggatacatcaagacgttcaactccgcaaccaaggccgggagcaaccaaatcggctcgtcgtcggcgaaccacaccgtgccgatcgtcctgccgtccgtcgcggcgttccttctcctcgccgtgctcggatggtatatatggtggaggaacaagatgagcaagaacggcaggaaaaagaagggcaagagctccaccatgaaagtgtacttgggccgtcagaagtcgccgtccagggacaccggctataacgcggacgctgacgacgacggcggcggcgacgatgacgacatcgtcataccgggcatgccggcgaggtttagctaccaggagattacaacgatgacctccaatttcgcgacgaaggtgggatccggcgggttcggcaccgtgtacaaaggggagcttccaggcggcgaggggctcatcgccgtgaaaaagctcgaggccgccggcgtgcaggccaagcgggagttctgcacggagatcaccatcatcggcaacatccgccacgtcaacctcgtccgcctccgcggcttctgcgccgagggttcccgccggctgctcgtctacgagtacatgaaccggggctcgctcgaccggtcactgttcggccgcacggggccggtgctggagtggggggagcgcatggaggtggcgatcggcgcggcgcgcgggctggcgtacctgcacaccgggtgcgagcagaagatcgtgcactgcgacgtcaagccggagaacatcctgctcgccaacggcggccaggtgaagatctcggacttcggcctcgccaagctgatgtcgcgggagcagtcggcgctgttcaccaccatgcgcggcacgcgcgggtacctcgcgcccgagtggatcagcaacgcggccatctccgaccgcgccgacgtctacagcttcggcatggtgctgctcgagctgatacacgggaggaagaaccgcggcgagcaggaggcggcggcgccggccaacaacgtcgccgtcgctgccggcagcggcgagcactcggacttgccgtccggatggagcagcgcgatgacgtcgacggcgagtggcacgagcggcggcggcgacgagtacttcccgatgctggcactggagctccatgagcagcggagatacctggacctcgtcgacgcgaggctggaggggcgcgtcgacgaggccgaagcggcacgcaccgtccgcgtcgcgctctgctgccttcacgaggaccctgcgctgcggccgagcatggccaccgtggtgcggatcctggaaggcagcgtgccgccgccggagccgcgggtcgaggcgctcggcttcctccggctctacggcaggagctatcccttgccggtgccgggttcgttgaccgccatggccggtggtggctcgcatttggacgagtcactgaaggacacgtcagcaccaagatagcactatgaagaccgagctgcatatcatccggcacatatgacgtggcactgtacaattgtccgcagtgccgacgtggcagtacacctgtccattatagaatccatggaaccgattaacctgacgtaatactccctggacgataatctgcaatgctgcatactttcgtcggttcctcccgtggttatatgcttggcagtatctgcagttcttcatctgataaagaagaagagaaaactgatccatgaggtgtggacaggttgaaaaacacaaaagaatggctgccatagattaaaagaactatgccaacttgtccatgtactagagcattagacaaagttagctttgaagctggtgacatggacagatgataaaatgattgctgattaattagtactccctccgtttcacaatataagtcattctagcattttccatatttatattgatgttgatgattcatcaacatcaatataaatatggaaaatactagaatgaccttatattgtgaaacgaaggaagtatatatgatctgcccggtacatttgtttgggaagtagagaaggctgtaaactgtacttaaaaccaggaaaagaaaacagagataaataaacggcatacacttgtaatctttctttacataccaaaactaaggctgcgcgttcgagtgcaggagaaagagagaaagatagttttgtgttccacgcgtacgtttctcgaactactaaacggtgtgtttttttgcaaaaaaattctataggaaagttgctttaaaaaatcatattaatctatttttgaagtttaaaataattaatactcaattaatcatgtgctaatggctcacctcgttttgcgtatcttcctaatctcctcaatcctatccttctcaaacacacactaagtattgcattcttttttagatgtttgtttccctgtacttaaagacacccgttaaacgaggagaagccagtggcttagcggcgagaacgagtttttttttcctcatccactaggttcaacacaattatttacagaatgggttaaacattgagcttctttgacgtgtacagtagggctttaattatacacatcagtgggacaagcatgaaccgtgtgtccttattatacattatctatgttttcgggaatgctacatatcggaatcccgtccgaacgggacacttgcttatttaaagaggagcgatacctgaccatgcatgtcccgagtagcagtagcagcctgtacaggacacggtgccgctccagcacgcacgcatggctgacataggcggcggcgctacggcgcccatgcccgcaccgtcaacgcactaccccgcgcgcgaccgcgagctccttgccggcagcactggcgccgtcgcaggggaggaggagcccagcgcggacgcaacggtagatgtggaagtagagcgcgaaggtgctgccctcgccgcgtcgttggcgtggagcacgacgagcacgtacttggctagcttgtcgaggcggcggaggaagcggccgcccgcgacaagctccgacgtggcgtggacggtggaggatgtgactgtcggtgacgagttccggcctgggacgtggatgacgaaggacacgcccgtcgacgactgtcacgcccagaaattcacgaaccagaatttctaagctgaatgtgcattaaatccctgtccaggaccagcccgggtacacaaacgacaattgttgacatacagatccacgtcttacaaaaatagaaaagattacaaatgcagcggaaaagataaaagcgagctaaaccgggaagcttgacttcagcagcggggcgactccactccacaggcaatccttgacggcagcgacaaaaccaacttcaacaagatagctccaactagaaaaatctttagctctggtgtgggggaaaagagagcaagactgagtactacccactgtactcagcaagtcataccggaagaggaggtatgatgcaggatataaccaaaggaggctaggggttcttttggacaaagctagcatttaaaagcagtagttgaaagtagtaaaacaattgtagtaaattaatcaatattaaccaatcactgttcaacgctacaccacgttgcaacaggcccaaccaaccacctgaactacaccagttcattaagctaaactaggggtgagactaatcacggtgaatttggttgatcgcccataaccgcgggcacggctattcgaatagttttactctggccagaggtttacaactgtacccacaagacacgattccacacatgtcgccatgccccgaagtatcaccatgatactgcaaagggggaaatcgtgacaagatcctccacataaccctcccctaaccatccacaccacgctaaggtttcacccccacccctcaaaaggcagtgggcggtcccctcttgcgccgcggtgaatccggcagctggataaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccagtccttaactgccatgggtgcgaccagcaaaaccatgcaccacagcccaccattcagtgtattttaattaactaacaccattgcggtggcaccaaatccaaagctatgctagtagacaaagtctatgtaataatgtgatccctttttgtgtactagttgagctaaacatggctaagcatttcctaaaccaacatctaatcattttgatacccaggttatcaatggcatatggtaaacaataaatggctgagtaataggacccatcccacatgacattgtaaaagaatgtaacatttaatagaaatacgggacatttgtaaattgggtacaatatgatcaattgtaatgcatgacttgccttgctctcgcactgatgagaccacagcaacgtcttcgagaaatcgtggatcgacgaaacggccgaaatctacgtgacaaacaaagcacacaagcaaaacatgctataagactactgaaacaggaaacaaatccatttttagtggattctagggatttttatgaatttactgagacttgaatggacttaaacggagctcggatgaatactatgaatttagaagataactgtgtttttactaataaagaaaagtccttaatcaatttattgcgcaataatacccagggctgacgtcatccaggggggcccggctgcgccgacaggtgggccccgcttgtccgcgcacaaggggagggagagggggctcgagcaagtgggccccactagcagcggcacaaggtggtcggtctaccgtggaccgggaccacgcggtggtccactgccggtccacgggaccgacggtccggatcggcctcaaaagcgatcggacggcgcgggggcgcggggggggggggggggggggctaggcatggctcggctcggcttcaaaaccgaccggcggccatggcggccggcggcggcacgcgcggtcaccggcggtgaccggcggcgcgg

SEQ ID NO: 51245 - DNA, 3066 bp, Oryza sativa
gcggcggcgcggcggtttggcggcagcggtggagctccggctccaacggccggaggtgggagacgaccgacaggtggggcccacctgtcggtgtcccgagagaggagggaggggcggcttgggccggcccacaaggaggaggggccgcgggagagggatgggccgacggcccaacaaagaaaaaggagggaaaagaaaagaaaaagagaaaaaggattttcctgggattaaaaatattgcacttgctcaattttaattggttaaaattatttccaaggctgtgaaaattccactaaaaatcatgttaatgtattggagcatggggaactcaagaaaaattccaccacgccgaattcgattattaaatgcatttattaattaggaatttagctctaggttacttaagataatttcttctggcaatttatttaaccaatttttaaagaaaaaaaaggggggggaaacttcagggtgtgacaacgacgagctccgtcgtgggatgtggatgacgaaggacgcggccaccggtgacgagctccgtggcgtcgacggtggaggatgcggccgtcggcgacgagctccggcgtggggcgtggatgacggaggacgcggccgccggcgacgagcttcgacgtggcgcggacggtggaggatgtggccgccggcgataagctccggcgtgggacgtggacggtgggatcaccggcgacgacgctttagtgcctggctcctgatatctggtatgtatcgtctgatacctcataagtatcatcttctacgtgataagaatcacatgatatctgataggtatcatttgatacctaacaagtatcacctgatacgtggtagaatcgcatgatacctgataggtctcacctgataccgggtaggtatcgggacctgatacctcgtaagtatcaccctctacgtggtaaaaatcgcatgatacctgataggtaccatctgatacctcacaagtatcatctgatacgtggtagaatcgcatgatacctgataggtatcacctgataccagctaggtatcaggacctgatacatcgcaagcatcacccaccacatgataagaatcgcatgatacctgataggtatcacccgataccggctaggtatcaggacctgatacatcgcaagcatcacccaccacgtggtaagaatcgcatgatacctcataggtatcatctgataccttgcaagtatcacctgatacgtggtagaatcgcatgatacctgataggtatcaggacctgatacagcgcaagcatcacccaccgcgtggtaagaatcgcatgatacccgataggtatcatctgatacatcacaagtatcacctgatacgtggtagaatcgtatgatacctgataggtatcacccgatactggctaggtattaggacctgatacatcgcaagcatcacccaccacgtggtaagaattgcatgatgcctgataggtatcatatgatacctcgtaagtatcacttgatacgtggcagaaacgcatgatgcctgttagatatcaggacttgataaccaccaggtatcgtttatctagaccgatcccactatgtatcaaatatgatacttggccatccagttatctagtacttgataccaaccgatatcacacacgatgcctgttatgaggcatggcacccactcggtatcagacatgtgtgatgcctgttatgaggcatggcacccactcggtatcagacgtaatacctaataatagacttgatgctcacccggtatcagatgtgatacctacctagtatcagatttgacacctggtagctaggtaggctactacttgctatactgaactagtttagctatcacatgaagattttttgcgtatgcacgtggacaaaatgacaaacgatggggtgacatgacacaccttttgagacacgatgacagacatactaattgaatggaaggaatcgtccggctaaattgcttgcgggcctataccgtccgaacggtataccagtatatagcagccccccaatgttttctaaggaaaatccacctgtacgttgaatcttgcaagtattattttgtgctgtggtggagacgtatgcgtatatttgatttattttcatgtctatagaagtaaaaaatggtacgaataattattaatttttaaagaaaaataatgctctagctcacaggaatacaaagagagttcggtgggtgaacgaaaagaagagtacaagagtacgtactacttaccagtgttgatataggaaatgcacaaattaatttatccggcttttagcattgggaatagttaggccctatcttttagccaaatgctaataatacgccgtactttgcatattagtaaaaaaaaactaagtaaaacttttatatacgtactcttagtgatttaagtgttaaaatgaaaatgaaactttgataaaaatattgcaaaataagccttaaaagtaagtttccaaatttaaattttgtcaatggtcgattctatacggaggaaacgatgggccttttgctttgctaaatctgtgattatcaggtagcccgttgccacaaactaacggtacatctcatcctaaattttgctttatcagtcagaaacagttgatatttgctaacaacatctgcggctctgcgctgattgtcaaaatcaagctagcgatgacaccacatgaccacagagtcaacaaacagccaaacagttctacaagaggctaggggccggatgctggcaatatatactccctctgtcaaaaaaaaaaatctagaactagacatgacacattttaatactaggattctagataaaggtgtgtccagatttgtcctattagaatgtgtcacatctaatattagattggtttttttatgggtcggagggagtgcagagtattggacgtgctcggactccaaaacatatgctgtttggaaattttttaaattttttaagtgtccttagtgctttaaaagctaatgtcgaaaaagaaaaccacattaaaaaaacctaaaattttctctaaaaattaagtttcaaaatttaaattttgg

SEQ ID NO: 51246 - DNA, 12806 bp, Oryza sativa
cttcttaaaatgggacaccttcttcttaatataaaacgtcggcaacggccttaccattcgaaaaaaagacctggctgaaagagttgtaccacaaaactggtgaagaaagatgcactcagaaatatgccttggcattttccttactcaattaaatcatttaaatatgccccgattaatttatccacaagtatgaatttgtgtgcgtttcaacaggcattgaaagggcgcagataacttgtgccaaaaaaatatcctttgtctttttgaagggggatgagatcatgacatgtctttcccaccagcggcggagtcaggtattatcaaagagtagagttaaggtaggacttaattaactagtgagttattcattttttttatcacattctcatggtgatttaagagaatttaaccataattttggaggcaaatatagggcttgagccctagctaccctaagcctggcaacgcccccgtttctcacccaaaaaaagccatcggtgactgtacttacacaatgactttaaagcaggattactcacactgttttgatgatttggacactattatgtaaccctaatgttatgtacgtggtttaaatggggatggatatcatgaatacagaggaagatacaaagatataagggtgtggtatgctttctcattcattctattcttcacaagtgtacaaccccatcacctcctaccctctatttatctcattcacctcccatacttagcgatgaatcaatttattaagtaaccgggctgggtcttcgtgggtcaccggtttcctaccagaaaccatttagtctggccctcctttcacaagattatgtttcacccttcattgtcagttttattgacggactacaattcgttttcacgcatagaagtccctttctccatcaattgaaatggaaagttcaaattctttctatgaaatatagctgagatatggagtatatagcattgtaaaccaagtttagcaagtccttttaggttgcatttttgtaattttagcaaataaaaaaacagagagaaaaagtcaattcaatccaaatttgaactattctgagtatgatttattatttttgacttttccaccaagtactaattaataacgtctacattatggtggtgcactatttgcatgggacaatgaaaaaaaaacaatatcacccaaaggttacaatttgtatggagagaaaacaatatcacccagctactaatccgtattttgataatgaaatatggatacaaaatgttacaataagatcaagcagaggctttcagctctgccagttctccgattgggatagcagcaggagcaggagcaccaccagttgttggcctgtaaaattatacaatctcttagaaatcctacaaagaaatgttccccgtaagagaaaataccgtgcagaagttcagatagacttacaggccaaccataactttgaaagaatcatagatcacccactgagttccagtcagtgtaccgatcatgaggatgcgaagaggaaggccgcgggtgaaaaggccccagaggccaaggttcttgacagcctgaaaagaaataagaattcagcaaacgaacacaaaacaatcacacattggcaaaacgcatcaagtcaagtatagctcccggctgtgccgttctacagggtgcagacttacatctccaacggtggcgcccttggagttgttgagaaacgagaccaagttgtcagcagggtgcgagacggcggcgcagaagactccagcaatgtagccactcccgaagctgactccaagctgcagaggcttgctgcattgctccttcggtgtggggatgagatgcttgtatgccatctccacgatgttctcgtacgtcgcaaatttcatcatagtatctgcaacaaggaaatgccactcacagttcagatgttcatgaacgcaagagagctgatcgtgatcgtgacaaagcctgaatgttacagtaaagcagagtaggagtactcacaaggaatctgacgcccccaaagcggaaccaagcctctgaacagactgcaattaacaatcagctacaggtttaattaacattctactagatcagtcagaacaggataacaaagaactcatcataaaaaaatatacataccctgcatagctttcgttcctgacgatctttgggaagccgtcgctgagccccctggcgtagccgggctgcgtctgcacgcggaccttgacggcctccatggggcagagcgcgacgtcggcggccacctcggcggtggccgagccggcgaggtagatgagggtcttgtacctggcggcgtactccggcccggccatgtcggcgtactccttcttgaacacctcgtacaggccgtacttgaacgccccctgcgcgctgtagccgaggaacgtcggcgcccaccccctgtagaagccgcgcgcgccctgctcccgcatcacgacgccgaacgccgacgtcgtgctcttgtacttggtcgggtcgatctgcgagacgagcattcgtcgtgtcagactcagagatgagaaaaaacgggaaatcagcatttatcgatggtgattgaaatggagtaagatggaattctaagatgatgggccgagaggtacagagcccatcaggcctactagtcctgttgacgaaaagttccccggaaagaaaaatgtttccagccaccgtcagtacgtcacgggtgacgagctcccggttcatcatgtttgtgagtctgtcacgctcctactttctcggcagctgacttggacccgaaactcccggtcaattaacacgaggaaaagtcttccaacaaaatcttcgagccatcgacaacgtagaacatagtagtaggttgctatgaacttgtttaatttactaccatattaccatatcataggcaacttttaatagtgtcgaatttttagacagcttatgagtgttattggcatattttgatactgaaccaaacattagacaacaaactattagagtgacaataatttgataaagcatattttggtatcaaatcaaaatgacctaaatattctgggacggatatagtagctaaattcacgaggtgctccgtttcgtaaaattttgcagaaactttaccaatatccgggcacgtcaaattaagaagcgcaaatctatccgatttttttttaactgatagctcatgtgtacctgtatgttgcatttgatgacgtcgagcggggtcacggcggcgtgggtgagcccgcacgcggcggccccgccgaaggcgcaggcggagtagtatgccggcgagaacagctcgatcatcccgaacggcggctcgctcggcgcccccgcgacgaccgccggcgcgcccccgccgccgccgccgaccccgtcgtagaggaagctcgggagcagcgagttgcgcggcgccatctctgtcgccacgacgctggcccctgtggtttcgtggtggttggatgactttgatcgccgcgtcgtctcgggccgggcggctttgtgttgtggacaccttgtggtgttcgttcgttcccctcgttgtttggagcttcgctgcccgcgcgcggccgtttttatacgggagaaactggaggaaaagcgattgtttggttggctcgtcggctgcgggctcgcgcgcgcgcgcgggtgcagtgtgccttcgcgcttggcggggtttgaccgcgtggtgtctttgggagcaaggtgatcgaagggagctggtcgtcacgtgccagcctgcctgcagtcaggtgatgtcaagtcctctggtttgggatttgggattaccttcctgagattggtgttaattttgaccctgtggtttattaggagaccgtgatctgttctcgtagtgaatttctcctcaacttgcgagttgcgacctgcgagggagatgttctggtctggatacgtcgactcgctgttttggacttcggagatgcattgcatgatggcggtctccatgtaggggtgggctaaaaaaagaccgaaccgaactaaccgagaccgataactttagtcataacgttgatctccatagtgtactaatcaattgggtcatgggtttcacttaaccgaaatacacttcaagaattaacccgaatacactccaagcccaacgaagaaattctaatttcctatccctcccaagtcccaatgaaccccacggcgcctcaatgccaccgcgccatgctcgcgcctcttcctcacaggcccgcgcctcctactcctcctccagtcctccactatggcctcccctcccctcatggttgtgttggctggttatctgatgaaattattgtgaataccatacactgagattttacacaccgactctgtttagggaacttatatctcttgatttttttttaactgtctaatgtctactgttcaaacaccttggaaaaaaaatcagtcaaatttaaacgaagaagattttaattcgtgcaccccctaaatctacgtcccttctcttctttctcaccgttacacttcaccgttgtccgtgcttgttgcccactgatgatccgacacctccacgaccttccctttcaaagccgcctcatgtctctaagttaaccaaaagactataaggagaacacaatgaggccgaccgagaaataggggaatacttcaaccgacacaagcagaccttgctccttgcctgagcatatcatacggactcctcacttcttcttcttcttttttctttttttttttttttgcgtggaaggtatgttaagttaaacgtgatttgtttgtatggacctaatttatctatcttctcttccttccttttttgcgtggaaggcatgttaacttaacgtgattttcctgtatggaccttaattatgttctctcttaatttatcggcaattcggcagagctatgaggccgtcattccctgtatcttcctattttgaaggccgcccgctcgcgcacaatgcatggcgtctattccaaaatccctttccctccacgacaccgcttccagcccacgcaaccctcgaacaatggcgagggctcgccggggacgacaaaacgccgccgcatcgccgccgtcgctggccctgcagctgcaggtggccagcctcgtcatcgtcttcgtcttcgccttctcctccgccatcacgcctacacgagctgatcatgtagaaggacgtaagtgcacttctcagctgcttcgatttcaatccccttcaccacgcacgcaggtaggagtacatagcaatcgccgatcgagcatgtcgtggcgtctggcgtttggacgacgatatgctgaaatcctagctccgttttttttaaaaatttttatccgtgtgcagacatgtcgcacgagatgtttggctacgaaaacgacgcgacggggccggcgaagtggggctcgctgcacaaggagtgggccgtctgcggcgacggcaagaagcagtcgccgatcgacatcaccacggtggagccgcagaaagtgaaggagccgctgatgcaagcctacaaggccggcgccaccaccattcagaaccgaggccacgactacatggttagacacagcgaaagcttgcatattactactccgtcccaaaataagttcagctgtggaaatccgtgtccaacgtttgattgtccgtcttatttgaaaaatttataagaaaattaaaataagttagtcacaaataaagtactatttatattttatcatctaataacaataaaaatattaatcgtaaaaaaaattcaaataagacgaacggtcaaaagtgagacataaacagtgcaaaactgcacttattttgggacagaaggaatactgtattattatttttagggaaacggtataggtacggtcagaaatttttcatatttgtgaaattaactactagctagtactccctccgtcccataatagatgacgtttttgactttttatttgcaacgtttgaccattcgtttttttgaaaaattagtgcaaatataaaaaaggataagtcatatgtaaagtatttttgataataaagaaaatgacaaataaaataaataataattttaaatttttttgaataagacgaatgatcaaacattgacaacaaaaactcaaaaagacaagtaatatgggacggaggtagtactatttagcagcaattctaatacgatgcatacagtaaaagataatcggaaacgatattatttttatggaaacggtattgggtaaacctgcaaatatgcaatgctgattgcaaaacctgcgtgatcttgtgtcttcatgtatccaacgttttggatttttggtctcagctgaaatggaaagatgggaatagcaagctgacggtccaagggaaggagtacacgctcaagcaggtgcactggcatgaaccctccgagcacacaatcaacggaaccaggtgcggatgcatgatcctggcaaaaactagctgcgcactttgttatcaaaataaaaggaattgtgaatcaattgagctgtagctagctggattaattagcggtggtgttgtatccaacaaatgtcagagtgtggtcggttcgaacaattaatgggattcatgcaggttcgacgcagagatgcacatggttcacgaggaccccagcatggcgagagccgtcgtctctgtgctgttgagcaccaaagcaggccaacccaacgcagtgctcaccgaggtagtaacaacgacgtgcctcaccgttcacctgaaatggttcgtttccatttcatctcccacggagaggccaagaaatggaaatgaacacatctagatgaattgtgaatactaactagaaagtacttgatgtcaaatagtgatctttagtactggtaagtggtactgtataacccaatatggtacatggaagattggaagtgctagctagcacggtagcacccatgtccccacaaatgcaaaatacgttcccacgaagtaatacgagaatatattttaaactctcgaatggatgttaaccgttatttcatgtagttcaaataattaaaaaaaattacaagattgattaatatataatatatcgctacataaatatgtatgttctttacaagttttttataaaaacacacacattgaactctagctactttacatatgttaacagccattttttattgtaacttatagaaattaaatttaaagtaacatgtttgtgaaccgatatatcgcatattaatttatccttttttaatatatatatatatatatatatatatatatatatatatatatatatttgaatgacatgcacgaaacaagaaggcattccttttatagtttacaatcatttctctagtaatatctgctatttttagtttattcaccagattattaaaatggattatatgctccacactttgaaaaatacatttaaaaaaattcctaatgcattgctcaaaccacttgctttaagatattagttaagtatatttcttaaaatatttaatttgttcctgcaatcaaatcaatgatccattgaataatctaaatctaaatcaaacaaaagtagtcatgcatccccactactataaacggcttatatatgctgcatatacatgcagatggcgccacatttcaagaaccttgctggtaaagagaaggccgaggaggaagtgaaggagcctgttgatccatcgacctgggtagataaaacctcaggctactacagatacgacggctccctcacaacaccgccttgcactgaaggagtgatctggacgatcatgagcaaggtatatgaaaacaatggactagatgattatgagctcatgttcttcgtttcctgtatggcatttcaccacaggaacagcaatgcatactagactaaatatgtaagcattagctgaactctctatgcttaattgtctaacagataggagatgcatcgaaggagcagattgacttgctcaagacagtggctacggtatgtacgtgctggaagagtgtgaatggctgaaaccataaataattgctctacactgtaaaattcctgacgtttatttgctaatgcagactgtggaaccaaatgcacggccagctcagaaactcaacgatcgaattgtgaggtactttgaagtttaatctaaagatgaattagggtgtgtttagttcctgaaaaaagttgaaagtttggggaaagttggaagtttggaaaaaaaaaattagaagtttatgtgtgtaggaaagttttagatgtgatgtgctgtgatgaaaagttgaaagtttggggtagttggtggtgaactaaacacggtcttaggattaaagagtgactaaagtgtgcatttactggtagacgatgcaacagaacaggtgagcattgtctaatgtctacagtatacagggtggccgacagaaaacgagaaatctagatgatcaccaaaaattactgacagatcgaactttgaaatttcaatttcaacattgaacagttctcatctaatgaccaattgtcttgactttagcatggtttgcaaaatcagtttctggattcatattgttttggtggttttgaccagttacaacccgtaacccaagaaacactataagattgaaccagctgcttgaaaaacattttgcatatttacctcacaagtcaccccaaaataaaactgcatccctaaaaccattgccattccaagttttttcactgggccggctactgagagccagcaaacctttttatgaaggagcaaacggtacaacaaggttgttgcatctactactgccaaaccactacagcaaacagcactacagcgccttgcatcagaagggcgcacagagctagcgccaccaggacagcgccacaagaaaacagagcactacgcgcagcatatgttccaagtttttatcaggtatcttaggacatcaagaggcagtagatagaccataataccataccagattgagtacagccttaagccattctgaccagaacatactaaatcccaatggcatattaacctcaaatgttgcttcaatttaactgctcggacacatccaatgaataactacgatcataacaatctaacactaaagctaaggcatcctctggaatgtactactagcatgttatagtttgctacagcgatgttgacctacagaagtacaaaatagacatgccaatgccatcacagaaatgtacgctaagagaacagagattaatagcacagttttcaaaattccaagcacaacaatcaaaattgttctaccaacaagctccagcatttgaactcaatcaggtaaacaacataatataagttactcgagaaggattgacacacatcctctattgaagtgacggtaaattgaaagaaaaaaactagttcttaaccaaatcaatttgatgaaagaatcacacggcatcttgttttattcaacccggactttcttgttgttcatgtatttgaacttacatatctcctcaaagaaatcatcagcggcatcatggcaattcttcatctgcgagattctgatgaccatagagcgcagcctcacgctatacttcacaagcgactcgagggtgttcagcttctgctcagcatttagtggtgagcgcactgtgatcaaaacctcttccaagcaagggatgcagaaccttgcatctaactgcattcacaattcacaaatattagccatctatcaataccttacataacaacctaaagttcaatgctatgccgcgaaagccaaaccaaacactcacattcttcaagctgtttttctggcacagagcagcaaacatggcaccatgaatatcaaacttgcggagattcgggtggctgttgaagaagtcgaccaaatcgacttccgggaatggctggagcgcgtcaaagtcgccactgaactcaattttcatcactaggtgcttcacatccctcgcacactgcagcacagagcttactgcagcccagctccactggacaccgcgtagagagaggtgctccagatctgggagcttcccggtgtccaccttgtacaccctccctacataatttcgtcgcaaagtaccacatcatgtcaacataatctaactacctcgcaacaacatgtcagcgtgattactgattaagaattcgctccccgcatcatttcatcgcaaaatagcatatcacatcaacataatcctaactacctcgcaacaacatgtcagcgcgattaagaattcgctccccgcatcatttcatcgcaaaatagcacatcacatcaatataatcctgactagtactctacctcacaacaatatgtcagcgtgatcaacaattcggggcggtgtgttgcgtacctgtgcttttggcgattgagaggcggcggaggctgtgaccaccgcgcagagtaatccaggtgaagccctggacctcgagtgactcgacgcggggagcggcgagcgagagggagcagttgccggctccgaggaagtcaagccggcatcgctcgagcagcgcgagttcgatggacaccgcgcccgagcagtcgcatccaagcagcgacaggtcggtgaggttggggcacgcggagatggcgtccttcacggcgctgtcctctagcggggcgccgacgatctccagcacgcggagcttgtccagccggccccacgccggcgcggccgtgagcgagaccccccagagcctgagctcctccaggcccctggccaggccaatgcagtccaggtacccgccgtcctccgccttatcggcggcggcggcgtccatccgcagctcgagcaccctgagcgaggtgctccgcagggccagccactcgggcaggcgggccatggagaaggggcagtagatgaccagctcccggagccgctcgacggacctcaccatccgcccgatggcgtcgtccgcggcgccccccgccgccgcggccgtgtcgaaggcgttcctcgggaagaagagcgccggcaggtacggcacgcactcgcgccagcggcggcacacgcaggcgcacgccgccacgtcgcggacgttgctgagcatcgacaggacgtgctgcacgacgccatccggcacggcgttcatgtccgtaccgcctccgccgccgccctccatgtgctcgacgaaacgcctcgccgctcgcgcctactcacagtcacagaagaagagacatgggggatcgggacggcgatggattggattagatagatcgggggcacgggggggtgtgggggcgcgtcggggaggatttgaaatttgaaacggcggaggtgggtggtgcggcggcgagcagcccgcccgctcggcagctcgtgggggagggaggggaaattttcgaaattgcagcgaccgtccgctcggattcgggaggttcaaatacgagtttgaaacgggagcaaagggtttgagggtttacccttttggggttggcggcggcggcgggcggctgtcgtggggaaatgggccgtgggcttggaccgattgtcaaggcttcgtgtccttcctgacaatgtctctcccatgggtttttcctctggttggtattgtagtgctcaattcccatggagtactttgtactttatagcgatggcacatcaacgtagtctaccacctaaacctaaagcacggttgctgaaacagtgaaaggggtttgtgctattcatcgtctggtttctcgatctctcaccagttttcctcgtaattggatatagctctccaataatgctagggcgatcatctgcggcaacggtaaagtgatggctcgacatcgttctaggtggtagataatagggtattgttgatatagccacgagcgagtgagctagatatggttacacccaggataaaggcgtgagaactatattgttaaaaaccgatggtgaatatggcggcatgaaacgtatgggaagctgagaggtgattttacactaacagatggaacaagtgcaggtggcgggaggttgaagaaacaagttggaccgtcagatttcaatccaacgatgagtcgaatcttcgttgtttgatcgatagtgggccccctcgagaaatatttctagtttctacttagatgaatcgttccttcttttggggtatgcgtttaaagaagggtatgcgtttgtttatagatataaagataacgtacagtataccctatttatcagtgtaataagtcgggaaagactattattaattgtagtagtgatgctgaagttaaaaaacataagggaaacattcctaattaattccacccgtcattagtatcaattaggaaactttgatcaattcctagggaattggcatcatattaattgttccaaatacgtggctagcattacgaagcccctttctctctcttttgttcgtggtttggctcttccatataggtgccaatactatttcttttttcactaatagtagtgtaatgggtatatatcttgtgtgctccctatattttcatgagggtcaaattatgtaaattatcctttaaaattgcacatatactgataggtttttatttgatggtgcatttttatttaccataacacaaatttagtaaaaattcaaagtttgctagctccgcccatgtaagaaaatttgtttgttatattttctccaaggaaattggaagtcctgtcattccaaaatataagtatttctaggtaaatagctagaaatgctcatattttataatagcgggggggggggggggggggcgggtattttcttggtctacgatgccagatttttttcctaatggggttcatgatttgaatttaaaaggcatagttagaaaaacagtgataaattaacatactagttcaaatatgataatatataaatagatctttcgctctctcg

SEQ ID NO: 51247 - DNA, 1146 bp, Oryza sativa
ctcgtaaaattagttgatatccatgcatgttactggcaccttcttgttgggctgattttgtggcatagtagaaaatgttgggtggttgtgcactagtggaaaggagaaagagcaatcaagagccgtaggatggaatggacgatggatatagaataattgcacaccaccccaaagtcagatgatccggatccgaggtggtatggtacagatgtacccccaccatgaaccaagttgcattcgccaccctaaacatagttttctttttgtcaatttattttatgattttaacataatcattctaaactccagtaagtacttgcttggtcacttttgacatagaacatgaaatttgggctaaaaacctccactctgaaaactatattttatttatttcaaacatgtttttccatcgtatattatattgagtaatttgttatgaggatagctgaaaaaaattattgcattttacctagtggtgatcgattgtatagaaaattagtttattgttggctagagatattaattttatacttttaactcaaagtttgtctctaatctgccttcatcactgggtgtggtaccacaattagacacaaccaacatagaaatgaaagaaaagaaaagataattgagcatatgtgtaaaaagttatgtctctatttcttcttggaattgctctcctgcaactattttgttgagtgctatccacgatggattggacaatcatagcgacaagataaaaccgctagtgatggtgatgtttttccaaccaatggaacaaattccacctgtgataattcttcacgaatactactacagtactccatgatggttggtttcttccggaaggacgacagatttttgatggctcaccatttcaccaacatagtcttcttgaactatctactcatccatttttagttatttttatttctataaaggagtacttttatctaggtgtgtacacaagtggtcataggaagagcatgccattaaactgtcaatgataatgacacctagaaactgttccagtggaacgactaatcgtgatgaaacaaacaatcaatcacttattatttataggtaattagctcttctaattttaatgttgaaggttagttactcacaaatactttacttcgaaat

SEQ ID NO: 51248 - DNA, 2229 bp, Oryza sativa
aaaacagaaggcgagtaaaaccaaaaaaacgctagccgtgacgacgaggacaccaccgcactcaaccaacagtcggcgcaccagcagctgaggttggaggaggaggaggaggcgccgcccctcaccgcacctcgcgcggcgcgggcgcaggcggttgcgagcgacggcctcagcggcggcggcggcggcggcggtggtggtgaggaggaggaggaggaggagcggggagagtgtcgcggtgttgtcagggtgaggggagtcagatgcgcgcggaatggggaagcccgtcgatgtggagctcggcggcgcggcaggcctcgagatcgccggcggcggagggggaggagggggaggggtgtgggccgtcgccggggcgatcggccgcgccgcgtcgttccggtgcgtgttcgtgctcgcgctctccgtgggagtcctcgtctcggcgctgctgctcctcgtgcccacccgcgggcacgggttcctctccgacgaccccgtcgtgctcggaggtgagctcttcccggtcaaattttgcttccggtggtgcgagggtatggggattcgtgggtttaggtctagtgaagtggtggatcgatgatgggatgggggaattgctgcttggggatctcatgccgagtgttgacacttcgatcccgccttcatggagctaggatttgcgtgttttagtagcgaattttgtagtttccggtgttccgggttttgtgcgacgcctggttcgttcgctgttttgctattccaagttcccaactagcgaaaatcgcattccctcgtaattagttatcagaatcttacgtggtaatgcctacaaatctcttgtatgatctgggtcattaaattggatggtcgatgtactctggtgcgacatagatgtcagagcaaaagcttgtatggtagtacttggtttacccactccttattctgtgcacaacgtgtaattgtctattggacattggagatttctagtaggttttcaagcttgcagtgtgtggtcaaccgagatgtgcgatttgctcttcttcttagagtactagtgactgcggcaataacaggagttgatttattgattaacatggctgctacataatatgatgatggtgcctcaagataaaagtacgctaagatttgcttcactttggcaataactgtaaaagccgtttgttgactattttgtttgatgggtacttggtcttatgatgtgcaaactatgaactgtgaatggaagcttgacaagcatggcatttgctttgttgtaccattgaaattacatagatagttttgtttgatcacaatagatcgaagtatgaactgtgaatgaaggcttgacaaatatgccattttctttgtgcctttgtttcaccatagaaattacatatatatttttgtttgatcacaatagattaagtcattgagtagctatccttggagctggctatgacctatgtaccgttcctgataatattttagaatatgaaatgctttaagtaagtagatgtgttgttaatttatttcatataatgcgcaaatttatagataacctagtatttgagattcctagttaccctattgttcgtgtactattcacaaagttgtgttataggattgacattccatactcattatgtgcttatataacaagaaagaaagtccatatgttccatttgattatatcttctcttatgtagtgagtgtagataagctgctgtggaaatttttttttaagcataggatgttttttaggactggatggaaattgctttatattaatgtttcaggctttggatatatggaactttttacatttacattctcgaattcatcgtacatgtcataaatttcaagctcatatatggaaatccatgctgcctgcctcaggtggaaacttttagatccctaaatttgaggtttctaaggaaaaactcagcctccacccaaccaaatttgtagtttcatatgatgataactaattatatccagaacctttataatcaactttagtcgttgcatatagtaatgttcctcttataatccttgcatcactttttccatcattgcattttctacttctcattgataccaattttctttacaccctatattgttgaatgaaaatgctatgccatctttttgtttactcatttgcatccttaactagtattgtttagctatattgcatttgttggcagttggcgcagtccttcattactttct

SEQ ID NO: 51249 - DNA, 4983 bp, Oryza sativa
gttcccgctgcagtttagtcaaggcttagctccaggtatcttttgtttccgctgcatttttgtaagacttttatgatgtttgtaagacgtggatctgaatgtcaacattgtcgtttgtgtaccccggctggtcctggacggggattttaatgcacattctgcttggaattctattcgggaatttctgggcgtgacaggtgatggacactgggcttggacaaagggagtgtatgtggactttgtttgtcttacttatcaggccgaggaggagggtggctactgggccaagcccaagagcaagagagagggggcggctgctgactgggcgtcggctgacttggtcaagtggggccgacggctgaggtggcgccaacgtggacgtcacgtcggatggggaagggagaggaggccgggcggctcatcggacggctcacggcgtgcggcgggatccggcgaacggcggcaagccggaggggcggctagctctggcggcaggaagaggagaagggaaactcattccacggctcggatcgggaagacgacgcgcgacgacggccggcggcggcggccaatctcgccgacacgccaacgtggccgcacgcgagaagagcgaagggcacgcgggctcgggcttcgccgaaccggtatggggttgcgacgcgcacgcggtgacgcgggacccgatggtcaccggcgacgcacgcgcggtggcgttatgcggcggcggaaggggcgacacggcgcggaggcaaaggagaaggtcggcggcctagggacagtcagggggagctcaaggggatctccgggagcgtggcggcgagaggaatcggcacgagaggtgccgacgacggtcgattgcggcggcggcaatcaccggcgagcaaaaggggaaaacacaacgagacgacgaggattcgattcaaaggggtgggagcatctccggggttcaaggaatccgtttccggtgtcggatggggcggagaagcactgaggagggccggcgacgagcagcggcctccgggagcggacggtaatggcggtgaggccatgccgggcgacggcagtgctagggaatggtttggggaggtcctagggagctcaaggacagtgttggcgagggtggtcgacgagctggggcccgacgacggcgcgcgactgcgcgcggcggcggaaacagagcaacggcgaggcgcgcggcgcatcgtgcggcaggctatggcgtgcggcggcgggcgcggcatagcgagcggtaggaggaaagggttcggcggggagctcaccgacaagaagaagcggcgtcggcggatcggagggagtcatggtgaggtggtcgcgacggtgggacggaacggcaccgggtgggcgcggccggggaggaagagaggagaggtggcgcccggagctcctcgtcacgcgcccacgcacgcaccggttcctccggtgctcggcggtggacggcgacgacgagatcgagtcgagcggcaacagggcggcgacggttgttcggctacaatggcgcgggggggggcgaaaacgagagagatggaggggaggggctcggctgtggttttataggcgcgggatgtggagcttcgaggggaaggaaccgagcacgggcgatcaaggagaggcggtggcggactcgcggtcaagttgtgacagaggcggtcacgggtggcaaaggaggtgacggtgtggatgcgttgggtggcgaaggcggtggatcgagcggcggaaaatcgaaccgcgggagcgggaggattagcgcgggctggcgcggtcaaggtgggggtggcgagctggcgctggcgtctgcgtctctgcctccgagcgctagcggccaaggagtggaggcatggcgtcgttgcttgggagggaaaaagagagggaggatggtggaaagggggggctttaccatgccggtttgggaaaaaggaggtgggagagggagaggagagcgcgtgaggcagagagacgtgctgcctccacgtcttggacgcacgcgcgcacagggtgggggcgagcggcagggcggcatgggcggccgtgcggcgcaggcggccagggctgatgcggcggcgaccgggcggtctgccacgcgtgggcgagcgcgggaaagagcgaaggcggtggcgggttttgggcggcgacggcgggaatcggcgccgggaggggagagagcagagagagagagagcgaagacgagagagagaaagaacgagagagcgagagagctctctctcggctcacatgcgtgcaacgcacgtgcgaggggggttaagatgatgggctgtgaggggagatgggccgggggagaaaacggcccacaaaaatccgagggaggcaaaatagactttttcggaggggattgattcgaagagaatttgaacttggaatttgacttagattttggaattgggatctcgatgagaggaaggagtagacggaggattcaagatggggttttggatattttggatctggggaagtatttggcgatgattcaaagagagggatagaatttcagagtttgatttggagacttgagtcggaagaggaatttcgagggggcaaatttgtgatggtgacgagagggatcaaggacggatttgaattgagatcttggcacaacttagactcgcacacaaagaacgaaaattttcgcaattaggatttttgccgaattagtttttaacgcctcacgaaaagcggagcgttacaactttcaacttttccgtcacatcaaatgtttggatacatgtatggagcatcaaatgtggatgaaaaaaaacaattgcacagtccgactgtaaattgtgagacgaatcttttgagcctaattacactataatttaacaatgtgatactacagtaaacatttgctaatgaaaggttaattaggcttaataaatttgtctcgcagtttacaggcggaatatgtaatttgttttgttattagtttacgtttaatacttcaaatgtgtgtccatctacttaaaaaaaatttggcacatgaactaaacacagccctagaacaccaccgtaaaaacatagattttcatctatggttgattgttcggactacatataactgttatttctctcaataggttataagagttgtatgttgttcttatcttccttaaaccaggaaagtgggatagcgagatcttcgaaatcggtggctgatacttgttgattgaattttgctcccatcaccactaccgattgacgtcaaaccaaaggaaaggggaatattacatcaaagagtaaatgagttataaataagtcattcgtccagaacttgccaaaaccatgccagcaaacctgatacaataaacacactgccaaggaacctccaatcaatgtcttcaagaagatggctagaacgtcattgtcgctattccgaacatctgtaacaacattttcacttggagatttcacttgagacacggtaaagcgagggggcgtcgtgacattgcccccaataaggtaagtagcgtttaaaggtgtcaccgatttctatgcaaatgcacgtcaccaacagaatcaccaacgacctcttgcctcgcttgcccaccaccaccctagcgctctcctgcctcgccatgccaccacgcaccacctgccaagaggcacggtgacgagacaggacatgccacagccattacccattgctgcctttcgaggaacaccggaattcggcgaccctagtgcgacaacgcatcagtggtatatctggcatgcgataacgatgatgacgtatcaccggagcaccacacgtgtatgttgccatcattgaacaatgcacaaggaagcctgcacgctagccatgtcgttgtcaccgttttggacgctgaaaacagatcccaggtatcgccaggtgttggatcccgccaagaagacctcgctgctgcttttctcatggggcatctccgacacttccttccaacagcagagagaagagacccactacggtgctttctactggtagtataaagcaatcaaaatcattgatcttatttgatcaaagggttcagatctatttatactaccaccctagttagttagcggtagtagaaacgtggagggacattattgtcaaaaaaaaaaagtgcgggggtataatcgacatttagcagtggctaaactttgtcttcttctttatttttggctttttcgatgaaatatgaatgatgccagcacaatggatgactacatattgatctagccaaggataaacataaatgaaaaatttacctctaatcattgtattagtaaattactgatttacctttaataacgaactgtttggattattttctactggtagtatgaaagcactggcgtatcgcttcggagagaaagatctctcgactttatttcgcctctcactgaccttagagcaaggtgtccacgtcaaagtttcactagtgcagataacaaactgtaatgggagtaacagttcactttgttgcaaaacagcgtgcaaattcttctcgccaccttatcaatgcagaacatggatgctactccaccagggaaatgtgctaatggttcacttgatgaagtattgaaccaaagaaaaaacaatgaaaataaaaaagcaaaactagtttagacaagacgcaggaccaagatactttatgtttagtcttactggggcatcttttgttctctatatattttttaaaatatagccatatatagaatttcagtgttgtaaaaatcagaatatatgggttgtatgggtaaggcaccggcacacgattaatcttgatgcagacgacacataatccttcacaaccacaagccctcgcttgtctgattcatcttcaagaagcaaggtaaagggccgtctcagtttggtcctgtagaagattgagaattattatttttcgaacgaatgaaattgagaattaagcggcatatataaggaactacgatcgctaatcgatcgcttaatcagggcaggtgataaat

SEQ ID NO: 51250 - DNA, 13702 bp, Oryza sativa
cattacaggttggtgacaaggtcccggcgaggcgtggtccatcgatagcaaaggaagtggccaccagcaacgagctttggcgtggggtgtgaacggcggagaacgcggccgccagcgacgatctccgacgtggacggcgcaggaagcgagcgccgccgcagacgtatctgtgcccggctcctgatactaagtagggatcacctgatatctagtaggtatcactctgatattgacgagtatcaggtggtacttcataggtatcacacataatgatacttggggtatcatgtatgaaaccttcaggtatcacacaagatgatatatacctagcaagggatcatacgtaaaaccttaaggtttcatgataccgagaaggatcatgatacctcctaggtatcacatgattctactaaggtatcatccatgaaacccgcaggcatcatgatagcagccatgatactcagtgtcttgatggtgttactcttattcacagatttttcctgcctatcgcctcgatccttagacttcgccttctcagcatgttgtcctcccattggcatcaagttcattgatgcaagcttttctaccaaatcttgaattgttttgattgcaagatcatatccttacaaaacacgattcagaggatgtttcacgggaagcagaggagtcgacggacggcgaggtgccgctggaaggaagcgaggaattgagcgcggaggcgcgcgattacgaggaggtttcaccaggatgctcgcgccggtggaaggaagcgaggaatcgcgcgattcctagaaggattcgccatgatctggagaagccgacggatggtgcgcgcgccggcgggaggaagcgaggaatcgggaagccggcgtttggcgagcgttggtcgtcgttctcgtttttgagcgctggttttgctacaatgcgcgcaagtggtgggtgacagttgctcagagcaatgccttatcgatatcagaatcgtccctttttgaacagcattccggtaagtagcatccccttttctactactacttaaaaaataagaggtgcttccatcgtccgtcaaaaaaaccgggtgaaaaaaaaccggaacgaatccgattcatcaacgcggtaaaagaatatgtccgattccacaaaaatagaaatcaaactcccatctgttttcgtttgagctgattagaactttgtttctgtttgggcgaataggacttggtttgaattataccaagtcctattcggttagcatcaccaggagaacaagtgcatatatacatacatagtataaaaaacatagcacataacaaagaatcacatgcagccttatagcactttgcgaaaaaacaaaaaattagatcgaagggggtcgccgtcagcacacatatatccaaataaaaacaaaaaattagatcgaagggggtcgccgccgctgccgccgtcgccgtcgccgtcgttgccgaaccgccgccgtcgccgtcgctgtggatccggtggaggggagagcaccgccgccgccgcctcccctcccgctagatccgccggcggcggcggcagagggcactctccggtggtgggggagagcgccgccgccaccgtcggtggtgggggaggactccaccgccgccgccgctcgcgggaggaggggcgccgtcgccgccgctcgcggggcgcctccccacccgctagatccgccgccggtggtgggggagggtgctgccgccgccgctcgcgggaggaggggcgccatcgccgtcgccgccgctcgcggggcgcctcccctcccgctagatccgccgccggtggtgggggaggatgccgccgacgccgccgtgggtggtgggggtgccgccgccgccgccatcggtggtgggggaggggcgccgtcgtcgccgccgccgctcgggggcgcggaggagagggtggcgaagtgagatgggagggagggaaatgggctagggttccgcggctgagagggagtgggttttgtttccccactattgacgctcggccgtccgatcaaaaccctagagatcggacggccggtgtcgtccgggccgaaatcggcccaagagggatcgagagtgaggcctcttttccgacccaagcccaggttgcggcctgggggaggaaaagtgcgcccgcgcatgcgcaaaaggccgtgggccgaccggcataggtcggaaataagtctattgttggtccctcgagccgaaaaaaagagaataagtacatttttagtgctcattttttcagaagcattacaattatagttctattgaatatgtttatttcgaagcaaacctataagaaagtattttctttctttttccaattaaataattgttaaatgatgtttgtattaataaaattagcaattaagctctgaaaattccaataaaattccaaagagcgtaactaattatggagaatttaataaaattaaatttaaccatgtcattttatttaaccatggagaatggagaattttacttgtaaatttatttaattatacacatacctacttaaaaataccaaatatttcagcgaatttgtattttaattaattgcatatttttctgatctgtaaacttcccggtgcaacgcacgggcacttttgctaaaccaaacaacacttttggtcaatatacacactctgtaatcacccggtgcaacgcacgggcacttttgctagtttttattagaagtggaaacccctgattaagtcgtatgtgatggtttgctgtgctttgtacggaccacttacaatactactacttccgtactaaaataaactaatctcgtactaagatgtgataacgaatctaatagaacgttgtattaagacgtgtcacattttaatacgaggttgacttattttgaaagtgcgggagttttggagtagtatggaacgacgacttggatacactgtgtgccagactggcatatttattccgatagggaagtgtaaaaacctcttattatcgcaagatacacgtacgtattgctgcatatatacggtccctcgcggcctcatgtcgtggtatttgtctgcaccacacaaccgcgctctaattgcttcgatttgggagtaagctttaccaggagcaggcgatggattccagcagcgccgagatcctcatcgacctcggtggcttccggctatacaaagatggccacgccgaccgtgccggcggcatggagagtgtgcctgccggctacgacgacgagaccggcgtcacgtccaaggacgtcgtcatcgacgctgtcaccggcgtgtccgcgcgcctctacctaccaccgtgcatccagccagctaccgacgacgacggtaagaagctcccgatcctcctcttcttccatgctggctacttcgtcgtcgggtcagcgagctggcctcctgtccaccgctacaccaactctgtcgtcgcaagcgcccgcgtcgtcgccgtcgccgtcaactaccgcctcgcgcccgagcacctgctcccgacagcctacgacgactcatgggcggcgctcagctgggcggtgtccggcgccgacccttggttgtccgcgcacggtgacaccggccgagtcttcttgtccggcgccagcgccggcgggaacatagcccacaacatgaccatcgccgtgggcgtgcgcggcctggacgccgtcgtaccggcgccacgcatagagggcacgatcttgctccacccttccttctgcggcgagacgaggatggaggttgagccggaggagttctggggcggcgtcaagaagagatgggcggtcatcttccccggcgcgaacggcgggctggacgatccgcggatgaacccgatggccgccggcgcgccgagcctgacaaagctggcgtgcgagaggatgctggtctgctcggcggggttcgatccgaggaggacaagggatcgggcgtactacgacgcagtcaaggccagcgggtggggacgcgaggtggactggttcgagtcggagggtgagggccaccacttcttcgtcgacaagcccggcagccacgaggccagcaagctcatggaacgagtggctgctttcattgctggccattaaactgtgcttccagctggataatttgcctcgtgtttctaagagcaaggataacagtagagctcactatctactattagcacatcttaaagccaacacatataatagattagctataaggttggctataatttttcttttcctatctctatatctcacttatacatttattatttttgtcttggagcttgtgataagctagctcttgtatgagagccaatacctttgattttttgttacctctctactccatataagcttatagtaagcttatagctcactattatacttgctctaagatgtcaaaatggtgaatagtttatcccgaagtgagccttgcgatcactctgttctaaacgataatgatagaatccggtcgcccggacgggggaggaaaaatcgggcgctccccccgtcccccgtgcgcggtgcatgtcattggccccaccacagtttctgcccccacctacaacaaatcaatcacatattttgcatattttggaaagcctatgttaagggaatttgatttattttttttcaccaaaaatgtttcacctagtgtactcaaaatgttgcagtgaactgaaatattccattgcaacaaaaaaacccacatattttggaaaaccccctattaagggaatttgttttattttttttgttccaccgaaaaatgtttcatctagtgtacttataatacttcactctgtatggatcaaatgttgcagtgtactgaaacattctttcgctatttgctgaaacattgtttttatataaggtgaaacaacacccgatttaaacgagtgaaacattttcgatctacttagtgaaacaattccgatatacctggtggaacatcgtgcaacatttaaaaataattcaataataagctaaaaaacttttagtcggaatatatccatgtgtggtctgaaacattctttcgctatttgctaaaacattgtttttatataaggtgaaaaacacccgatttaaatgagcgaaacattttcgatttacttagtgaaacaattccaatatacctggtgaaacatcgtgcaacatttaaaaataattcaataataagcttaaaaaaaacttttagtcggaatatatccatgtgtggtcttgttttgaagatttaattgcaacgaatttaatggtgcaattggatcatgatttggataagtaatttaagagaaaaatcagtttaaattagttttgcacgtaaaccatgcgctgacgtcatgctgacatcagcgcccgatttttctccaaatcgatcaggcgcccgaaccgtagagtcgtcctgttctaaaagaaaaggactactccctctatactcgtaaaggaagtcgtttaggataatgtttaagtcaaacattgggaatataaatcataaataactctcaaattgttgagtttgaaaatgtaaaaattatatgaatagatttgtcttgaaaaatactttccaataaatatacatatattactttccgataaatatttttataggccatgtcactgttcaaaacattatactttccaataaatatacatatattactttccaataaatatttttataggccgtgtcactgttcagaacgttttctttactagtacctgctttccgtctggaagaaaacctgttcaggctgttcacagaagcgtttcacttatgcaaacaacgaactactacctccgtcttctccgtcttttaatagatgacgccattgattttttctcacatgtttaaccattcgttttatttaaaaattttatgcaaatgtataagatataaatcacacttaaagtgctataagtgataaaatatctcataacaaaataaattataattacgtaaattttttgaataagacgaataatcaaacatatgagaaaaagtcaacggcgtcctctatttaaaaaacggagggagtatgacgaacgtaatggtctacctttttccaaacaaacttttcaggctcgctatcaaaggcatcaccaaaggatactcttatcatttgacaacaatcaggaacttcccctaaataaccgcaaacatcagcatgtgtctaaagtttgaaaccaaccttgcaagtgcatgatgctatatgttagctgaatgattgaaatcagactgatgactatatatttccaccaagtaaatgtgctgctcagtcatttgaaaatggtcatatgtagcaataaaaagtgccactagtagtcatgtagaactgtaaagggtacatttccacaattatttgatacaattgctgactgctgagatgcccataaaactatcatttgacaacagtcaggaacttccctaagtaaaaactggagtgcccagaaatagttgaaagcgagctacatggcaagttagctttgtgtcatagagtacttggtactttcaaatgtagaagcatgcaagtactataatccagttcctctttccagtgggtgaaagtgagatcaccagattaagatcacacactacattcgaatccaaaactctaatgaagctggagccagtttaaaagatagtatggactacggacaacaggactatgatcatcttagataaagcaactatctacagtacatccctgaatttccctatcagcaggtttatgtccgcaagaattgaatgttggaatgtggttgtttttgttaatggttcattagaaatgaagttaaggctaaaaactagatttgcatacggtaaaacatggatccaaaatctatttaatcaatctcaattctcaaccaaatgtctgaagaatattggtaaaactaatatctgcaagcattccaatgagaatcatttgcaaatcaagcactcaagtagctcgacaaacatagaagcaaaagacaagaacaaacagaacaagtaggataagcatcacaagtagtcaatactcaacacaaaacagaaattacaaataagttctaatagtacggttcaagtgcaatgtctgtgaagatatccacagcactaactggcatcttagagatcatgacctatactatagggatcataaaaagaaaaggaaatagtggtgatcattcattgtataacagctataaatccttactcagccatccgctgtagcaaatggatcatgggaaggtcctacatcatttccaatggttctttgcactaagcgctgcaaatcagccatgaccttgtgctctcgcttcgacttctcctcataattaaacatagcaagcgccctcttatcctctgcactgtaaacctggttttccttccttatacggatagcattcatcctctggtgcctactcccactcatcacatagcccaaatcctcgaacttctgaatctcctctgcagatagaccaacctcaccacgtcgtgggatacgtttcccttgctgtacgtactgtgcaatagcatcaccttctccaggtctcagtgcaccaccatagctaatatgaccttctgcacgaggaagaggcattggcccaaccggcatctcattctccaaagcagccttcttttgggcctcgagcatttccttgaatttgattgcttctgggtcaatctctggctcatttgtctcatcgatttccttaacaccaaggtcggcatcggatggggcctgatcttccgaatcagactgcttgctcctcttcctccgtgagctccggctcttcttcttactgtccctcaaggggctagggcttgatcctgaagccgctgccaccgcctcctcctcagagcttccctcagaagctgtatcattgctcttcctcttcttcctcctggagctccttcccctcctcttagacttcttgtgcctccgcgatctcttcttcttcctcctatccatagagtcctcggaatcataagagccctccgaatcctcctcagccttgctgttgtcgtcaccctctgtatcagatgaatggtggcggcggcggtggcggctacgcttgctgctacggtgactacccttacgccctttcttcttcctccgggtatcatctgatttgctggaatcggacaagctatcagactcaccggagtcggattccgacgaacccttgctatcctcctcttcgctcttatccgaggaggccaccttctttggcgattcctttttctcctcctcctcctcctcctcgtcgctgtagccataatcctcatcctcaccttcgcggcgaggagggctgggcgtgatgttccagatgcaccgcttcatgctcttgcggagcttctctctcttgacgcggcggtactcgaagtaggtgagacccttgagctgctcgtcgtcgtcatcgtcggaggcggaccaggcgccggcccccgcgccgccgccgccgcgacggggcgcagggtggtctcggtcccgagcccactccctctccacgtcgcggccacggtcgcggtggtagggggaccactggcggcggcggtcgcggtaggggctaggggaccggtccctgcggctgcggtaggggctaggcgaccggtcgcggcggcggttgcggcgcggggagggcgaccgggacggggagcggcggcggcgaggggagggcgaggcggagaccctggagcggccggggaggtgcaccacggacgcgaggcggccctccgtgcgacccatggcggcggatcgccggcttaggtcggattggggatttggggaagctagagaatagagatcgggttggacgcgtcacgcgtgggggaagaagtgtggaggtgagggcttctcggaggcgaagtcggtttggaatttggatcggcggtatgtgtgcgttattgggcttgatggaccgaaagaaggcaaggggtagttatggaccttagcataggccgatagaggaggcagctagttcatatattgtaaacagctcattttaactccctcaattattggccgaatcttatccatgtttctcaatcgtgaaatcaggtatatgagtccctcatctattcaaaccgatttaatttgactcctctagtagtttagaggatgattttgtcctacgtggtgcctacccgtcaaattgattttgttattttttgactaatcaaattgattttgtcttcgtctaacgtggcatctatccggtattaatatcagctaaacaaattaattaatatagtaacacccacatgggatccacatgttataatgaccactttttcttctctctctctcccccctctgttggtctgcaggggcaacgatcgatgaaaaaggagcaagaggcagatgcaacctcatagacaggagaggcgtcgatggcgcagtgcagcggggtggaggcctagggcaaggacgacgagtgggagagttctaacttagtggaggtggcgctcggaaacaagttcgcgttgactcctagcgttctcgagcaatcaaatccgcgacagccggccatgccatcgcagctgctgcgcgcaccatatctgcacgagatggcactagcctacgaaggggagtatgcggctaccaagctaggttataaccctgaaggaggcaatttgatccggttttaatatttgggtaaaattatatatctgattttatagttgaggaatgaggatgcagaacaaactcagctgacagttgaagaagtcaaaatgaactttttctcatatgtttgatggctgaagttgggctgaaatgtgtgtgaagcatgtatcgatctgtcagagtgattttgtgcgggtgggctttaaggagagaacacaatgtaatgatgggcctcgaacttggacatgcctgttttagcaatttcatttcaagaaacctattcggccgagggactcaacagaactggattatctaattatccagtagattaattgaatattgcatgtattactataaagccaaaaatataataaaaaagaaatataagaaatactattttttttagagaaatcacacattccaaagcgtggcatgaataatccaattaacaattgtctgcattaacttagtcaattgtaagatatttcggtttagtttatcggatgtgtgtttgtatgatagggtgtgaatgtttatgtttacatgggtgagtgtatgcatatgtacatgagctcacatataaaaaaacaaagaaggataagaatcattttgttccacaagctatcagttcttaaactgctcctaagttttacgtgttagagtttggagccacacaagagaaattcaaatcacatctactctgaacgctattccttcctcccctgagccaaacaaacattatagcgtgacgccgtggccaaaccgccaaagcacagaagtcaggatggccaggttagccgccgcccatagctagccgcgtctgccagacatgcccgtacaagtacgaccaccccgaagcccaaccgtcggtagtaccggtcactctgcgtactgcaccgcatcgcactgcagcttcccgcctgcatcacgcatgtttcggcaatgaatgccccgcacctaagttcccaacaaccggatcgagctcaaaacaacgttagtacgtagtacgccgcgacgcccggccctacgtacgtactctcctgcatgcgccggccgctgcagcaatgcgatgcaggctgccaccgcctgcgctgcaacccctcgttgcttgtctctcgtcgtcgtcggcttgctgtcgtcgtcgtcgcgggtacttacgtacggagcagggggggccggccggcggagacgcggagagcacttagccgccggccgccgcgcgcccaggccccaggctatagggatagagcgatcgagcgagcaaactagctagcttggccggcccatgcatgtggccctcttgcttggtcgggcagcaacactgcgcccgccccggcgcgagcccctgtagcccggcagaaaataaatttgtgtcccgaggcaggcacatccgggtacgctggtgcacaccacatgactgcgttcgcaacgtgaataaatcctgccctactcctagatgaattgcttcttcttttttttaagaagaagatgatctgcttcggtatctattagtacggccaagagcggattatatgtcaaatgacttattaccccttcagattgataatacttgttgtttcgaattagattttagttaaactttaaaaactttaactgtaaatatcatctaaaatatttgttatacaaatatggagaccatatgcatatattagtcttaaaaaagttttaataaaatcatatatttgttgatagttttatacatattgtaatacaaaatagtagtcaaagttattttttgaagatcatgtccttatctaaaacgataaatattattaacatggatggagtagctacttaaaaaaattaagaaaaaaatatatttatccttaacgacttaaaagctaattaatgttgaaaaagatactacttgaaaaattatctaaaattaaaatcgatattaaaattttaaatttaagttttggcagcgactgatatgatatagggcaaaccgataaggctatatatagtcttttccttctttactacatccagggattgtgttaattttctaggttagtggagttgcgtcggatttggttcatgcatgatgcatcattggtgatgaggaaatgatcagaaactggccggaatgatcctaaccagatcgtcatgatcgatatggttctgggaaaagaataatgttcacgatcgagatagtaacctgtggtgtggtcacctagcgcataagccgtgaagatgattggattatattcagatatgacgttgccagctggatttgagatatatgcatactgcttgtattactcccaacgtccacatgcagtacaaatacatgttcaaaacataatttctcattgactttaatgagatatccttcgaaagatatattatgtccgacaagaatgtttggtcgcgtcataaacacattgatgccttagatggtgtttggttggaggaactaaagtggggctaaactttggtccctctcacaaaagcataagtccctgagagggactaaatttagtctctagttcctaaacacccccttattttcttccctttttttaccgtggtgattaattagtagttatgagcattacatttgaccatgtcgctggtctgtcctacaggctacagagctacaggactaagacgtcatgctcccttgtgctcttctacaggtccatttccaagaggaagtggttaaggtgcatgcatcctgcccaacatatttctttcttggacgcagcagcatccaccagccttcctctcttaaaacacttcaaacgaagggttggtgcacaggcccaaatcagggccaggggcccccacaaaaatgatcatgaaagggcacttaaaaggggaggcattatttggatcagaaaactatatgtgcttaagctagccgatgtatacaattccccacatgttatccccctctcaatttctaaaccaccacatattccaaatcagacagccgtcgcgagcacaccaccagagcttgatttgacatgtttgttccttgtcgtgagtttctctctatgtccttctcctggccttgcttggaccaataacgattttattcgatcgtttcgtgtaaacataaactattaaactattgtacaatttctataaagaaaagtaatttgattttgagagaaaaatgatttgttttgtgacttaacggaatgaaaaatgcgcacacacacacggaacacccacgaatacatgatatgccccctaatacaatcttaaaaagatgaagaccagtgataaatatctgactttttcttaaaaaaacgaaattgtgtatgcgtaatatgaattttagatttttgttttgaagagattttagactctgtgttgctttaacggtaaacaacatccatgcatggaagattgctagataactcttttgaaagtctttatgtgccaaatctaaaaagaagatttattcattgtaccctcaacgacttaaaccagcccaatgtcagaaaaaaaaaagaaaaaaagaagaagtgcaccaacattaagaaacagagtccggacggatatgcaattatgcatataggtagggagacataatcagggtatgaggatatatgaaccaaaaagacataaagttacgtttccttttcaagagaaggacgggtttttcacggacgcgtgccgcagccccattggctggatgaattgtccggagaggactcgacaaattaaaggcaaagaaaatctaaacaattaacggaaaccataagaaaataaaaccagcgtccaaaagttcgaaccagcgaggaaggatcagccgcgggccggggacaccgagagcgaggtcacaatcagattcaggaggttcacggcctgttctaaacaaagacaagaaacaactgattagttacataattgcatgcgaaaccaaaaacataacatataactacttgagtattaattattactccctttttatattttaatgtatgacaccgttgatttttttaccaatgtttaactatttatcttatttaaaaatatatgttattattatttattttacagtgatttgatttatcattaagtgttgttttaaatattttttttatatttgtaaataagatgaatgttaaacattgataaaa

SEQ ID NO: 51251 - DNA, 743 bp, Oryza sativa
ggactgcacctgggacttgaggaacttgacgtagtggatggcctcgtcgagcatgaagcggtgtccatcttggtgcggcccgggacgagccgctgcaggatgcggatgcgctcgctgatgcgctcccgccgcagccgcgccgccacgctctgcgggtccttggagatgcgcacgttgcgccgcttcggcggccgcacggcctccgggtcgatctccaccggctgcagcgccgcgatgtggaagatcatctcccgcatcgcctccgacgaggacgacgacgacgagccctgcggcgcgccggagtcggagcccggtgacgacatcgcgaagtccagctggtgcacgcccgcaccggcgccgtacgttgccggcatggagttatactgatcctggtaaccgccaccggcggtggtggtggtgaccgacatctgcggcggtggtgagaactggggagaaggggtccccatgggtgataccggcggcgacgtcggcgccgccatgaacagcgactggtcactgagcgcagtgagctgctccagctgaagcatcgtgctcatcaggtcaagctgcgattccgggtaggaattgaacaagtcgaagtccatcacttagctaggatatatatcgatcaagcaactagctagctagccaggtattgatgagctagacacacggagcttagtggaaagagcttgagattgagcttgagcttgagctagctagcaggagtagtagctgtttca

SEQ ID NO: 51252 - DNA, 1041 bp, Oryza sativa
cacgcaccggctccttcggcacacgtgacggcggcggtcggcgatcagcgagacagaggggacggcaatggcgtggtggagcgagggcgaatgggagaggaaaggaaagggggggaaacttgggtttatatgggcgacaatgtcggtttgggagaggggaaccgactttggacggtcaagccagcgagctggcgctccggctagcagccaatcggcgacagggaggaggggaatgacgccggcggaggaagggaaaaaggaaaaagggaggaagaaagggggcttgcctccttgccgctttggggaaaaggaggaggaagagagggcgacgcggcagagggggggagctctgcctccgtcccttggaggcacgcgcggggagaggcggggccgagtcgatgacgacggcgatgacggcggggcggtttggagtggagcggcgacacgggcagcagacgctgggcaggcgcggcaggcgctgacggcggcggcgactggccggtcggccaccacggcgcgcgcgcgcgggcggcgcggcgatttgggcggcatcggcgggaacagccgcgagagtggagagggagagctcgacgcggctcacgggcagagcggggagagagagagagaaagagagagagagagccggggagggagggggagatgggccgagaggagttcggcccatcgaactcgagggaggctaaatagacttttgcggagggatttgatttgggaaggatttggattcgggattgaactcggcaatagatcggggatttgagatctgagacggcatggacactagagaacaagcaaagaaacggatttcgcaaatagggtttttaagagatagttttcccgctaggcgccacgacggaacgggcgctacatcaaaggaacatctaaatcttctataagtagggtttaccttatcggaggaggggtaaccataccccgatggtaagcctatttacatcgcaacaagaagtgttaaaaagaaaaaaagaatatcaaaatatatttgttattattatattttta

SEQ ID NO: 51253 - DNA, 733 bp, Oryza sativa
agagttcaggctctagaacccctcttcctctttctctcctctaccagctcaggtattctcagagtcgtctgagagtcctccttttttctcccttccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgccgtcactcgcctgacacaggggataaccctgtcattccttcattaatgggtggagatttgcaatggccactgtccgaatgaccctccgatgggatgggtcatacctacctccactccgccggaagcagatgcaacgtgggagcacggttgtctgccgatgacgtgaccggcgtcagaccagtcacagaccggtcattcttgtccaccgcgcgtcagtttagcatgccgcacgtctgcccttcttcatacaatgactcccttaccatgattgcgatgaagcctggaatgaatctggccgggactgacataccaattccaggagttagtacgccggctccggctagggacgagtgcctggaggctctcatcattctgacgggacggggcgaggcgtgtgacaggccgcctgttgccacctaacccgcgatctgaccgttctgtgaccggtcacacactgcgaccggtcacggaccg

SEQ ID NO: 51254 - DNA, 983 bp, Oryza sativa
agctcgtctcgttgacagccctaccgttagcccacatctttgttttttttttcattttaataataaaggttataaagacatagctttaaattgaagggtcaatttgatctatgctactgtaaatttggctattcagaaaaatactattataattcgcctattcataaccatgccactggaattttacaaaattaaaaccgtgccactgccgtcacattttccatccattctcttccttttccgtcttcttccttccttctcccatcatcttcccggagtcaagccggagagggagcttgctggcaaggtgaacgaacccaacctagagcgtggcgcggatcctggcgttggtctcctgcagggtgcggtcaagcagctcgacacgctcccgcagctcttcatgggactccctcagccgagccacctcccatagctcgctctatcaggcgcgactggcaaatccagcggtgggcacgaccgacgaatccggtggtggcggtgtcggacgatagtggcgtcgggcggaaccggcggaagcctaggctgcgcgtcgagagtgaccggcggcgtgaccctcttcttccccatcgctgctcgacctcggctcccgctttggcctccaggtcggtgagcacctcacgccggccgctgtccctcacggcggtgttctccctgctctcctcgtccgcaggcctctccaaatgcctcctcgccgcctgccgcgagcgccgcaagcggcaggacacctctccaccgtctttaagtcttcgtcgccaccgtcaggcctgctcgcgccatgccgtgccagatccaccgacgcttgctccaccaccgaagctgtcgaagctcgcggcggccatggatggatggacgaccgccggtggcatcgccgctaccgctcccgcgcgagatctcgcgtgcttgggtctcgctgctgactactctgagcttgccagcttggctctcggaagaaatgcgagaaa

SEQ ID NO: 51255 - DNA, 3206 bp, Oryza sativa
ataaaatattatgccttaatatcgtatcaagtttggatattctatggcattctttcgtgtttagctaccactatattgattttgtaacccgttttatttttttagataatggattaaataaaacctggcctctatatcctgaaggatgtacacaaccatagtattacatcatcaagcacttaggcttacaaacaggttcaaaagcaaacgatgccgtaggaggcgaatggacgacaaagacatccagaacaagtctcacaacaaaagattttatctaacacaattcaatcttcctcttcaattccacctagattttgagtagaattccataatgataactttcaattttaggcacccaatctttaaagctttctcatcaccttctttaagaagcaaagaccactggcgagcccgatgcgttaccctgaaaataacctgcaagagagagttaatacttgagccatttaagactacatcattactagcaagccaaagtgaccaatagatattgaatatcggtttaccgccctattgtttttttatactttctgtgcgccaggaccacacaaaaagatagtaatactcacagcatctatactacgttctttatatatgcagcacaccttgaaccacttaattcctactccggtatatacggagtacatataaataattggtgtcaatgtgtcatgcaccagcgcctgaaatcacggagaatagacatcgatgcttcctgacaaaacttcactccatttgttcactgaaccatacacatatagacacctagttgtataaaaatatatctcacgcgttactaatttatgtgtataaatacaaggcatatatacagccctgacgatcgaagcacgtacactactcgatccagcacatcatcatcatatcgatgaattttctgccaattgatcaaagcggagccgataatcaggggcggaaatggcacccccttattgccgtcgtcctcgtcgtcttggcctccgcggccgcttcactacctctgtaagcacctctgagacacttggcagatatatcttgagattgtcaaagtcgtcagggacgtcttgttgtcacccgtatatactgtctataaccgaaagaataattagccatgagaaaaattaaaatccaatcccatcatactaggaattaatagcatatgcacgcgaggatgagagcaagtataatagtgatctataagcttactataagcttatgtggaggaaagagataaacaaaagagaatggtgttggctctcatgcaagagctaacttaacacaagctccaagacaaatagattaaatgtatgagtgagagatagagatagaagaagaaaattataggtaaccttatagctaatctattatatgtgttgactttagtataggttaggggcgcgggcgccgcctcccgccggctgcgccggcttggctgccctcgggcgtgccgagtggctgctgcgtggggcccggccgtcagccgcccacgcccttaggtgcggctgacgcgtgggacccacggcgctggccggtgcgagcccgggtgcgcccggtccaccgtggaccgtgaggctgccgcgtgggccccactcccgtggacccggtccgcgcgccccctcccctcggctcacgcaataaaccctttttaaattaaaatttaaatgaagaaattcgcaaatattcatttaaagagcatataaacttcaaatagccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattaccgctttgtttaaattcccgcgttatcactgttttatttagccatgcctatttacctttgttatgaccttattattattgttattgttattattaccttgttcaccctagaataaacaaaacaccaactagtggacactctactcatggtaccactagtatgattttaggtagatgcttcgctggttaattatgcaacattaggtggttttacaactctagactttgggaatattcatatcacctggacactatggaatggttggattattgtggaattggattcacacctccccctctattcaaaaccctcaaaatggttttaggctgggctcggggtgcatggttttgacagtagcacctcggccatataaggaccggtcatcgggcctctgttgcaaagcactaccgtacttccacatgtctagtgggtaaggcttagtttgtgtgtcgcgtcccaaaacgactctaaaatacatcctcaaaattatgcatagaataagtaaaatccatgtgaaagcctccaacaattaaaatgtgcaaagttaaaagtcaaataaggtttggaggatttttgtatatttcctaaaagcctaaaatgcgtaaataaattttagtggaattttcagagcacaaataataattattaagaaataaacaaagttaaaaaggttttataaaaagaaaaaccctaaaaagtcctttttccccccttcccctcttgggccggctcggcccacctccctccctctctctcctcttccccccgcggcccaatcggcctcctccccgcgcgcgtgccgctgacgggcgggcccgcccgccaccctcgctgacgggtggggcccacccgtcatcccctacctcccgccgctcccgccgcctcgcccgtgccctagcgccgccgccgccgcggattccgccgcatcccgccgcccccgcgtgcaataaagtgaggggaatcattccccgtgattccctctccctttccccccatttttccctctctctctcgcgttcaaacgggcggatttgcccccgcaaatctcgccggcgccattgatggagcccgagagcgccgcgccggtttccttctcccccggccgccctctctcactcccaacactatataaacgctccccgtgcctccctccaccgttcccgccactcgccgctctctctgtccgccggaatc

SEQ ID NO: 51256 - DNA, 6591 bp, Oryza sativa
cgtttcgcccgccgaccgccggaacgccgccgtccccgtcgacccgtgccgcgccgccgccttcttccgctccggtcgccgttcccgtcgtcgtcgtcgacccggggtgagccgtggaccgcccatttcgtttcccccttccctcccctctctcggccgccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccactcccgtggaaccggtccgcgcgctcctctctcccggctgacgcaataaatatgtttttaaattaaaatttaaatgaagaaattcgtaaatatccatttaaagagcatataaacttcaaatggccataacttggccatttgaactcggaattggaccgatcaagtctctaatttttccttaagaagccaagaacccatttttgtgctttgtttctgcttgttatatggagtttagtagagtaaaagccgtttcttttccgttgtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgtcatcactgttttacttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatattcatatcacctggacaccatggaatggtttggttattgtggaattggcttcacaccgctccttctattcaaaatccccaaaaatggttttaggctgggctcggggtgcatggttttgacagtagcacctcggccatataaggaccggtcttcgggcctctgttgcaaagcactaccgtacttccacatgtctagtgggtaaggcttagtttgtggctcagtctagtcataaacaaaagtacacggatggagatggaagaagtcgggggtcgatggacatctctaggacaaatgaaggctacacgagctgcggcccggtagttgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtgctggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggcgttgggttaaggcaggttcgtgtgggttcacggccttgataaaaaaatattgtatagtactagaatcgtgtttgcaaaatagccctaagcaactaatgtctttaaatgctgtctactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggtacgcccgttgggttatttccggtcgtgacattgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcagtcctgcctacctgtcccggaggtcccggccgtaggtggggttgggtcggtactcttgtctgtggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcataacaactaaaatgtggaatggttggcctgggttggcttgggacgagctgggacccagggtcgggtttccagttcggtctgaatcatcgtaggccttgggttaaggcaggttcgtgtgggttcacggccttatttaataatattgtatagctctaggagcgtatttacaaaatagctttcagcaactacgtgtcttttaatgctgtttactgcaaaccctaaccctttatattatgactcccttgtactcccttgcatttattctgcacttgtgggtgtgtcttgttgagtatggtggttgtactcagtcttgctcaatttttcccaaacccagaagaggagcccctgtatgatgaaggctttggtgtctagctcgtgcctgccgtcaagcgcctgtggtcgtcgccctagtcttccgctgttttccgttcgtctttgtgtgtgctgggccttcgccgcccatataataaattatctatttactcttccgcttgttaaactctgaactgtatcaacttttggtgtaccttgccttctgggacaaggaataatgcacgcacgtaaggaacgcccgttgggttatttccggtcgtgacattagggcacccacaatggttatctataggctctctacaagagatccatgtcagcatattttcctacttggaagagattaaatgaagagaaagagagcaaagctatctactaacctggaaatagtctatagagaaaaacgaggtaatggattagagagctatagatacccatgtagacataccattgaagtggtttactattaatctagtctattgctgagatgtacatgttttatagatagcatcttactttaccattgcgggtgctctaatagtaggaagtgggctatattattatccttgctctgagaatgtttttcaatcaacgtttgaccattcattttattcaaaattttccgttagctgcgccagcatccagcgcagaccggagaagccgacggcgagtatgagccttgctggcggcgaggtatccggcgccgtcctcctcacacaattgtgtagcgcagctgccatctgcgtggcgggatggttggtgccattgccggcagccggccaggtggcgaggtcgggaacatggaagcaatgctgctccatcgatttattcctcagatcagcagcatcgtcgcagcaaatgcgtcgacagatgagctgcaggttgatcagtgatcagcaaaagcagcaggaggaggaggacgtggtggtcgtcgatcgacgacaatctttgttgtcgctgcggccgcgaagacgtgatatcggctgaactgctgatgatcaagaacctgcagtgccggatggaggagaccatgctcggcatcatccgtcacgacaacatcgtcgtcctccggggttccatccagagtgacgacgacgacggcacggtccagttcgtgtacgaggacatggagaacggctgctgcctccacgaatggttgcacggcatccgccgatcccagctggaggccggctagagtcagcggcgtcggcgactgagatggcgggcgcggcggtccatcgccgtcgacgtggccagagcaatctgctacctgcaccacgattgcaaaagccccatcatccaccgtgacatcaagccgaccaacattttgctcgacggcaacctcaaagccaagatagctggtttcggtcttgcacggatcaatgttgctgggctcaaccaaccgttactcaacgtagaaattcctagcgaggcctttgggtatactgctccaggtgaggtgatctttaatgcacgatcaattccgatattttttaaaaaaaaacagaaatagattctactttatcataaacataattaaaggcaccatgattaaatcattatttaggtctggtacaactcaaaatccaaggtttcttatagctaaatattcatagctacataaatttgttgatttagtccatgcatgattacgttgataacattagataaatcgttttatttttattttagataaaatttgtaattttaaaccactataatttactatggatttgggatttgaagttgtgctaaacatgactttaccatttatttgtaattcactacatatatattgacatgtttttttccctacagagtatgcaaccgcgcaggtaaatgagaaggtggacgtgtacagctttggtgtggtgcttctgagctcgtcacgggaagattgggtaacgagccaggcgtaaataatgggcacttggctatgtgggcgcagagagggtacggtcgacatctcagcaaggacgtcgttgataaggagatcgtccctgatatggcacgatacttgaaggagatgaaggccatgttcaagctcggtgtggagtgcaccgctatggacccacgggagaggccgtccatgctgacggttcttcgtcgcctcaccaagcttggttccgtatatgtcagttgtttcaattcatgtgataattaactatagtggggatggcttgtatgtagtgcttccttcagtcattaatatataacattttttttctatttgtaagtactactcactttgcccaaaatataagaacctattatgatgagatattttctagtagatttatagtattagaaaatgtcttatatttattctatttttttatattataggatagagcgagtatatgactccgcacttcgtctaggttaattaaatagcgcgactcatagccctaccccgtttgccactgtgctagcgtaattatttcaccatcaagtacacaatgaagaacgatctcaaaatggccggcgtattaagttttcaagtctatctgtaatctgtcgatgaactttctcaatgcacgagtcatggaatgagtacggagcgccagtcggtcaatgaccgaattgttatacattctgtcattatgatattattatatttgtaagagctccaacggttagcctaataagtcaaagcaaaagttaaaatttaaaattttaaacttgattttgaagttggttttaaaatattttcaacgtaatttctttttagcgttaggtttttagtcgctacgaacaaatatacaaaagttttatctataaattaatttgtattctctaataagtcgttttagcttataagggagtatgtgccaccggtgaggctctaatattgtagtcttagtctttagacctatcttctatctttgtcggctctagctagtttctgcttgttctttacatttacgtttctttgggaagtttcattcatggatacaccaatatatgcttgggtattatcgatctacctaacgaacaaatcaaggtttgcaatctcgaagtttggtttttttcgcgtgggggtgggggggggaagaaatttcttagccgaaattatttgaaaatttgacgaatgttgaatgattttgaaggaactttaaccaaattcgaaaaaaaaatggataacaaccgaaaattttagacgagatttgtgcttgccgttgatcggtggagggcgaaatttcgtttcgaaattgcaaatcactggaacaaacacttggttcttgttcgtcggagtataaccctctggacgtgctttctagtctgttgtgtcagtatcagattgcaaatcgtaaaatgatatcattgaagagcatcagccagaagatcaatacaaactgatcaattatttaagtggaaatatctgtcaagctgtactgtccttgcgtagttgtgtattatcgaagaccttgaccaatatagcccctaaacacacggtaaagactagacaccaagcttcaagtctgcagtagcgtactgcatacgtacactgattaattagtgatcatcaactgagagattctcactcactctccaagtcacagcct

SEQ ID NO: 51257 - DNA, 4261 bp, Oryza sativa
agtttaactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtatgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagaacccccttgaccctaggacgagccgtagatcccaagccttagcagtattttcgaaataaaaatcctctgttatttgtgaaaaccctctagtctttctctgtcttgctgcttcatttatcgccaaaatctgccctttttaaatgttgcttttctttttgtttgtagatggccggcaacgtcacccgtcgtggtttggacatgactggtttcgtcttggagctgcgaggcatgtgcgttgtcctggggtatccacatggagtggactaccagggcaggccgcttccggagcaggagggtgacgatgcagagccccacgctgcttgggaggtcactgcagtgatcctcgctggctctcccgagcggacttcgctggccgtcaccgcgggtggagattctttccccgccgcttgccagagcgccgctctcctcgccatcggcactcttcaccagcactacccggacgagttgcagcactcgccctaccgctaccaccctcgccgcggaggagcccgcgactacgccaccttccgggatgctagctcggaggatgacgcgaccatcctgcacctggcgcgcatggtggaggcgtacgacgcggctcgtatcgacttccatcagatggtgcgccgtgggatggccgagaacaacatgaagatcctggagctgcgtcaagagaacctgcagctcaagaaggacctagacgcggtggaggcgcagctgcatcagctcaagatcgctcagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccaagcctgcgcccgtggttccccaggagggggaagcctccggcgttggtagcacggaggatgcgctgttgctcaccttccgtcctggcccgtcgcagcggtagatgagcagttagtaggcttgcgcgtgtgttctttctcgtttgtcttcttgttggagttgtgtggggcatggttatgccggtgtgtggtataactgtgtcggagcctgtctttattttatttgcctaagcaacttgaactttaatgaaccaatttaatagcagtaataaattcaagaattatggtagtcgtggatggttagctttaattgtcagctctctctgtttgctggttctgtgtggggtttccagatggtgacgaccaggagaagtgctgccaccggtgatggcaaccaacctgaaggcagcaaccaccaccaccagggcagcccacctccacctcctcctccgcctccaccaccaccaccagacaccaacgccattctcacccaaatcctcgcccagcaggccaacatgatgactgctttcctccaccacctccaaaatccgccacaacataatgctccaccaccacctccccaacactctaaactcgccgagttcctccgcatccgcccacctaccttctctagctccaacaaccccgtggatgcgttggattggttgcatgccgtggggaaaaagctagacactgtgcagtgcagcgatgaggagaaagttatcttcgccgcccaccagctgcaggggcccgcatctctatggtgggaccatttccaggctacgcagccagaggggcaacctattacttgggcccgtttcaccgccgctttccggagaacccatgtgcccgccggagtcgtggcccttaagaaaagagaattccgagagttgaagcaaggcaaccgctccgtgacggagtatttgcatgagttcaacaacctggcccgttacgccccggaggatgtgcgggaagatgaggagaagcaagagaagttcttggcaggaatggaccctgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacaccaactgtgcagcctggtcaaggccgcaaggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgccaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttcagaactccatcagataggactgttagaaatccccatcgtcagagagttcggagacgtgtttccgaaagaactacccggcatgccgcccaaacgagagattgagttccggatagatcttgctccaggaaccactcctctgtacaagcgaccctaccgtatggcagcaaatgaactggccgaagtcaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaagtccgcagtttcttaggtttggcaggatactgccggaggttcatcgagaacttctccaaaatcgctcgacccatgacacagttgttgaagaaagaagagaaatttgtgtggagcccgcaatgcgagaaggcgttcaaaactctcaaagaaaagctggttgtctcgccagtgttaatcttgccggatactcgcaaggatttcatggtgtattgtgacgcttcgcgccaaggattggggtgcgtgctcatgcaggatggtcatgtg

SEQ ID NO: 51258 - DNA, 1679 bp, Oryza sativa
agatggaagccctgaacctaagcatagttggtcgcggattcttggctgcattggaagccaagcctaccttactcgatcaaatccgcgaggctcagaagaacgatccggacatacatggactcctcaagaatatgaaacagggtaaaaccgctggtttcacagaggatgaacacggaaccctatggaacggaaatcgagtatgcgttccagataacagagaacttaaacagctgatacttcaggaagcccacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggtcggacttctccaacctctccaagtacatgaatggaaatgggatgaaattgggatggatttcatcaccggacttccaaagacccaaggtggatatgattctatatgggtagtggtggatcgattaaccaaggtagctcgattcattcctgtgaagaccacctatggagggaacaaactagccgagctctacttcgctaggatcgtgagtctccatggcgttcccaagaaaatcgtatctgataggggaagccaattcacctctcacttttggaagaagctccaagaggagctgggtacccgactaaacttcagcactgcataccacccgcagacagatgggcagaccgagcgtctaaatcagatcctagaagatatgcttcgcgcatgtgtcctggatttcgggaagacctgggataagagtctcccctatgccgagttctcctacaataacagctatcaagccagcctcaaatggcaccttatgaagcgttgtatgggcgcaaatgccggacaccgcttttgtgggatcaagttggggaaagccaagtgttcgggactgatatcttgagagaagctgaagctaaagtcagaaccattcgggataatctaaaggtggcacagtcccggcagaaaagttatgcagataaccgtcgccgtaacctggaattcgcagtggacgattttgtgtatcttcgggtcacgccattgcggggtgtacacaggtttcagacaaaagggaagctcgcacctcggtatgtgggtcctttccgtatcgttgcccgacgcgaagaagtcgcttaccaattggagttgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtgaaaatcctggacaccatggagcgcaggaccaggaaccgggtaatccgttttagcaaggtccagtggagcaaccacgccgaagaagaagctacctgggagcgtgaagacgagctgaaggcagcccatcctcatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcct

SEQ ID NO: 51259 - DNA, 2882 bp, Oryza sativa
tgaaagccatctagattttgctggggttacctgcttaacatgatcacatgtttaggggatgataatctgaatactcgcttacaccctaaacaggtatgcaaaactcaaataacatgttccatatatgaaagcaaaattggctgtgtacaactgtacaaccgctctatggatgtagagtctggtttcaatccatctcatcataaaaaaaaatgaaagctaattaagaggtagaaacaacagagctagctataagcaggagtgcaggagcctcccctgtgaggtatgtactggagtacctagcaaaaagaacacctaccagaactactttgataaatgcaaacagtgatgctattgtcgtttgaacatgactgataagtgtctctaggacagggttttcaattttgatttcggctaaaatttcggccatttttatagaaccgaaatttaggttttattggctgaaattttctaaaattttgattaaattcacaaaaaaattgagaaaacccgaaaatatcgaccgagatattgacttgccgagagggttttcgaaagagagaatccattatatgccactgactttatcacaggtctatgatataccattgattttgttacgttttacaatatatcatcgacttttgcttaacttctacgatttaccatcgccatcgacttttgcttaacttttatgttcactgagttagtctccgttagtactgtacaaatttatcgaaatgaccaaaatacccctgggacagaaactttcaaaaattttgaaatatcggattttaagtttttgccaaattttggatatttacaatcttatgtttataatatgatattttagaatttttattcaaatttcggaagtttttttctaggagtattttggtcatttgggcaaaattgtacggtgctaatggaggataaccggacggcgatggtaaatcgtagaatttaagcaaaaatcggtggcatattgtagaatgtgataaagtcagtggcaactcatagatctgtaataaactcagtggcatataatagattctctctttccgaaattaccagaatttcggaaattttgaaactaaaattacaatccctgctccagggctgcattgttcataaggatgtagtacgtcgtagcatcttccactgcaagagtaaagacatgattcgaaagacaacaattagcgacgtgtccattttgcagctttatcggtctataaaattattaagggtgagtaatgctgtgaaaatcaaaattttatagtataaatgtatggacggattaactggtatgaacacgtcctcggccccaaggcccaacagcccaaggctaacattctgtcttggcccattacgcctactttccattgctgtcaagatattcttatggaacttgtcgagaaaacagaaagaaatcagtccagcaaacgcaacaggcagcattatatatcagccttgctaataataaacggcatcaattgtctctaattacagaaataccggctcgggttacaattatctatttatagccagcatcaattacgataattaacattatctaaaaaaattgcgataattaacactattcacgaggcctctatataaatagatcatctactcgtccagtacgagagcctgcagattatattcttctctaaaagatcatcgagccctgcaaaaatcagaccacaaataatggagatgaagaacgtcgattctcggttgctgtttctgctgctgctgatcatcggatgcgctgctgttcctgcagtgcaatgtaagggcaatcctaattagaaattatcgactctgggctacggcgggagccaaacgcctagtgcagatattgccttagtgtctattcgatctttgtaaatattaccttttctccttacatgtaaatattgctccctgctttattcaatgaatggcaagcattgccgtcgttcaaaaaaaaaactatatactcagcgggtgtggttggttcaacataaactctcatccaatcacctctcttatctctcctttttttttatctattgttttcattcttgatttatgtgtagaggtagtttcttactaatgatttcttcatcttttttcatctctcctcattaactttttagatacctcggtttttgttttacatgaaaatgcatttaacactataaaaattagatgagatggaacgttgagtgcccttagtttatctccacatatattgttaattgactttgtttcttttggtggaggtgaacttaatgattcgaaaaggatctcttagcatgaacacctaataaatcttatgcaaaatagggtagaacaaagggtggattattgaccagaattgttgatgccattaattgttcgtggttcaaaagcctctgttgatgtaggtgttagtgtagtgcagattcacctgcagcagaaaactcaacgccaaaatggattagcactggtgcatgtggaccttaattaagatcgatggcgtatgtatatggttttgggggtggcttaaatcaaagtccaaacatctttttaattagtctcgagaatactgatcaatatatatacagaaaattccttaggttcctcggagttttcaattaaatttttcccctaaattttgtttcgttccttacgtgtctgagttcttgattattttggattccaatttccaatccgtgcattctaaacccttgaagcccagacaccttaaagcaccatatgaccgtcctatatacatctagctagtcgactgcgagttaaccgttagactcttttagaaataataattagcatacttcctctgttttatattataagactttctagcattgtctacattcatatagatgtttgctataaaa

SEQ ID NO: 51260 - DNA, 3991 bp, Oryza sativa
ccatttaaccatcattttcaccatagcatacatatgtgtctgtgctaatgatttaattattgttttgacgttgtaattaattaattaatatttaataggccggagcaatggtgacatgttgggagagaagatcaacataccacctgggccgctatgtgcaaagcgaccagacctctgcaagaactgctggtgttgtgaggtcagcgacgggcaatgctaccagagtctcgaggcctgccaggtcaactgcccattaccatcgccaccggccatttgatcagatctcgatcgatgcatcatatcgtttgtgtgataataagctgatcaatcaaccaataaagaaggcattaattaagtatcgtactctgttcgttttggaaataaaatgctgatgccatcaatggatgcatcatgcatgcatgaattaatgttctggaaaatatgtgataatcacatgtcgtgaaaacttgaaaacaaccttggataaaataaaaggacacctgatatttatccacgttatttagagtaaaaattttacttgcggatttaatcatgagtaaaaattttactattgatgacgtggataaatctcatacgttcatttttaaatccaacggtagctttcaggtttgtacgtgatatattttccttcttaataacgtttatagtgccagatatgggacaattgatcttttgtccatattttaaagtctaactataactatacacatttgaccctacatttttaactttgcttatttgatcttattttttttaaatcgaagttgttatttggccctattgtataggaatagatttagaagaaaataaaaaatgaatttagagagggaagaagacttaactgccccctgtgatttaccaaagcacatacgcgcggctagagttacatgggcgcggaggagaccaatctcatgagcacagagccaatctcggtcagcaaccaaattgttacacattctgatatgcaatacttatattattatagtctttagacttatctttgtcggctttagtttctgcttgttccttggatttacattcttcggaagtttcaataacggatccaccaatatctgatttagacagattattgtgtgctttggtgaagaattagtacttaactggcccccgcgtcatcctcccttacgggcgatacgggaggcagaaaccaccgccatcgtccgctccccctctttcctcctccgcctcgccgccgcccgagcggccgcaaggacggcggcggcagggcttcgtttctctcactcgccaacggtgggggaccgtgcgggatggtgaaggccgcccagatccgggccgtcgcagtcggatcttgcagggacacagccggcggcagggtagtgtgatgaggcggcggcggttggcagtggtggcggtggagtatgaaggtggtggcgatgaaggagaagagaggggatccgtcggcggcggggatgaagatggcggcgaggatggcgacagcgggcaggactcggtcacgccgaaagcggatccggccccctgaggacggatctggtgcagggcgaggttgcagcggtagcggcgcggcggagctgcggcgacggtgtcggtcgcaacggcgcagacttcgtggtgacggtgacggtggcaacggcgtggagcttgtggcgatggtggcggcagcggttggacggcggcgacagcacggtggctggtcgacggaaacggcggctgccggcggctgtggcaacggggtgcactcacggtggtgatagcggcgcggagctcgtggcgacggtcgcggctggacggcggcgagggggctacggctagtcggcggcgaggtgtccgttggcagcagcggctgcggtggtggtgaccgtatctacggttggaggaggcatggcagtctcggacagctaaccgggggtgtggcagacggccgcacctggccggcgtggtagcgattggaggggtcggaggccagcttggtgcagagaggcgcagccgatggcagtggaggccagtaaggcgcaagaggcgtggccggcggcgaggaggcccgcttggagcgagaggcgttaccgatggcgggaggccgaactggcgcgagaggcgcgtccggtggtggaggccggcgcagcacgatgaggtgcggccggcagtaaaggaggcaaccacggtgcgatatggagctgccgggggtgtggcgcggtcttgggtacacgaaggctggctggagggggcaccggtgcagtggtcccacatgtcagcagaggttgagtggtggtaaagcattggtgcgacaaccatggacttgcaggtgatgagcggcgggtgaaaacccagcccggcctttgccggaccgacaacaatggttcattccccctcctaagggcgttgtcgtgccgtctcatcccttaagggtgtttgccgggcgaaagcccagtcttgactcttttgagtccttgacggacggcggcagtggttttccatcgcttctctccttggagacatcgtttaggcatctccttgtcgaaaccactcgaacgattggtgcaagcacactctagatagagttaggctttgtgttggttgtaagggcgtttttgggcattttcgtctgtgttcctttgttggcctagcggcggtcggtcacgcttagcggcaaccggttcggtgctagtcttctctcggacctgtgtgttggtggtggtatattttttctctttttcctggttacgaccttctaggaatgtaatcttgtaatttttttttctgctttatcaatagaacttcgcatcgtctcgtgcgagtcgctcaaaaaaatatctactttagagaatcaggttcttaggccctgtttagtttgcgagacgaaaagttttggtgtgtcacatcggatatacgggaacacatttgaagtaataaacgtagactaattacaaaacatattacagattccgcttgtaaactgcatgacgaaattattaagcctaattaattcaccattagcaaatgtttattgtagcatcacattgtcaaatcatggagcaatgaggcttaaaagattcgtctcgcaatttatacgcaatctatgtaattagttttttatctatatttaataatccatgtatgcgtccaaacattcaatgtgatagagtgaaaagtttttgtttgggaactaaacagggccttattcatctgaaagcctgaaacttatgtcattatcagattgcaaatcataaaatggtactcacaccgtcccaaaatataagcatttttgaccttaaaacaatctttgagacgctactctgaccaataatatctataaaattaagtcgttttaaataaaaagatatatatattatgatattttgtttaatgataaatctagtagcatcaatttaaaatgatcttttttatttttttcactattaatggtcaaaattaaaattgtttgacttagcattattttaaaaatgcttatattttaggatgaagggagtagtattcttgaataccattatcaaatatcaattatttatgtgaaaaatatgtcgagctcaaactgtccttttgcattatcgatgaccttgaccaacatagccccagcacacacggtaaagactagagacggccagctgcaagtctgcactagcgtactgcatacgtactgaaattggtagcttctcactctccaagtcagtctcacaagtccacattaaacaagcatcaccactcgtaactagtaacaaaaaatgaccaatagtaccgataatcttttgttactactgctcctcttcttctccggctccagtgcggagcttgatgacggcggcgagctccaaacgcttctgaccatcaagcggcattggggtagacctgctgcattcagctcatgggaggtgagaagttctaattcttttggttactgtgattgggtaggagttgcttgtacagatggccaggttacgtccctctccttcca

SEQ ID NO: 51261 - DNA, 801 bp, Oryza sativa
ataagatttaattgctagaagttgttatatttagaaagagagagtacttatgaccataatttaagtaattcaaaatttaaaatttgactaaaaatgtaaataaggaaaatctttcgccctgtttttaatctttaaaaaattcttatagtaatatttatgaatggttggagtagcatattcttgagttattttgcttttgatggtgagttcgttcgaagataattagaaaaaaaatcctcgtctttcccacgcacgcctctgttttataaaaagtttagtgtttaatttattgcttaccttattttacttattttttcaatcctatttgttctcctgctctcagtcactgagctagttgcataaccatcgtttcgcggaataagcgaaatggcacatttgtaaaagaaaggtaatttgtgaataaaacttttatatacgtgttcttaacgatctaaaaagaaatgctgaaaaataaacttcgataaaaaaaaccttaaaatcagctccaaatctctaaatttaatgttgaaaatttcaaattttggttgataagcgcccttagcctgtgcgtgtagtgtatgccatgcattgggcttgaaaagatcagcagatcgtgtgacgtactacggccggtctgctgccaaaacaccgttctagggtcaccaataattggatggaatctggcactacgttacatcaaattattggccagatttttttcccctttctttctctcctcgctttcacggtcgacaacagccacggccatggtgctggctggacccgtcgtctcgtccctgt

SEQ ID NO: 51262 - DNA, 1627 bp, Oryza sativa
ctacttttgcaattttccataaaaataatattaattctcaaaaaaattcgtttcatgaagtataggtaatggatgggtctgaactctgatttcccttaagcaaacaattgtgcctggtcatgttccaagaaatgcaacgacgaaaaagacaacaattattaggatttttacaaagtacaaaattgcagaaaatttatgaaaacggtatgataaattgtttgcttatacagtagtgggacctgccctggcacagttgatctagattaactaatatatattgtgtgggagaaaacatcatagtttcattgctattccacagtttaatcaagggactatctaaatctttttcgacagaaaaaagcttccaaaattatgcagttggatcgctttgagattcatgccacatgctcaaaccgtttttttttctcccttctcttcctcatcccgcctaccgccgttgctttcacgtgctcgcgtacgcgaccgcgcactcctgcaccgcctccgccccaccacagtatagctcgatcggccatctaggatggggctgcagaggaggacttctgcataagctctggtttgagaccaaatttaggttgtgtttggttccacgttaaaattaaaagtttgaagaaattaaaatgatatgacagaaaagttaaaaatttatgagtgtaaaaaagttcgatgtgacggaaaagttgaaagttgaaagtaaaaagttgaatctaaacagggcttatatgtcctttctataccttcggcaattggacatcactagtgaacacgtcacacttactctcgcacaaatcatttttccagtacaatctaccgtgaaagtagaaaacgtcgcatcgaaccacacgtaatttacagcgactcgtgtaggtgccacgtcagttttaaaccggatgcgccacgaagctgccgctttcctcgtcgctggcgccggcgccccacattttcccggccatcattcccgccgacgagctcttccacttcccgtctttcttccccttcgagaacgacggcgcgccgccggagtcgtcgcggcaggcggcggccacgctgaacgtgcggtcgtactggaccaactgctcgagcacctccttcatcgtcggccgcgacgccgggtcttcgccggtgcagatcatgccgagcaggaacaccgccacggcgtcctccaggaacgccgccctgtcctggatgctctcgtcgacaacatcgtgcagctcgccgccgaccttttacctccgccacgcccactccgccaggcaccagtctgcgccgccgtcgttcgccaccctcccgtcgtcagctccagcagcacgacactaaatttgtgatactggccttatcatgtgtagtactttattttgttttagattataagacgttttaggtttttgaatagattagtgcatagaatttatgtatagacttaatacatgtgtttaaaagttatataaatatcaatagatctagacgagaactggaaaagccaaaacattttagatggaacggagggaccgagggagtaggaaagagccaaggactcaagactgcaataggtcaaggtcttcgacaactaaggcgaatcttcttgggcctcttatttcaaatgaaa

SEQ ID NO: 51263 - DNA, 1261 bp, Oryza sativa
tgcgagacaaatttattaagcctaattaggcttaaaagatttatctcgtaatttacacgcaatctgtgcaattagaatttttttatctatatttaatactttatgtatgtgtccaaatattcgatgtgataggatgaaaaaacttgccaagggatcaccctgaactcattttcattttggaagaactacaacacaaaggtatatatgtaagggtctgaactctgatttccccgaagcaaacaattgtgtccgggccctcatgttccaagaaacgcaaggaaatagactacaattactaagattttacaaaagtacaatgttgcagaaaaattgtgagaaacatcaatcatatgatttttcctttgtttcaaatgggttctaaaatctatatttttgaacatgttaatttattcgaaattttcaagcactcatctctacaagtaaacataacttaaaacaatcacgttctgaaacaaaatttatttttacttctatgccttcggcaattggacacaaatatggtggacacacttttacccttacacaacccgtttgttccctgcacactctacagtagaagtacataatttacagcgaggtgtcacatcggttttaaaccggatgcgctatggcagcagcgacttgtgttggttccccttgccctaccccttctcttccctaaggccttatttggtttggagggaattaaagaggattgaaagagattgagggagaataatttcacaccacaataggtgtgaaataaatcccctctaattcctcccttatggagattatccgaacaaagcctaaagcagcggcggcaagtacccccgtcttgccgtctattccatctccagcggctctccaccaccaggtccacaaccgatcacggtgtcctaatcataagctctaatcatggccatgactccaaactcattgatcttcctttttccccttcccctcaacctcctcccataaccccctttttcactacgctgtacagtagaagtagaaaacgttacatccaactacataatttacagcgactcgtgtagttgccacgtcagcttaaactggatgcgccacgaaactgccgctttctcgtcgccggtgccggcgccccacattttcccggccgtcgttcccgccgacaagctcttacccttcccgtctttcttccccttagataacgacggtgcgccgccggagtcatcgcggcatgcggccgccacactggacgtacggtcgtactggacca

SEQ ID NO: 51264 - DNA, 5507 bp, Oryza sativa
aggccgaagtcggcgatcttggcgcggaaggccgggtcgagcaggatgttgctggacttgacgtcgcggtgcatgatcggctgcgcgcactcgtggtgcatgtagctgagccccctcgccgcgtcgatggcgatgcagagccgcgtcggccactggagcggcgccgtcggcgcgccgccgtcgtcgcggcggtgcagccaccggtcgaggctgccgttctccatgtactcgtagacgagcagcttggtgtcgtcgccggagatgcagcagaggaggtcgatgatgttgatgtggcttacctccccgaggatcctcacctcggcgtcgaactccttgtcgctcttcgcgtccgacttggccgccgtccgccatagccgcttcaccgccaccaccatgccgtcgctgcccttgccgccgatgttgatgcggtacaccttgccggagccgccgctaccgatcacgttctcctcgtggagattgccgagcacgtcgcattcggagaagtgcagggtacggaacggcgtcatcttccacccggcgaggtcttgctgacgcttctggtgtcggatgatcagcaaccagatggcgacggcgccgatgaacacgacgccggtgagcaccgagaagacgatgatcaggttcgtcgacgatttgttgtggctttggtgggggcaagccggaaggttcatgttcgtgttcaccgtggcacagaggccatggttgccgaggaagctacgatcgtaggcgccgttttgcagcgtctccgggacctcgccggagagctggttagaagaaaggttgagaaagttgagatggagattgctgaaatcttgaggtatgtcgccggtgagcccgttgtcggagaggtcaagaatgtagaggcccatccacccgactgcggcagggatctcaccggaaatctggtttctgctaaggttgagggaggtcagacttgtcaatgatttgatagacggcggaatcgagccggataactggttgccggcgaggttcaactcggtgaggttggcaagcctagacatgtcagctggcagttcaccggagaactggttgttctccgccgtgaaactcttcagaccgacggcggtcgacgggagggcaccggagaagcgattgttctccatctcaatcctcgagatgttaaatgatatctcactgggtagagtgccggtgaagttgttgttgtaaatcatgacattggtgagcaactcgaatgaccatatcttcttgggaaagtccccaacaaagtggttgttgtatgccatgatgttgttgatggttttgcaatccccaaggttcgtcgggaacacgccggagaagctattgttgaacaccacaatgtcaaagagcttcttattgaagcaaagtgtatccggtagctcaccagagaggttgttgttggacacctcaaaattccccaattctgaatgttttccaagctccgcgggtaggggcccagagagcttgttattgaagagacggatgtcggtgaggtccggcatcataccaacaccagccgggatgggtccagtgagattgttgtagtacaaatatagtaatctcaacttcttcaagtttgcaatgtcctctggtattgatccagagaacttgttcatggacaggtcaagctcctgcaggttgagagctgtgatgttaggaccaatctcgccactcaaattgcttgcatagagatatagattctcgagcttctggtgcttcaatacccactcggggatttgtccctgcatcttattttgtgacaagtccaacaatgtgagctccatcaatgacgacagatcatcagggatggtcccagtaaggttcatccatgacagccacagcattttcagctttgtcagcttgccaaactcctttgggactggacccggctcgaatgggttggatgccaacgtcagcgtctcaagctccacaaggcctccaatggcggcacccgggtaattcccattgaatctattagtgtcaaggaccaatgacttgagcttcgagaaccttgcaatagccgacggcacatcgccggtgaaagcattgctggacaggttgaggtgttgcatccccaacgatagcctgtcaatgcggtccggaagtctgccggataattgattgttggataggtcaaggaactccaaagctgagcaaccgtagagcaccgtggggaaatcaccggtgagattgttgcaagagaggtctatgtaggtcagattcttgaggctacaaacggaggctgggattggtctggctatatggagacttggcaaggagaggccagtgacctgacctgtgctgctactgataacaccagtccagttgccggtgctgctccatgaactgagtggagctgggttgtcccaatcttgcttgattgctaggagtagtttttgctcgtcggcgctgggctgcgcagtcgatagagagaagagcaatagtagtagaaagaggatgaggatgttgtagacagccattttttgcgagtgtggtgtgttcttggatgttcagacatggcgtcggagtgatcttaagtagaaattaaggcagagagagaaccaccatcgaagtgcgtcactacctcaggtcaagtcttcggtatagcttccttagcaccaatcctctagtgattgaaagatgctctgatagagacatgtgagttgtcagttgagcactatgctatcctctttcatccaacttgaatgtatttaagattagaagcatgaaaaggatgatcaccttctggtgtagtacaagacaattacttggaatatgttccgtttgatatatatgcgattatatatcactatgatacggcactcgaaagcaaggacatgcagtgagaatggaattgccgtttcctagtcgaaatgttcttattctgttctgtcgaaagtttttttatgctttacatacatatgttgttctgtcttttcggcagaaatgggggggggggggggcgagattgtatctactaccgtctcttgtagctgaagaaactcgtgtgattctcgatcgcccatatctgaaactctgaataattggtgcaggttcagagagttcaggacttcaggtatattcgccgcactctgtttctgaattcagtttcgtttcgttgtgcactgtttcttttgccacgtacgtgtgtaaatcatggaattctcacaagatgttattaatcgggacaaaaactaagctctctccaatggagtggtgtcatcgatttttattgatattacgtatggagaagggaaggtatctcacgctcatgatggattttatgttctaacatcaataatttgccacagtagcatactactataaatccggtttttccaaatgtccaattgtggagattatgagtatcccatacccacacgatatggttttccgactgattataggggataacttatatctatggaatatgtaacggatcatgacttgggtattacgtttccctgtttattatggaatagcctaaagtcctggtttgataaaattataaagtagatttaggaaaccgataccgtattggttaaggtttctatcttgtaatcctgccccccatcctatataaggtgggcaggaggccctctagggggcatgagcacatatgatggtcagatctatactacacccggcggattcaaatccccaaacatgattagggtattacctctctaaatccttgtctccgcatccatccacttttaggtctcgtgcgctaccccttttattattgccgaattcatgtttcgacaccaatcctagtttttgcaggcggcaaagcgatcatcacgtaccaaatggtctgtaaaaattgatatcgccgccggagcccgccgcctagagagaggagaggggagaggaggagtaggagaggtcagaggagatagccgggcatagagagtgtgggtgatgggagagagagaggagtggagaataaataaaatagagtgagctatttttgcgtgcgggtgagttaagagccctgcatgtaaacataccttatttttgtgtgcggatattttaagtggtccgtctgaaaaatttgaattttgcgtatagatctcttaaagagccgtatgagaaaatgagggtcgatttttgcagacacggacactaatggtccatctataacctattggggtgttcgtctagaaaaatcattttttaagaagtggcaagcataacccccaatgcaaaaacttttaccagatttgtagataacacctatacgacaatctatcatttcgaaaaattccaacacaaaacagtaacaaacctttgtcttctctaaagaaaaacaaacacaaccctcttatgtgtttcaaaaattacggaacaaatcacacgacaatatctcctaaactctcaagatgacattctctcgttgtttagaagtcaactaaatagttatgaaaatttttttaaaaaaaattaacaagactgattattatgataaatcactctacaaatatacaagttaaaatttaacttctacaagttccaacagaaaaaacaaattaaactatgactagttaacgtatattcgtaattaatttttttattgcagaagttaaatttgaccatgtttatgaagtggtttatcatatattaatctatcttgttgaatttttttaaaaaaaatcataactaattgggtaacatgcaaacaccgagagaaaatcctgtcaagagtttaaaatagttttgcaatctctatcctttctatacgcaagctatctttgcgacgaatattagccatttagcattatcaaattttagtagggcagagaaccggaagttcgagatattcgcacgtctgcttcagctggttgtggacaaagaggtgactccgtgactccccgtcgtccgcttgtcctattgaagtattgatgatagagcttgatgactgatgagtgaacgacatcggctgaactcgcagaagaattctctaacgccgacgatccagtcataatcagtgcggaaacttgaagctttctgctcttataacccactgtcgatctggccatttgtacaaacgaagggacgggtgtgtaaagttttggcattgtcacatcaggtattatgtaggatgtcgcatgagatgtttgggcactaataaaaaaactactccctccgtattttaatgtatgacaccgttgactttataaccaagatttgaccactcgtcttattcataatttttatgcaaatataaaaatacttatgtcatgcttaaagaacatttaatgataaatcaagtcacaataaaataaattataattacataaatttttttaataagacgaaagatcaaacgtttgtcaaaaagtcaacggcgtcatacatataatatggagggagtaattacagaatccgccagtaaaccacgagacgaatttattaaggctaattaatctattattagtaaatgtttattgtagcactacattgtcaaatctagagcaattaggctt

SEQ ID NO: 51265 - DNA, 15444 bp, Oryza sativa
ttttatctgcttttgtccatcagtggacgagtccaagaacacgacctgcctttgaacgttgaatagtgctcaattagttagctaatatacgtaggatcgatgtagccatttcaattaatcaagtggcgaaaggtgaggagctttggcctttattaggaggtaagaaatggagaatctaggaggcaatgatgcggcaagaatcatcattatatataatggagagtaaagtggtgggtgaaaatccaccgtagatatgatatgatttatcctcgtccaggggccaagacatgcctagggctggtagtgcttaaattctaggccaaactctgcaatccaattcaggccctataaaaatacaatagaaattctgaaaatatataatgggtagttaagggcatatttgctcagccctagccgccttggcttttcctatggctcaatccttgtcctcatcaatcttgttgagctttcaccgaagcttcggtagatacttattatcctgcttgcaaggaaatggcacgatgctctcttctaatgttgcataaaagcaagatatttcattcaaaatgaagggaagtgttgtgatcaacaatcaagcttaaagatgagtgcaggacattcttaataacctaactagtaaatactacttgactgcaacttcaaatctatttgctttgtaaaaaaatgcatgtacggttttgagcgcctaggaaaaaaaatgcatgcccttgtatttagattgtttatttcagttagctaaacttccactattatcacttctagaccatggttgaacctccaggtgttcataatcgatgttccaaatagttaacatatgatgttccagttccagtggtatcgatagtatttagatttcattttcaaacaataaaaccagaaactttacacctctaaactaccatactgtgtataatgatagttacttcctaggatgttgttttttcctttatttttagaggactccttaaactaccatatctgtgcttgttctgctgctgccaacacatgttcattaaaccagatacaaccatgcataacatatacatttagctaaaaaaatttggtgaaaatgttgtgcattggagacaggaaaacttcagctaaagcttactactgtatattgggaatccagggaatatatatatcagaatattcagaattatcaaggcaattaataagcaaagacagcaggcggtagtaaactaaatttcgataccttcgtgatgagagcgaaatcccccgcccaattcttccggagaaggaggaagagaaaaaggcgctcacggcgacggcgggggaagaggtggttagaacccttgatgctgtcgcttcgtcgtcgacggggagcggcggatcgatgagcgcgcctcgtcctccgcggcgatggaatccgtggctaggggtggggggaaggaggagaggcgccggcgtcccgcggggaggtttcaggggtgcgcggcgcggaggcggcgccggcgcggacgcggaagaggggggatcttcgcaacgcatatgatccgacggccacgatttctcttctgatacgattttcacaaagcccccttgattcgagtcgatacatttggtagcgatccgaagtttacacaaagcccccactacgtgtacatcttaaactcaattttaatcttaactaattaaaagattcatattattcctctcgtcgcatctctttgaccagcgttttttcgtccgtcaccgtccccttccgctttgtccacaaaaactaggattcggtttggacagataagctcgaatcgagctcaattccgcgttgatttcttcaagataagatccgattcttgaggaaaacggaagaggaggataagagaaatatttccccttaaccaattttggaaaagatcgaaaggggagccaggatttggaggagaaagcggcgccgggtcgggctcagtctccggccagaggttgaagacagcactgtagcgactgggacgtggtgtggactttggggaaaaaggctggcccgagaggagaagaagtagggacatgaaacggactttcggcgctgtaaacttcgtggattaggcccaagaaagagagaggatttttaattacttctccaaataaattaaccaatgaaataatctttgaattgttaaaaatatttccaatgctcaaataatttcaagaaaaatcttgaacatacttggacactctaagtatttaacaacattaaaacaagatcatttaatgattaatttattatttaaataattactgaaatgttctttgtattattaaaattagtagttgagctctgaaaaatcctagaaaattccaaagagcagaattaaccatggagaatttaataaaattaaatccagccatgctttatatttaggaaattttattatacatttacaacttactaatttatttatatacaacattaattcaccaacaaatacatagcattaagtgtaaccaagagcaaaaaaatgtggttggatttatcacgtcatctttccattcactacttttaaatgatttttctagatgagcacccgaatagattgtagacaggccataagtgttcgtgcctgcaaaaattgatcccgattttcccgtacggtttcttaagaaacccgtatgcaagaatcaatttttccaaatggaccatttaaaatatccacacgtgaaaatgtggtgtttaacttacccgcatgcaaaaatacccctgaagattctcacttttgtttattctctagtcctctctctctctcccaccacccccactcctctccaccctaccggcggcgggcaagggcgacgacgacggcttcctcctcttctcccccactcctcctctcccctctcctccctcccgatgcggtggagggctcaggcagtgggagagggcggaggagggatgcgacagcggtgacggatccgacgatggtgaggcgtgtggtggcggatccgacggtggggaggcgcggcggccatcgcccgcacggatccgacaacggcggatccggtggtgggaatgagcggtggcagcggatccgatggtgaagaggcacgggggcagcggattcagctccccctcccgcgcgtcgacggtgaagggagtgggcagacccagccaaccctagccccctacgccccacgacaaggacggggacgaggatgaggacagcagcgacgacggtgacaacgacgacgatgacgaggaggacggcgggcatccgtgatatggacaatattacatgacatacaaaaaataaataacttattgtagccataaatataggagtcaataaaaaacaattttatttcaaggtggtatcaatatctttcttataatcataaatcgactggatttaaaacaacaaacaaataggtatgagtgtagtgagtgtcaattcgttgcaccacaatacaaggttcgatttagtggagttgctttcggttgatgtgtcatcgctttcgactccttatccactaacttgcatgtgcagagtatgtatgtaaaatcaaaattgacttcatccgttacaacacacgagcactgtgctagtagaagtatagaactcccccatattttgtaagaaaaataacctagtagggccaactcaactttatttggtagtagaaaaaagataattttttggtgagtagtactctcaaatgaggttgagtttcaacttattattatttggtgttaatatacttcatgcctatacttatctctagtaaattttttctagcaaattgtctttcctagctgaatgtaatataagtttataatctttcagatgcatgaattatttaaccaaatacagagtgttcagttatttggaaacgtgaatctttttctctcacataatgtcgatgtttaagcattgaaactattggatccatgccattgtaacttcttcggttataaaaaaaaatgacattactattcacttattaaaaatgccattacaatttgactaaaattagagatataccactacgtaccccttcaatgcacttataaaaaattttgaaccaaattacccctccttcattcacccccttcttccttacactagaacctccgccacccacacactaatgttgaaggtgaaccaccccctcgtgtcctcctctactttgctttctcccctaccaccgccaggggagctccaaaaagggtgacagcaagattcgagcttgaaggggctaccacaaaccgctcctcgacatggtcatcccagttaccaaggttttcatcggggcagccccgccgccaccactgtcatccaagaggacgacgagatccgcgattatctaccacgagctcaatgggatggctagtgatggagaggtcgcggctctatggtatggggatggacggtgagaagtgggcctaggtggagagggcggcagccagcggactcgattgggatcaccggattggaccggtggaagagatgacatagattagtgagagggagaaggaagaaggaagtgaaggaaggagaagggataatttggtgtaaattcttattgcattggaggggtacatagtggcatatctctaattttggtcaaattatagcagcatgtctttaaatagatgaatagtaatggtatttttcaaaattgaagaaattacaatggcatgagtccaattaaccattgaaactaatttaactcacttctctgatttgttttataacaattgaatgtgctatattaaattactaacccaattaaagcatataaaagcatcatgaaacatctgagctttggccactgatcggatgagccatttgcaagttgcaacacacgttggagcctcagtttaggccccctgatcaacgtttgcaacaaatttggccacatttctctgaactaggaaggtagcccgcgcagatgcgcaggcaatttatttattgtttacaaatttaattggtaaattttgagatagatctaatggtttagaaaatttgaagatttttttcttaagagagtaggaaaggaaagaggagatgaggagagtacggaagggtgtggagaaggtgggagcacatacttttttttattcgaactaatagttaaaaatattggacccaccaattttaaaagaaaatcaatggatagattttagagtgtcacttggcttaatccaaacaaattaaaattaaatcagatctacttgaaaaaacacaactaaattgctttattttttcgcaattacgtagtacatttatcaagtgatatttgatatcctaaaatataatatgaaattatttaaaattatcataacattaattattatataaatttagaaccgcaatataaattttataagacacaaatattttatttaattaaagaaatgcaacgggatcacaaattgattatataatttaaaataatttaaaagatgaacgtttagagataattgatttcatattttttatttatattatagatctagtttatatttgcacatatttgtggagtaatatatttttatatggtaaaaagttatattttaaagatcattgattttgttctgacggtaatatgtattatcgattttaatttattttgaattttaaattgttggtttaattatgtatagagcaacagttagattagatatgatatgtgtagcttaaaataaccatggttgtttctctttatcatagctactcaaaaaatatagagagaagtggagggggcagaaagtgttgtgcgtatctaatggtgagggtgaggtggaggggactttgtttttctatttttttctaaatcatttaggtcaaaaaccaattatcatgtattttgttttttaaaaaactttttaattttaaagtcattataataacttaaaaaggtaatcttaattacacctatttaagctggacgatttaactggattgcttggttcgaattagctacataatatcacggtaaagccatgtaaactgatttaattagctatgtataatcttcttgtaaatctcctagcttacatatatatatatatatatatatatatatatgtgtgtgtgtgtgtgtgtgtgtgtgtgtattgccgtgcatgtaataaatatagctatgattagtagtaacacaatatgacagctaattaatctcaacttctaacaaccatagttactaatccttccgacaaaccgtacatacgtacgggagaaaggtagatctaattcattggtataaaataatgggtccaccaatttaagtgaaaatcaacggcaggtaaagatctaatctaatggtataaaataatgggtccaccaatttaagtgaaaatcgacgatgagattatattatgccacatgacggcctaggagcatttgtaggagcgcctcgtggtggcttaagagcgtttataggaagtttaatggacttttagtatataactaggaaggtagcacgcgcgaatgcgcgggcatgcgtcgtacgctaagtttgagatacttataaaagcgaaatattaaccggtgaatatctaccacgatttctccataaattgttttcgtcgacattaatttcctttataattttctaacctattagctttatattatatcatatttatgtaatatctataagcaattatttataatcttcttcatcatttgaaaagaaggtatacttattttcttaagaaaacatgtcaataaaaagtaagtgtaaaataaaactaaggtattttactttttttaattacatatatattatcatggtttattcgaggattaattgggtgggacatgaagctccactaaatatatgatttatatagcctaatatgatttatgtaatttgagatccatttatgaacattttatgtggagtgggtcagaagttctacgcaagctaacatgaaagcgaaatataattgaataataatatttttgaaatgtgatgtaccatgtatacacatatgttttttcttatataagatagatctaactattctaaatagtgattccaccagtttaaaaggcataggagtattccagaaatgtagcttaaaaattatggttgttttaatatccaacattattgcgaagtaaacgtagctcaactggttaggttcattgtgatggaatttgcccacttgggttcatgtcctagacttggacaaattcttttaagtagtaggtgacgtacccgttgacagcgagaagtgcatagtgactttatcaatctcaaaatatgtcagcctagtctctcgaaaggactaggacaaattctttcagtagtaggtgacatacccgtcgacagcgaaaagtacacagtgacttcatcaatatcaaaatatgtcagcctagtctctcggaagtactcataggggtatgtgcatgcgtgagttcatagagctgagtgtgtgcgttgtgaacacccgcgtttgtactttatttttaaaaacacatcaaacattatttagaaaaatagataaaacaatagggatgggacaacactgttgtgtagatgtgagagtgaggaggtagagattttatttttctaatttttctaaatgatttaagtgaaagctgatgacaaggtgctttattttttctaagaatttccaaggattatccccttttttataggacgtgccccaaggtaacttaagattttatttaaaaaaatagatctaataatttttttgatagataggtttagaagatggtttaaaagaacattgattgaatatttattatagatcttaatttaactaaacatattgatatttgtgaagtaatatattttatccttatatagtagaaaatcatattttaaaaagaccgttgattattatgtatgtatgtttttttctgtctttcttatgtatacgtatatgtatttgttttcttccagcgaagatcaggaaactttatcgttttgttttcacaatcatgtacgtttgtatacgtacggagagaacagcagtaggatttgtaacgtacaaactcatacgtacggacagtagtagcgctggtacattataaacatgcggaagttattattttttaataatagatttgatctaatagtgtaaaataatgggtccaccaatttaagtgaaaatcgacgctaagattagactgtgccatgtggtgacgtaggaacatttgtaggagtgccacgtgacggcttaggaacgtttatagaaagtttaatggacttttagtatataatagatagatagattgattcctagcaacaacaatttcatgtccagtaacagagaacaaaactattaaatgggtctcatgcaacaaagcaacattccaaatatcatctgccagagaataaactgcataaatgtagagcatttagctgaacatttacatgatggtcatgtcaaattgcactcacttcacacaagtgtcttaaacagaaggaagcaagttggttaagtaggaacaggaaaaccccaaaagatcagcacagcaagacattgagagaaagagacgatgatacaagctcagaagatcatattcttcttcacagcaggtcactgaatgtgtcaaagcagctccaaaaaagaaggtcaacactcagcagctgttcttttccgtccagaggttattagctgcatggattacatggcgtgaacaaatttcagaataatgcggagataacagagtttgatgtaatagaactaaggtggaaagaggtactgacagatgaagagaggtcagatgtcttcagtactctcagtctcttaactgaagaaacaaacatcctgcatgaattgcagtatcagactatcagttaggaggcatatggtccagtttgatggtaaaattattttctcccagtttgataatcaataaattttttaaaaaaaacaagggaatagactgcatatcattttcaagcattgctgtttgcataatcagcatccaataaaagtagtaactttgtttactactctctgaaaatgcaacggtaaaacgaaaaactcacccccatggcacatctccaacaagcaccttgtcgccttcataatcctcataaaccaaagtgtactccccagttccatctagcaagccagatattgccacatcttcctgctggcagtcctttgctccagcagtgagggggtctctttgggcttaaatacaacgacggaaattgaacacattggatcagatactaatccgataactcagccattcaaatttcaaaatactgaaaataacaaagaaataatttgcgaactttcgaaagaacaataaggaaataatttatgcagtgccatggttcagtatcagtggaaaactcttcagatactctatcataaactgcagtcgcaattgaatgatttaattgtgttacaaaacaacagagttgaggttcatatacctgcaagaaggcctcggaatagcttgtcaaccgctaaagaaagcttctcatagctatcaaaagcattcagatcgatctttctaccaatagggacaccatccatgtttatctttatgaatggagctctcttgatctcttctgcttttgcagccttctttccattctgcagttcaagagatgctttgctggatgtagccagatttcttctgaatgttcgaaccggaggccaaccaacaacaggagtactaggagatctgcatttcgaggttgtcaggttgaaaaaggttcagaaatgatctcctgtattattttgcaaataataactacagcaaactaaaactagagtatctgactagctatagttactatttttcaaggttgaaaagttcagaaatggtatcatatattattttgcaaagaataactacatcaaactacaaaatagagtatctgactagctatagttattacctttcaatttccgttttttgtacaaatcctaaatcacctatgcatcagaaactatttctctggaaaaaggatgttcaaattaaaacatacacattgtagtagtctacattcagatcaggaagcttagtgcctgatggtgtacaacaccagtaaatgattgctagctaatgccaaagctttgcctatatatggtgacacaagagtggcttataaatggatgcaatctaaagggtggcatatgatcaattttcctgaaattatacttaagtaaataatcctgcaaccaggtatgtcaggtgaactaacaacaactgtcatgaacagaagggacaaactagaaagtaaacaacaaacagtactacatgttgacaaagacaactgcatccctcataaatggagtaggagatctatctatctatctccatggatagcatgcaggcaggcagaagcaaacaagcaaaatggtttttgtcataaatgaggagcaggcatgcaggagatggaggcatctccctcttcaattcatgcagatgaggaggaaatgaggaataaaagaatcaggagctagtagctagctaccaatccaatagttgagtttgcccactcataaaaagcaaaagattatggtgctgtggaatttttgacatgtgaggagaggcccttatgattcccaaccttgtctggaagcagccattattgttggatgcaagtgcattattccctgtagctggtggtggatgtgcctcttcttcctctggggaccccttgtttttgtttgccttgcctgcacaagaacaaggaggaagaaacaagatgtgatatcatgcttcagagaactttttcccctgctgttcttgacttttgagcatggcacatgcaatcaagattgaagaagaaccaatgatgcaatattctactcatatgcaatacttctttttttttgtcagataatggatttttcattaaacaacaatgatattacctaggtttcttatgtaaacacacttaccacaagtattttcttgagcagtgtttaccacaagtatatatcaagtcaactaaacctctgaaaccatactgttaaaagttcagtgcacctatcagctccccccaataaaaacacaaaaagttcttaacaacaatcttcttaacaactaatttttcaggtttcttttctgctcattctcctcagccaaattttagaaaccactcctacttcagagttgagagcaatggcacacacatttctgctcaggtctcaaacgctgcattacccatatatctaactaagtttcatcagaaaatgaggcacatttttgtggtatgtcacaacaccaaaacactaacaaaaacacacgtataactagatgtctattacagtaacatgcaactgacatcgcaagaacacgagatcagttacagagttgtgaactttttcttttatctgtaccttgcgagtgggagacgagtgtggagtagcccagggagagcatggagctcttgtcaccatcatcatcatcagcagcagcagctgctgcaatggagtgcttcgtcgtcgtccccttgtccctgcacgccgctcgccatcctcctccggggagcccaaggctgagctccagcgtcttctcctcctcctcctgttcatcgccatggcgatggtgatcgcttggctcccccatccagcttccgccgagacggcctctgctgatcttcttcatgctctccgacgcctcccccatcacccgctctctagatgtacagctcgcccaaatccaagaacaaatcaagaaagcagaaactagctagctgagctgctgctgctgctggttgctgtcttggctgcaatgcaagagggagaggtgtggaacagagagctagaaaaggtgtgggaatggtagtagtagctgcagctgcaatgcgagcaacggcacacggcaatgtgatgctccgatgcgagtagcgtctagctgagcctgagctgagctgagatgccgcccatgacatcctatcctgctactcctcctatcatgccctgatagagagagattcgtgtttgcttctgctgcctactgcattctctctctctctctttctctatattcctctcactcaaaaggtggcagatggagcagttaaaatagcataagctagctataaatatattttaatgagataaaaatgagaaagaaaagcagtgggctacagatctgtagccagctgcagcacggactccaagacacaatatatgtatgataggtgggaccatatattaatagtatagtaagcaactattgtatgaattgactattagatcggctatagatgaattagactaagtagtgggttatactattaaacttgctctaataatgtggtggttttgctttagactaattaaagtgccattaacaagctcatcagctagtaatagagtagtattagcaagaagatgatgatgattatggaggcagaacagcaagcgacaaggccataggtgggtgagaatgagatggtgatggggataattaggcgtgcagcggagaagatttgcaggatcctgctcttttggccgctgctgtagacctgtagtactctactattcctattcggctagtattcctttctactctctctcatggcctctgtgcctgcctgcgttgggccgcgagcacattgctgttgtggttgccctgtctgtctatccgtgtgtcgtcagggtcatcaggattcaggggcaaatgcaaatgcaaatgcaaatatgcagtgcagagaaactgcaggccaggcagaggcagaggcagcagagcactgaaaaggttacagtggccaagcaagcaagcaaaggtgacaaccaaaccaaaatatgctttgctttgctttgcattgctttggctttgatgatttcctcctcttcttcttcttgcgcgcgggcgaggccggctcccgagttggtggttgttggcatgccaacggacgacgggttgttggctcaagaaagctgcctttctcttcctttcttgtgagttgggatcagagtactcatcgctagctctgggttcgtttgtttgtttgtttcggtgccttgcattgcgttgcacctgtaaacaattgcagggatgcaggtgtggcatgcataatgcattgattcttggagcaagcaatggagagttgttttgttggagaattttatgtagaaagtggtcttatgttgtgtgatacttcctctcttttcaaatactacctccgctttttatatatataacattgttggttgttcgtataatgtttgtctattcgtcttattaaaaatttagcgtaaatttttaaaaatataagtaaaggtcagagttttatatgataaaataaaacataaaaaattaaatagcatttatataaactttttaaacagaacatataatcaaacgtcacattaaaaatcaacgacgtcatatattataaaatggagagagtttaatatttctcagcacaatagtctacttttcaaggcatttaatagggtgcgcgcaccctcaacaggatcactctcccaactgatagtggtagctcggatctaatgttgaaacatgaaaccactcattttatattgtaaatgcccttcaaagataatagaagaaatagggcatgtttggattgttgcaactttcatgaccattctgttcctgtaccaaattttggtattagcattttggtattaccaagatttgataatgcaacaaatcaaacatgttcttgtcatttctatcttactaaaagttggccgtcccgaaggttttcgctcttaaaatctctatcatattttggtaaagcctaccaatcaaacataatcaatattatcaaattttggtaataacaaaatttatacttgggtattaccaagtttggtagggttggtttgggcagcaacaaaccaaaaagatgcttacctttggcctctgcaaaaataaatgataacattaatatttgaatcccagtgaatagagttatgcatctacgactccctcccatgatcacattgatgttgctttctcaatggagttatcttttgctttttcttatttcctgttttgtaaatttgtaacatctgttggcaactgaaaatagaatgtgaagtgagcccatggaaaaaaaaaggcacattgcacaatttgcggaaaaaatagttatcttagatatcatgcaaaaccttgcttgaaacttcatgcaaaattacttgtagcatgaaaccatccatgcaaaaaattgtgagagcacaagaatgcactttctgcatctaggaaagcaagtgcccctagaggtcaacaataatgagctggtggcagcatccaagcaacaacagtgtgcaggtggtgagtgactaacttcaacttgggtgccattttggactttggagggaatcattgtagtagtaacctccatccaccacctttgcataaacctctctctggtcccctacatctttgctcctcttcttcttggtggccgttggatcaaggattccttgatctagcgtcctatgtaaggtttgtcaatgtttctaccgcgagagagagagagttagatgaaatttccacgcttctaataaatttaattccattaatcatgtaactatgtgttgtcgaatagacaaccacgtcacgtcgaagacgtggtttttttcaaccgttgttggaaaagtgaaacagttgtattacttagtgaaaaaaacttttggaatccccctattatatggccctagggggctatttatagccccattacaagttctccctattagggtttagattttacaggggaattttcattgttacccttatgataggaatattattgagggcacactgtgtcctttacacatatgggctcctactggacttaaatggctcggcccatctatctgccaaaatttcctgaggacgtagcggcccgctaggcttcccgacgacgaggttccgtactttggcgaaaccgtgccttcatgccgaggctttcgccgcatcatctacacccgtgcagccttctggcaaggactccgcttggcgaagctggcgtaacccaagccacggcttacgcccatatggctttattctcaaccttcgccgcctgcctccggtctgagcctgttgcccgagtttttggtttcggcaggtccggccgaaggcccttcgtggtatacctccagcactatgcaaatgttgcatttctaactctagttttcctaataacctgtaatatgtccatattatacaacggtataggcctatataattagaaattgactagatgggtggactaataatctctactattataaaaactgaagatgtttttattggtctcttggtacaccatccgtatttgagtctgtcagtttgttcgcttttggaaacacatatccgtatgtaagtcggattttaagtccgtttgcttttggaaataaaaagagtcgtataagaaatctctttaaaaaactcgcatgctaacttaagatgaaagttggactcctaattgtagctcatgattttctaaagaactatccaagcg

SEQ ID NO: 51266 - DNA, 11923 bp, Oryza sativa
ctgcaagcagttcatcacaaatgaatatctcggagaccgtgccaaagtccaaaaatgttcatattttgggacggagggatgcagtgcgaaggaaagggaacataaggaggacgcttttaaagaagtagagaaatatcatcatgtgattaatagcaggattttctagataagtttgtacggataacaaagaatagaaatttgaaaatgcccaattctacaagattattcttggtagatttcaccgagagaaaaaagaaatccaaaaaaaacatggcatgaatacatgcaggcgtgggtgtgtgttagatgagaagagaatatataacaaccaaaatgtggtatagtcggtgataccatctttagctagctactttctgtttagtttaggccattaggacggtggtccaaaatacatgtaggagtataaattgcagaaagaaaaggtaggtaggtaggtgtggccggccaggggccagcgccgccgcggcgcgtgctgccggccgccgccgcgccgtcaaccttttggacggacggacggacggcgcagctagcagctcacaaagattatctgcggtcaattggccctcctgccgtcccctgtactgcttctgctgatgtgatgaccacattttatgatcacagttgtgacttgtcatactttttaaataatatatttcatatgccatagatttatttttttaaactttttggctagcaatttatccaccacacttttgtggctgtcataatttatctaacgttagttgtggtaaagtgtggctggcaactaaacatgtaagttttcgtatgattaatcacattcctaaaaaaaatatgcaggtccagatgctaccatcgttgtgattcaaattatttgtgttttacatttgtatcttagatcattattttataagatatcattcaaagccagctcctaccattcgtacaacgtgcttatcggcaattttacaaaattataatggcattgttacaattttcccaataaactaaggcccggtttagatctcctgcaaattttgcatcctatcatatcgaatgtttggacatatacataaagtattaaatatagacgaaaaaaataactaattatacagattacgtgtaaattacgagacgaatcttttaagtctaattgcgccatgatttaggcttaataaattcgaattaaatttgaaaatatattgttcattcaattttttgttagaaatattcggtatgcaaaatcttttgcacaaatataccatcggtctcgcacaaccattgcgtgaaaataacgtggaaatgacattgcgaccggtatcgcgtagtgaaagtgcgagatcgcacagtctcgcgcggtctcgctcaagcaaactgcgataccgtgccttgccgatttaattagcgattaattatctgataacaatccggcccaggtggggttggccgaggctcgataacttaaggttgcccggatctcaacagttcataggcacacccactcggggaaatgtcccatctccctaaaagactagtccaatagggaaatggtggctctccccttttaaagtggcttcctcctgtcaagctaagcaaggtgggattattcagaggctcacatggtcgccgcccaacttttgcatctttgccagcgggtaatagtggatgatgtcctcatcattatcctgattagcgatcgctaatcaaatggaacccattggacagtgtcgttgattgcttcagcgagaccgttcggtctcgctcttccattccgcgagaccgtgcggtctcgcgctttcaccgtgtgataccattttcgcgcaacgaatgtgcgacactgacggtatatttttgcacaagtttttgtatcctgaatattcctgagaaaaaattgaatgaacagtatattttcaaatttaattctaataaattcatctcgcggtttacaggcggattctgtaatttgttttgttgttagactacgtttaatacttcaaatgtgtgtccgtatatccgatgtgacacgccaaaactttacacccatggatctaaacacggcctaaactaaacatttgattggggaagacaaaacaagttccttttttttgacaaaaataaatccgtgcggtattatttgaccgcacgggataatcgattatcccatgcggtccacttaacccgaccgtacgggaaaatgattatcctgcgcggttgggccgcccgcacacgaaaatattcatttttccagacacctgggtccatacggggaaaacctccgcacggaaaaatcaatttgaccacacagaaatatagtttatgtagtagtgtggttatattaatcagctatcgttgcatcggagtttgtggaaatagagaataaatgtatttggaggacataaagagaaataattgcattgaaatttgataaaatatggatattttagttcttttttatgtgttgatatgtgtgcgatggatgaaaaataaatatatttttatggcccctttgaatcaaacgatttttggagaaattttataggtatttgaccctttcatacaaaggattagagctttttaaatcatatgaaattccatggaatgactcattgcacatagattttgaaaaaacacttagcaagaactcaaaactcttagaaaattttctttgattttatctctctcatcagattcctttgttttttatgtgattcaatcaaacagtcacttatgtatgttttacattttcattcctatcgtaatccagtattttttttctattctttttttttctttttgcgattcaaaggagaccttagggcatgttgatccaaccctaaaattttacgccctgtcacatcaaacatttaaacacctacatgaagtattaaatataggcttagaaagaactaattgcatagattgggactacttggcgagacgaatcttttaagcataattgctccatgatttgataatgtagtgctacagtaaactatggtaatgacggattaattaggattaataaactggtctcgcagtttactagtggatactataattagttttttattagtatctaaacaccctatatgacaccatatataataattgatgtaacactaaaattttacacgtagacacccctttagcatactacaaatcggtagaacaacacgtgagctgagtagtacgagtaatcgagatcaggttgtgatgtgaccgaccaaacaggacgacgtgtatactgttgcagtagtacattgcattggaggcagattaacttgtccacgtggcgaccggctggcaaaatttgggctttcttggcagaggagaggagcagtagcagctttgcaaattgccattgtctcgtgttgctcctctctgcagctggttcagttggtgctgtgtgcctgtgcaaaatgaaaatgcagacgagacgacttcaccaacgcgagaacgaaaatgcagacgactccaatccaccaacaagacaacggtttctatgaaatcgtagcgtttttgcctgtatttctattccctctacttctctactgacaatgttggatttgatattaaaacatcgattttgctatatctcactcgaaagattttttcttatctctcactcgattttctcactcaaatttacagtgtgttttcttgtaagttacaatataatttatgaaatttgcacggtaacttttgtaagttacagtgtaatttttgaatcttcgcatataagttttgaaatttatattggatttggtctttttttttctgaagatatggtaatatagtatccattatggtgtttcttagttgttttttgcatttttactgtgtctattggattttaatctaaggattaaaaatctgtgtgatatgattataaaaatctttcaaaagatacatagacactcccttaaaacatgccattctaattttctcggttataaatatacgctacacctgttgggccgtgcagcccacttgagtaagcctgggccgatggcaccatcgttcgttggaataagttcatctgacgtcctttaacttgtcaacaaatccgattttcaccttcaagatacgattggtccctcaattgtcaaaaccggtgtaatatagatctcaaggtggtttggatgacggttttaattgacgtgacacctaagtggctaatttgactcggtcttcatctgacatggcatatgaagcaaaaatttaacaattttaaaaaataaaacaaaatatatagacctacatgtcagtcaaataataagattaaaaaataatggaacccacatgttagtggcccccacttcctccacctcatcctttccccctctcttcctcttctaggcttccatcctccatccttcggtgctcccacagcgacgacatcccacgacagcggcgtcgaagtgggtgaccgttggccacctatggcttgcgggctcaagaacgtcagcggtggtaagaggaatagggagaggaggacggcgagcgcactgagcggtggaagaggaggggtgtgcagcagtcggcgggagtgaagcggatgctttccttttcctctagatctccgccccctctgctccggctccaccgccgtcgaccaacgcttatgcgcggaggaggaccgaccgcccgcgctgtcccttgctcctgcctcatctcccatagcctccatcctcaccacgcggaggaaatacggaggcggtcacctgcttcgacaacgacgccgcaagcgatgggcccccgccgactacttgtgcgactcctgggccagctgcgtgagctgtgccttagctttcactacaccacaagcacatgctctgataactaccacagaggccgcggacaacaacccagtcgctttccttcttaccccgttctcctcctgcacccaatagatctgccaggtcactaggagtgtagtgtggtagccctagaggcatgacgtccgatggaagagaagaggggcggtggccataggggagaagggcggcgaccggcgggaaggagctaagcaacggccgcgacgtcaccgagttcgaccgccgcagggaagtctagggacctccgctcctacatcgccgtcgtgcctcctaagctcccaccgtgggtaggctaagcactgaacccacagcaagtcagcaaccacgcggatttgggtcccctcccgatgatgatggatccgatagccagtcaccgctagatcccctcccgccgcgtctcctcctgctgttgctagtcgttgagttctccttttcgaaggccgacatgaccattccctccctctacatagttgcttccttcgccccgtaggcggtggtctccattacgatggaagaggagcaagccggcggcgacctcgtctccctttgagcggcgccagtgaagccgcccgcctccgttctccctctccgcgtgtgctcaccggtcgacgaggaagctcgaggagagaggaaggatggctgggaggaggcaccgacactgccgtccgtggaggcgatgagccggtgacaggagaggacggtgggatccactgatacgtgggtccacctatttcttttatcttttatctaactgatatgtaggccctacatgttttttaatttttaatttttatatgttgcttttagtgcctcatcactaccacagagaacaaggacaaattagccacatatagacctcgtttgctttgtaagttggaggactagttgtatctggtttttgggtggaaggacgaaaatctaggcaacaaattggacgaccacaagtgaacttattcctttcaattttaagttctatggttacaaagcccatctgcaaactgtgcaatttgactgatagaaactcatttgccatcaacacaggacacaaggtagcattcggcaacccaggttaacagaccttgatttctccatatcattacagctcacagcaagaaatacgatgtcaaaaagagccgaataattcacttaatcaatgaccacaacaaaaggcccgagtgaagaacaagaccaataaaccttgtgccagcgaactaagagcaggaaagctgattaagagccaatttatagggacactgagatggtatgttgatcaaagccaagtcacagtaaacgcagcaatgtaatgtaacaggggggcatatgtcaaaatgctcaaaaaacttttttttctagcagatcaatccatattctgcgaatagcgacaaggagatgcgctaaggggtacaaaaattgatagtgggcggagaacttaaggcagctaaggtggtatgtcaattcaacaccattgcttacttcttcttgcctgcatctccagcctttgtctgcaaaatcgacacaagcaagcagtttagttacatgtagttagcaatgcggtttataactcttataataatagaacttggcggtcaggtaagtatatagaccttcttcacaccacggatcttctttgctctgttcttcctctccttcatctgcttgcgagacttctcaaccttggtggcgaggccattctgtaggtatggcagcaaaaagaaaatgagaaagacaaaatacataaaacatgggctttcatagtgtttcacgagttaaattgatatgcatcatggaaaagttgaattccaaaacccatgaaagtaattaataggtacacctgccacctgaagctttaggcaatgaaactcattaagtttggcagcatgcagtaatgcataaggctagtgaaacagctcggaatcaagcactacatgcaacagtatattatgcatgtcaaaagatgagtattcaagcatgatttaaccaatttttcatgttataagttctgtaatcatcatgcagattagtagaaaccaccacatattgcagtaattcctagaataagatgggaagtcaaacccacaccaagcttcagcagtacatgttttacacactacccaatacaatcgcgctaacattctgaacataaaagtcatagtttgctaacaaaggcaacgatgctagtaaaatacatcatttatacgcataagaatgtgattcattacttccaaaccacattttacaagaaatggtgctctactgatcaacataaaaaaaaacaccgatcaacaagaaccaacaatactatatttttcaaaatggtaatcccaagtgaaatttactcctttttcccatcagacaactactctagtagtactagattgttcagatttcagcatagcatcacgattaaactaaactatcaagagcagggcgagatcaacgagacaagagaggcgcgtaccctgatgagcctgtacttgggctcgtacttcttggcggcgtcgaggttgtcgtagatgagtccgaatccggtggacttgcctcctccgaagtgggtgcggaacttgaacacgaagatgcagttggagtccttcacctcgtacagcttcgccagcttctccttcagatccgcctgcacacacgcacacgcacacgcacgcatgagcctcacgccggcggcgggaaaccctagcccggacggtcaccggaggaggaggaggacgcgacgcaccttggagacgttggcgcggcccgggtggagcacctcgagcacgaactgcttgcgggagaggaggcggttcgtcatgaacttgcgggtgcggagcgtcaccgccggcgccgtcttcgtgtcggccatgcttgcgtcggtggtgtcctcgccggagattcctcgctgcggcggcggcggcggcggcggcgagagaggagcggcgagcggtggcggcggcgagggagacgcgggttggggtggtgggggcttatatataccaccccgaacaaaccctaggtctggcttgggccgcttggtagaatgggaatattgggccgattataatgggcctgaagagacacataggcccttttgttattgggcctctcagctaccggtccgatcatatctaccagtcaaacctggcacgtgcagatgagcacagcatagtatacagctactgagctacctaaccaaatttccttttttttagaagtaacctaatttcttgcacatcacatgtagcagtagctagtagggccgagtttagttctaaatttttttcaacaaactttcaatttcttcatcacatcaaaacttttttacgcacacaaacttttaactttttcgtcacatcgttccaattctaatcaaacttttaattttggcgttaactgaacacattctacctagcttgctctaaactgaagtgaagcgtaactcaggtatatatagctgctgctgctacttgaacattagctaaatccgattgatcatttcagtggcttaatttagtatatggttttagttagtagaaaattaagcgaaatcgcgatcgatgtgcccggcggtgacgggggcgacgctgttcgcggtgggggtgatgctgtgcccgttcccggcgctggtgccgtcgtgccggaacctcaccgccgtgctgccggagctatgggacctcctcgccgccgtctacttccacatccgcgacgagctccaccagctgctcgtccgccgatcgccgccgcacgacgacggatgatatacatgatgatttgatccatgacaaattcgagatcgatcgattcttccatatgcatatgttagatatattcgcgctaattaagttccctttttccttcgaattgatcgtgtgggtcatgcatgtgtgtgtgtgataaatagctcactcttgggtccttggatccggattgattgatgttttgaatttcttgtggagaaattggtaagctagctaacttgtttttggctagcttgtttggatgaataatatatactccctccgtattttaatgtatgacgccgttgacttttcgaccaacgtttgaccatttgttttattcgaaatttttatgcaaatatgaaaatatttatgtcatgcttaaagaacatttgatgacgaatcaagtcataataaaataaatgataattacataaattttctgaataagacgaatggtcaaatgttggacaaaaaaatcaacggcgtcatatattaaaatatggagatagtatttgattgggttatgtatgatgatcatctcactcgtaccgttggtcacgcgagtgcacgagtgcagctaccaatactgcaggttttgtttcattaattgttgaatgcttttacgtcctgattgtttcagcttaagattattataatctatattattaaattagattactttaagctgaattataataagctaatataaaataagctgcgagttgtttgtttctccggattattgaaggcatctaagggtagtgcgtcattaaccaccaataatatgaaaaaagcttctccaaaggagattattagattatagtaatctggcttacaaattataataatctatcataataatctacttgtttgtttcagcttactcataataatttagattataataattttaaactgaatcaaataggaccttagccttggttgcatctatctattgagtgattgagttatctggatcatatgatatgctatttggttagtttccgatggatgcggataaaaatatggatatccaaactttgttgctacactgctatccacagaacacaaaatgtacatcatcccgcttgtaggcctagttctatagcaaactttctcattttcttaaagagaaattgtatggttcttgaaaaaaatatctcaagataactaaattttacatttatattgttggtaccttgagataataaattttacagtagaaaatctatacctccgttaccttctgaagaaatagtaaaattacccttctttaatggtgctttagcctacaacactagcgcatgctgttaatattatttcaacttgcaaatagcaatctaaattaataggcatgtatttatgtcgcttcgttaatttcacatgtatttatacttgttatatcgatcgtatgtgttgaattcaatcggcatcatttagcctattatctaatggtttatttgaaattagctaggttttcatgtttcaagaaatatttatttccatacttgtgtccaatattaaatatttatttgtattcaaataatatgtatttatttcagttattcatattcatttttgtctttaattaaaaatataagggttaattagatccacgccgctgtaactttttttttataaaatgcaattactatttgtctatttggagacatgtcattacaatttgaccgaaattacagatataccactatgtacatcttcaatgcaattataaaatatttggatcgaaattacagatatgccactgaaaatatgtcgattcagataaataccactgtaattcgtcgattcagataaattcatcttcttcctccatcttctccctccctttttttctcatctctctccaccacctcaacggaggggactaggtgggcatggccgccatggcgaggtccagggccccctcgttgtcgacatggactaggcggtgctgccatcatgtggtcacggcttggcggcctggatccgcacccctgtggccgcggcggcggcatagccaggcccagcaggtgatcccgagcagcagcgacgctagcaaaggtgcccccggtgagccctagcattgacaatagtgaccctagccgcggcaacgctagcgacgacgccggcgaagtccctgcattgcccgctgaggagacggccgccacacgtccagatctgctcctccccacgccaccagacgtaccgccgctccttgaccgcttgttattccgccagccgccaccgctgggaacattccgtggcgagatatgagaaaaaaacgaagagggggaaaatggaggaagaagatgaatctgacatgtgggtcccacgtgcagatgaggaagaagatggagatggatggaaaaagtgacggcattggcatgattccaattttgtaaaatttcaatggcacgactatgaataaacgaattgttatggcatttatctgaatcgacatatttacaatgtcatggattcaattaaccctaacaagaattggagctttttgcaacgatttgtgctgcggcaccatggacgaatggatgatgagtggagaacagagggagcgtccgtccggtaggctggatgggaatcgccggatcggaccagtgtaagagatgacagagattagtgagtggaaggaggaagaaggggtgaataaggaaggaggaggggtaatctggtccaattctgttttataattgcattgaagggatatgaagtgtacttgtatattttcaattttgaccaaattacaatgacatggctctaaatagacgaatagtacgtaacggtatttttttaaaatcgaaggagttataatagcttgatccaattacccagaatataaaaacaaatacggagcgagcattattcatttgtatccacactgttttaataggcttctggggaaacaaaaacttgccaggtctgctggaaagtgttgtgtattatgtaaagtttttttttcttttttttacaagtagtgttatgtgaagttcaaaatcccagcccacacgagccgagattgaggcccatgaagacacggcctgaaggtgacttgctcagattgttaggccctaaagtcagccaataggcagttggatgctgttatacttcataagtaggaaaaagtacaccgaaggtctcatccccacctgcaaaaccagatatctgatgtcttttaactaatcaaaaccggtcacaataggttctttggtggttttgaccccggatttatcctacatggaggatgagtcagcgtgggatccacatgagccacacatgtcaggatgccacgtcatctttctcccttcctcctactcctccttcccctactctttctctcac

SEQ ID NO: 51267 - DNA, 2087 bp, Oryza sativa
tctgggtagtggtgggggtgcgactgctcctcattctctcccgctcgcgcgctcaagccgctggccaccgccacgtccgccgcggcggccgcgctcaagaccctgcgtgtgctagccgccgcctcgtccccgctcgtcgtagtcatcgcgacgtccaaggcgacctccaagtcctacaaggcggcatgcacactcagtctcgccacatgcctcccttccctcccttccgacaagtgcctgaaggccgcctttgccgccgccacgtcgcttctctgcctcacggccggcgcgccgcccccctccccccgtcgcttcccccaccgatgtcgcggccctcgtattcctcaagtctgggtacaagctgtccaagaacacgacggcgacgacgaagacataggtggatacagccgtggcgacgacgacagggaggatgcggcggcgacgacacgggagaagggaggcgacggcagctacgacgcttgagaaaggaggtggtggctaaggcatcccgtgcgacctcgtggtcggaccgtctgagtggcccgggaggcgtcggcggcggcggcgcgggcgagctcgaggatgaagatcccgcgcggcgacgaggtgagcgaccttgacggcatcacacctgctgtcgatgacccctacctccccgtcgacgcccgcgcacggccgctgcacgcctgcaccgttctcgcctcgctatcgcctccccgggcccatctttggccaccgcggagctccgccgggaggccgccgtgctttctcactgcggccgctatcgccgccgtcgcggcgctgccctcctctcccgcctcgccccgccgaccggcctacaggtagagagagataggaggaaccgaggaagaaaagagggaggagagagatgatgtggcagcctgacatgtgggcccatgtgggtcccacactgactcagccgccacgtaagataaaaccagggtcaaaaccactgaaggacctattgtgatcggttttgattagttaagggacgctggatatctggttttatggttgggggacaattttgtaactcaatgataagttgagggaccttcggtgtacttattcctcataagtatttgctccacgcgctttgcattacgagtccatgttagtgttagactttagaatttgttgggctggccatgtaaattccatatctcttctggaccaaaaacctgctcgcctaggcccactgctcgcgcctaggcccagtgtaattgcattgggaaattgaaaagatttttttaaaaaaaggaagaataaagcgcttgaagtcactcgcactaaataaattatcatctaatgaattgaaagaaatagcgtcaaacaacactacaagttggaaactggcctggccaaattggctatgtgtggtcgtgcatccagttcaactgagattccaattaattctagagtcgatatagtgttcaccagtttttgaaaaatatacacatgtgtgtgcgtccaatgaattcatgtgtaccacattttgagaatttgtttgggcaatttgaaacatcggaaactaaattgatactagagcaaaactctacgtaccgtatcggttattcacccttaatatacctacaggtacagaaacacgaatacttactctactataaaaaaattcacggaaattttagcagcaaattgcaaggtttgtgtaaatgtatgaaggaggatatatacaaaaccaaaactaggagcaagcaaaccgcaagatgagatatttttgggagaaaattaaaccacaagatgagatctgaaagtcgctagagtccaactatccataacagttggagacttgtatgcctcgccaaccttgtataaataagatgcaaggccatgtaaattccatttctcttcttgctttccatgaatatgctgctggtctcctcagaaattctccaacaatatatgatgacgaccgaggcaactctaaataaacctttgtaccaaataaaatgtcaaatcgtacttctaacattcgggtattcatcgagggtctaatttaagcttagaaatttcatctgctctctctgatcataaccatttaatgt

SEQ ID NO: 51268 - DNA, 4771 bp, Oryza sativa
tcctataaatatttatatcatgtacaaatttgaatcatgcaaatatttaaatttgggaccgaagggagtaaactagttgagtttggtctccatggctatcgatcattgatcatggtcgtgattttcctcttgtgatgcgtgccatttgatttggtccatgatccaggaaaatattgtttgtgatggaacaggtagcacatgttaagctgcagaagctgaactcatgcatgcttgcttaattacctgttgattaatttcagatcttgttatcttgtgctcccaagtctctgcttagcatcattttattgaattattgttcaaataggagcaggagatttggttcgtgagctggaaagatctcgaaggagttccagagggaaatgctgccactatttttcagtaactccagatcattgaattatttattgcagagacctgacgacaagatgacatatcttgtggccaatgtagatcttgatatggcctggccccctcattgtgttgttgttttcaaatcacaaatcactctctggtccattgattcttttatgggatccctgcaataatttcagaaaatgaaacttctgtctgcaggttttctttcctaggctaagcgcttcagttgcactgcactaggacagtgctcactgatcagtttttttcttcacttctactcctagctgaaatgcttgaacttgccttcacgatctcaatcataaaaccaaaaccttatacttccttaaaaacggagtcatccgctcatcccctttcacatctcacatggcgtgcaaccatatccccaaaaaactgaataaccacgcttttactctatcacgctaccaacccatttccaatcgtataggccattggcctataaaaataattattgttagataattaaagtttttattaaactcaatcgattacattaaggtaatacaatttttgtgatatctgcataactaagatgcacacaagcgaacacacaaaattaaccgcaatagtaatttaatgtccgcaacagtaatatacgggtatcttattagttatataaaagtataacagcttgctttcacaattctggaaactcttgtgaaaatatctcggatcaagaaagcccctgattggagcacgcacgttctttcttgagttttcagtttggactaatgacaaaagaatttggccgattatcctttcaatttggaggactgatgacagggaattttcggactgcggttttaattttggactaactagatgggtacctcgcgtattgttgcggaaaaattatgtgataatatagtagatattaggtctgttcggtagtgctgaactgtggttgtacagccgcagcgctgctgcttccctagtatctttcttgtggtgggactgtggctgctggctgcaaggcagccagctagtagcgctaccgaacacacccattacttctaaaattttctttcttacctactatataatttttctttcatgtgtttatatttttttacctttatcaattatacataggttataaatgattgggttgtatggtgtgtcttttggagggaataaatgaaatttataccttttatgaatcatccaaaaacttaaaaacagttgaggtgatgtgaagagatgtaatttacacccttgatgaatcatccaaaggctaaaaacaattgagatgatgtgattttatgagagaaaagagaattagcattaactatacttagtggggatgaactttatatatatatatatatatataggatgacaaagaggtttgctcattatggcttccttattagtattattgcaagggagaatcagttgacacagagttagctcgtatgagtaatcggcgtcagattttgacgtatgtttttctgccggtgtttggtcgtcatgtcagttaccaaattaaaaagcgtcagttgcttctggtgatgggaacacagcttatttctttcgtcagactgcacgctactacgcttctattagatttcttgttagttttgcattcggcagaatggctgttgctgaaccttttgcgttttgttgttgccgtcactatccgctttacagatattcatggagcgaaatttgaagctgttgtatgtatggccatctgaagaaaccatatgtcatttttttgttgatacctctgcctaaaaaatgcaaatattatcttagttattacctaccgtcaatacaactaatgcaaaagccatgatatcataacaagatgttgtcatctgatcggagtttatcatttttgacatcttcatctcagctcgtattattatttaccccgtctttttttttcaagaaatggacacatagattaacggaaacgcttcccgagctcttaagggtgattactagagtaaatttcattaaatcccacctatttatgcatcaagttgcacgaaatgttaggtattttggcacttgacatataacctagctttatgattctaaagttttagaaaaccacacggtaaccattttgatatattcctatattaaaatagaaaaaagaatggatgtagcatttataggatggataaagtgctaataaatttgagaaatttgagaagtgattgtaactgtaaagtacggtatatcaaagttaaaataattattaatgtggttttgtgaaatgttatgaccttaatatctaagcttacgtgtcgcataccaaatttcctgtggatttgtgaaacttaaataatggatgtgattttatgaaatttactatggattttaaaactttctatatatgcgcagaatattgtttaaatttatttttcaactttataatagtcaattcactcatacgtacccttaataattattataaaataaggtcaccatatcaccaaacaccaagaatttagtgagaccagatatttttcatccgtccccatatttttgagcgtgtataaagtgaaacaaactgacagatgtttatgtgtacgtcgaaatccatgagaaaacatatgaaaggtttgaccgaaaacagcaccgtcatttattttttgttctcctggggttgtaataacatcgtgattctttctttcaaaccaaaccgtactaaaatagccaccgatttcgtcattctttctgaccaaagagagtttaaaaacccataaatttcactatggtcccaagagatttaattagcgaggaccatggtctgttctatactactattttgaaaccttgccacgttgtgacgatctggaagcacaacttctcttcccctgtcattcggctccacgatccaagatctccgaaaatttgacatttttactctttctaaaaacttatttaaaatgtatttcctgaaaaaacttcaacaataaatgaacctcaacccaattaccaattacacaaactataaaagaagttgaaatgaacgtaactcaactggttagatttcttatggtgaaactagcccatccaaattcaaattatagatttaacacgtgcttgcatttatgactattttcttttagtgctagttaacgtatttgtcgatagcaagatgtccgtgattgcttcatcaatctcaagatatactcttttggagatacttatatagataaattacatgcgtatatgtttatagggatgaggttttgcgcgctgtgaacgttacatttgtagcaatgtttctggaaaaacaatggaataagatttggccggattcgaggggattccatcagctcacatgcactgttgccacgagagcgaatcctgaccgtccaatccggtggcgttggtggctagaaaattagctccgcagggcgtcttcgaggcggcagcggcagcagcagcttgcctgagctgacagatgcatgtctgagtatttgagtattggcgtttatgtgtgtacctatttcacgtaatccttccgtcgtaaagattgggctacatatctcatcgtagtaccgaggttgagttttttttaacgggaggagtaatcacgaggaaaaaaggtttgatctaaaacaacaccgccatttttagcgattattagcgctttcaacgcgtgtacactcatctctacaaaaaatacgcctatctctataggcataatttgtacctgcatatcataaaaaataattacccataagactaaaagaaacccataaatttcacaatggtccgaagacatttaggctcagtggaagaaacggctgggttaggaactaatttctcacgaacacacaacagaatgacttattaacgaatgattaattaagtattagctattttttttaaaaaaaactaatatagttttaaaacaactttcatgtaattttatttttaagaaaacatattgtttaacagtttagaacgagacagccttattactgtacaatgtaaggaccctggtctgttgtacagtatattgtaatcttgccaagttgtaacgatctggaagcacacactcttctctcttccccgtatcatccggctccacgagacaaccaacaagaccaaaaactttttttttttgggggaaaacaagaccagaaacttgatgagaaggcaaaaataaacccagaaaaaaaaacaaagggaaagatttggccgagttcgagtggattccatcagctcacatgcgctgttgcccgccccacgagagccaatcctgaccgtccaatccgcggcgtcgctagctagaaaattagcggcgcgtcgtcgaggccgcggcagcagcagcagcttgcctgagctgagctgacagatcagtcgtggg

SEQ ID NO: 51269 - DNA, 5362 bp, Oryza sativa
gacaaggcgggatcttgcggcgccttcctccaggggatctcgctcgccgcggccgcgcctcgctcgtctcgtcgcccaagaggtggaagaagaggtgggattttactcttttttcttttatcttcgtgggtggctctgggcgtagcgggtgggcactaattaaccaaagattagtgtagtaatcaccgggtgtttagtttactgccgccgctgcgtctgtctgtccgtatgtgcgcgtgtgaggctcgcatccatgtggcatctgggcagcggcagctgcagcttctcctccccactgagcccttttgtcctcactcgcaggtggcccttgccctttctctcttcttcttcttcttctctgctgctgctgctgctgctgctgcatacttccagcatccagggagtggctgcctcctggctttccatttgagccgccttcgattctgatctgggaccgaggagcaccccgcttccttccttcctcggttcttggccgtttctttggtcttctttgggaggtgcggtgatggagttctgcaagaattttgggagtcctgtgtttgttgttattgtgattgctggttcgggtgtgttcatttcttgctgctgatttcttggatgcagggatcggagaggggtgaagatgtcgggtgctgctctcgtcgcaatcgcggcctccatcggcaacctgctgcagggatgggacaatgccaccattgcaggtaaaaaggttttacttcccgtgtcgtgctagattggttatttggttgagagtttgtgagtactaggaaatatgaacagctgtcaattttttcttaattatcagtgttggtgtaccttctaaatttttcagattaatagactgctttagatcagatgtttgttgagtgctaattatggtcttctagtaacatgtctggtgttgttgtttgagtcctaagagcaattggcacaattgtttatcagcaaactggatcgcatgatattaatagtctcttaatttttctagatctgtactaatcttattgaagaaagagatgttctaatcataattgttagctattgtgttgtctgttgaatcattactgtttgccattctttgttctgaacacctgtaaagattgttctatccaacaagaaagtgtaaatgttaacaaggcacaattattaaacttcttcaggtgctgtactatacataaagaaggaattcaagctagaaagtgagcccactgtggaggggctaatcgtggccatgtcactgattggtgcaaccatcatcacaacattctcagggccggtatcagactggatcggccggcgccctatgctcattctctcttcaattctctacttcctcagcagcctcatcatgctatggtccccgaatgtctatgtgttactgctcgcacgccttatagatggattcggcatcggcttggctgtcacacttgtacctttgtacatctcagagacagctccttcagagatcaggggtttgctgaatacactgccacagttcagtgggtcaggagggatgttcttgtcctactgcatggtgtttgggatgtcactgttgccgtcacctgactggagaattatgcttggtgttctcgcaatcccttcgttgtttttcttcggattgacaatattctatctgccagaatcaccaagatggcttgtcagcaaagggcggatggctgaggcaaagaaggtattacaaaaattacgtgggagagaggatgtctcaggtatgttttgctgaaaattttgatgttcatttcacccatatttccagctgaccagtttaaaaacaatttctcccagattctaaactcatggttaatactagaaaacatgtgtggcattggtaactgttaatttcttgacacgaacttaacatatgcagaaatagtgtatttttgaaaaaaaagggtaaaagaaatcaaaatctattaagcgccttctatcggtgctcttttgaaaaagcttatgaatcttcaagtaaaaattactaagtacacataactacactaattcattttccatagaaggcagaacatggaatgtacaatcgttatctcaccaggtagagcccaaatgaggtgtcccaactttttgctgagtcctaatctggagaaaaataatcaggtgatctagatagacatcgccctcttttttttttttttggtaagggtaactctagaatttggggggtgggacctgctggtataatgtggatgtgggccgacccacgggtccttatctactctagtttaactaaatgaactatattttgcttttgagattttaaaagtgaaattaagtccatctagttgacctagagtgggtcaaggagccccacagcggccatgcctaacaacagtgattgttcagaaacgttagtaatgatttatccttaagttcatgctttcctcaaactaattacataatacatgtgtcaacatcaaaataggcatatgctgttagcaagtggtttctctattttctcctctacaacagactaaatggacagtattcggttggctgagagcataatattgctgttattttaagttcatcgaacttcgctgtaagctggttgtccccagctgcactatgctagctttctattaaagctgggcccttatatttctgttatttgtttctggcacaccattcatatttatattgctgctttattcatagttactacttatttatgccaatgtttataccaatgtccaaataaaatcatgtaatctacgtgaaaaaataaagttgcataatcattcaaattatcaaattgcgcaggagaaatggctcttcttgttgaaggtttggaggttggagctgacacttccattgaagagtacatcatcggaccggctatagagccagctgatgagcatgttgttgatggcgataaggaccaaataacactgtacgggcctgaagagggccaatcatggattgctcgaccttccaagggacccagcattcttggaagtgtgctttctcttacatctcgtcatggcagcatggtgaaccagagcgtgccacttatggatcctatagtcacgcttttcggcagtgtccatgagaacatgcctcatgctggaggaagcatgcggagtacattgtttcccaactttggtagtatgtttagtgtgacagatcagcaccccaaggttgatcaatgggatgaggagaaccttcatagggatgatgaggaatacgcgtctgatggtgctggaggtgactatgaagacaatgtccacagcccgttgctgtcccgacagaccacgagcgcagaagggaaggacattgcacaccatgctcatcgtggaagtgctctgagtatgagaagaagaagcctcttggaagagggtggcgaggcggtgagcagcactggcattggtgggggatggcagcttgcatggaaatggtcagagcgagaaggcgaggatggtaagaaggaaggaggatttaaaaggatctacttgcaccaagaggaagtgccaggatcaagaaggggctcagttatttcacttcctggtggaggggacgctcctgaaggcagcgaattcatacatgctgccgctttggtaagccaaccagcactttactccaaggatatcattgaacagcgtatgtccggtccagccatgattcatccatcagaggcagctgccaaaggttcaagctggaaagatttgtttgaacctggagtgaggcgtgcgttgttagtcggtgttggaattcaaatccttcaacaggtagagatgataccaatttcataattcttttttgtactgtccaacattgacggtgtttaagatttgtgtactattaagaattcactaattccttttatgttctttccttgtgcagtttgctggaataaatggggttctctattacactccacaaatacttgagcaagcgggggtggcagttctcctttccaatcttggcctcagttcagcatcagcttccatcttgatcagttctctgaccaccctactgatgcttcctagcattggtttagccatgagacttatggacatctctggaagaaggtactaacttgtttccttggtttgcatcatcttagtactaccaaatataccaaacaagaaatgcacccaagttagtattaattacatcatacattgtttcctttttaggtttctgcttctgggcacaattccagtcttgatagcatctctagttgtcttggttgtgtccaatgttatcgacctgggtacagtggcccacgccgcactctccacaatcagcgtcatcatctacttctgctgcttcgtcatgggattcggtccgatccccaacattctgtgtgcggagatcttccccactagggtccgcggcatctgcattgccatctgcgccctgacattctggattggtgatatcatagtcacctacagcctccctgtgatgctgaatgccatcggcctagcaggtgtctttggtatatacgcagttgtttgctcgattgccttcgtgttcgtcttcctcaaggtccccgagacgaagggcatgccgctcgaagtcatcaccgagttcttcgctgttggtgcaaagcaaatgcaggctacaaaggcctaattcttcagcaactctgctttcaatctttatataacactgtaaattggaatctgcaagatcacaccatgaggctggaggagctttttgagttgtaaatgagagaagaggattgctattcatgctccttatgcaagggaaaagagttcattactggcacagggcagctgtaaagtaggaaattttcatgttattcatgtccacttcttgtttatttagtactgtgttaggtaatgttgttattcatcagtagttgctgctagggatgttcaaaaataagcttgctaatctgattttgagctactatgttggggttcataataaagtaaattttctgtgtcaccttgcaagcttttgcactttgttgtaaattgtatggggaagtttatttattaatggtgccgctctaaaagcaactacagaaggctctctggtgtacaaccgatggtgattcttttgttcagattttatgtcatcacagttacaaggagtaaaaatgactgttggactatgaagaaacagtaaatattttaaaacactgatatttttgcagtgcatcaacaaattacaaaaaaggattggacttgtactccatttcattgtgaaaaaccatttcattcttcatactaaaaatatccacaaggttttctcattctttgatatcaatatagggcacaacatctagccagtgtaagcttactatttgcacaagaaaatcagatggcagcttgacttt

SEQ ID NO: 51270 - DNA, 6063 bp, Oryza sativa
atgcaactataggaattcaagtgaattcgtgtcagactatatcggtggtgtaataaattgataaactgccttaccatgttgtctcaggatttagctgattgtcaaagcaaaataaaatttttaaaaaggttttacccatctacagccaactttgacagaaaagttcagtatactgtcgatagcatactgtcgttgtaagcgtcaatagcttactggtttggggctttcccccaatccatctcgacagcatactgtcgttgtaagcttcaaaatgtaatgaaccccctcttctttcttaatgaaattggttgactgtatctttcggccgacccggcaaaagaaaagttcagtatatggtatccctgtttgattcatgtccacttattcagttcaggaggcaagctatctgtataactactgctgacagattaagatccattctaccatacatcattgccttaaaccatacttcacctgaagatctagctggggcaggatctcttggtttaggtcgcaagcttgatgactggccagctttcggcaatgtaagcttctggacacggttcaccgccctagtcctgcatgagaaatagcaagttacagataaccagtggaaataaatttcacattatacaaaacaagtttttttagataatgacattatacgaaacaagtatgcaataaagatgtcaaattcagaaaaaaaaaagagttagctagtataagaacaagattggaattactcacaaccgctctttcgcagcagtgttggatgttttctcttgctcttgatctgctacattgcttactgaactatcagcttctgcacccatggaaataccatccgaagcatcgcttaaccttccatccgagtcgacatccgcaaggccagaaatctcaggatcaacggagagcatggacccagcttcagattgcctgtcactggtgtcggagaagttatcaagatcagaagctgccccactgccaacacttgtgcccttccctagggatgtaatgcccggggaagaggacgaatgcttcaatacggaatcagcttgtctcgttggcttcaatctggtgctactattgagtaattgaagcctgtcgatttcctcatccttctttgaaatggtatctttcagaagtgaaagctgcaaggagaacattacaaaacaatagatgtaacagtatttttcatggtgaattactattccattgcttacatcacataatgttttgacattcccgaacaatattcttaaccttttgccatttcaatactgagaccattatgtcaagagaagtcagaagtgacttgatgattattgagaaatttggttacctgatccattaattctttgacatcttttccctccttcccctccttattgctcctagcaacaccaagttccaccccagacactcgttccgcaaatttcagagtacttaaagtctctgtgtaagatgaaacatctgggttgacctgcacaaacattagggtttttgcatgcccacctgcatatcaaactatgcatgtcaatacaactccgtgtatggcatgtaaaatagttctcaagtgaagcagaatacccagtgaagtctgcaggacttgtgtgagcttgctatttctgtatggtacatgagcattcttttgtgataaagaaaatataacatccccaagagcagccaaagacttgttgatgtgctgtgcttctttgagcctgtcccctgtaactgcagagcggtccaccctctcacttccagcaaggtccacaagatgtagagcgccacgcaaagtgtttccagtcttcagatcttggcctcggacatgaatggtcacaacgctgcaaaaaaaatatgatctctagtaagaagggttagtcctacgacaaaaaaagaaaagagaaaaggcaagtaaattacctgtgagacctgctactcctctcattcaaagctgttgcactcatggctctattgtcatgccctgtttgcattagctcgattacatgagaagttgaggtgacaggacacattgttgcatcaggaacagcaagtccattgggttggatggtgttctggatccctagtgtgttggaagttaagaaaaaggaggatatttcttcacatcaattcagtctgcaaaaatcaatgtatggaacttctcaagcaagatgatcgcactagaatctgatgaaggatggccatcgtgtgtgtacacaataaaaaactgcaaattttattgcagatttaaattctatttggtgaaaggctacactaatgcaagtctgggggaaaaggatatttcttctgcacgccaccactgccaaggagatcacggatttgctcattgtagatctcaatcatctgaacaccaagttcgtaagtgattgtgtctctacggtcatgagaaatattgaaaaggtcatttaatgccctataattgactccccattccttctcagttgccttttcaggtcccatctgagaaattgatagaaacagatcgttgtaaacacatagtgactgtagagaaatcttctggcacgcaaactgaaataaacagaccaaatgtttttgccctgagcttcagcgtaccatagtgtatgtttttcctgatccagtttgcccatatgcgaaaatgcagacattgtagccatcaagaactgatctaattagtggctgtatgtccttgaagacagcatctattaacaaaataagagggataagagaattgatgtatatgacatacactattatgggatataattttttgaaggatttgttgaactaatttgatgcaatagcttcaatggaaacccaacagaagattaagttgtactgaccacttatcatgtaccttgtgtagtgatagggccaaaaactttgttaaatgtgaaatttttgcccccttccttcccttgttttgtagggtttgatagaactagttcaccattgtccccaatatattcaactgaactggacttgtcatcctccccaggtcgaaaaggtcttatccgacaatatactctgatgtttcctgctcagaaatactatgccaaggtgatatcttttgacctagataaccagacaaaatggactgatgattgtagttcacatgtaccttttagttcctggatctcattgaacaattttctgttttctgcaagagctccatgatacttttctgcagtatttgttaccaccttaaggctttttcctgttgaagattgcaactggtaatgttagttgcaatccatcgatgagaaaagaagtatttgtatatgaaacccacaagtaatcacaaggttaattcttaccaaggccagctagttcttcagaccacttgttttgacaatttaagatttcatgcctaacggaaacagaagatagcttcaaatcctgatgaaacacaacacttttgactaactgcagaatttaagaactccgtaaaatttgaaaaggaagaacaaaaggaagttatttttctaatacctgaacattctgtacttgcaaacttacaaattgatcgatcaccacttctttctttttccagaattggattctagtttcggataattcctcaagttctattcttctcttggtagaatcgtctaacataagctttacttcttctatcctctgttccaactccttacttacttgtgcagccttagtctctaattgctgactgtgtgcctcatgcaatctctttgtttcttcaagctctttcttgagttctgaaattatactgtcattgttttccttgtctgtgagaagcctggccacatcttccttcttagattctaacaacctgcagctctcctcgtatgatgatcttaatgtttccgattccttcttaagtttcaaaatggtattgttaccatcttctttctccttcatcaacctcattatctcagccttatccttaattgaccttgctgcatcttcatccgcgattttcttcaattcagccttattttccttctccttgatagacatgaacatgtcttccttctgcttcatcaaactaattatatcttccttttcttcaagcaacttaattatctcttccttctcctttgttaacctaactactatatcatctttctccttaattatctcttccttctcctttgttaacctaactactatatcatctttctccttaatcagcctgtctttattgtcatctgccatttgctttctgtcctcatcctcaccttttcccaagttaaccatatcttccttctccttcataagtataattatatcttccttttcttcaagcaacttaattatctcttccttctcctttgtcaacctaaacactatatcatctttctccttaatcaatttgtctttaatgtcatctgtcatttgctttctatcctcaacctcccctttttccaagtaaaccatatcttccttctccttcataagtctaattatatcttccttctcctttagtaacctaaccatctcttccttctcctctgtcaacctaagcacaacatcattcttctccttaatcaacctgtctttattgtcatctgtcattttagttgtaccctcaacttcacctttttccaagttaagcaaatcttccttctccttcattagtctaactacatcatccttctccttcaacaaccgaatcatttcttccccttccctcaccaatctatctaaagcatcatccttctccttaattatcctatatttatcttcatcttctattcgttgtgtttcttcagctttgactgttttcaagttaatcatgccttctttctccttcagcaatctaaccatatcttctttctcctttagcaacctaaccatatcttccttctctctcagcaacctcaccaaatcctcattttctttcatcaatctaacaacatcatcctggtacttcattaacctttccatatcttccactgctagttgccctttatctccaaacttgtctttctccatctgcataataagagtaaatcaaaattatctattgcttctcaagaactaatgatttaaagacctgtcatcttttacagagtgaacaagaatcccagtcattctgttgacatatcaatctcagagaaaaataagacaaagggaattgtatcagcattgccatttgtctgccattttatctttttaatatttattaattaatggtgacaggaggatcttcaaaacctcatttaggccaggtgaatacttcacttgaagtacacaaaattcttgcaacaacccaaagtcaagatagatggctcagagaagttgctggagtttacatgtgtttgcccacttaccccaccagctaacacctctagcactcttatccttgactgatacttctcttcgcgagctttaatcaggttattttgctgcagacaagtaagaaatcacaaaggactaatctggtataagaacacatatagaaaatatttatcttacgttccgtatatgcccagcctgggtggaaatgcgcctctcaatctctagtatgaccttcctcagcaagcaagcaatgcgctacaatgaaacatttacattcatttgtacaagggaaggtgttaaaaacatgaaatcacttaaatttggaaagaacaaactaactgcatttcttttctgagaagcctacataaggtatttgtccattcttcctctcaatgctctcatcaaggatgctgttgaaaacacccagaagtgactgcgtaggtgcattctgcaacaagccagcattgggtgacaatgtaaaaacttttctaaagtaaaacatggtatctcattactagtagggataattagatgcacttacatccaagctagtggatttcagcaagtctgaatatttgccaccgagctgatcagcatatcctccttgcttgagctgaaatacctgcaacggcgaatacggatcggatcctaacacagggctggatggctctgaatacaagcaaaagacaagaagatgtctctctctcagccagcaattggatgattcaccatcacaaaatcagttgcaattgtcagtttgtccactccaggtatacctga

SEQ ID NO: 51271 - DNA, 838 bp, Oryza sativa
attttaataatatgtcgaactgcgggagttcgacaccccagcctatcgaacaggggctattcgacaggccctgtcgaactgcagccgttcgatctcctttccagtcgcgctccggctcttcgatatctaccctatcgaactacagccgttcgacatggtcccaaattcgcgattttccccggttggccactacttttgcgattttccataaaaataatattaattctcaaaaaaattcacatgaaaccccatgccttgctgttagagttttatataatattaggagtaaagtccatcatcggtccctaaacttgtaccactgtgtcatcccggtccctaaactcacaaatcgaccgtccaggtcctcaaacttgttcgactgggtcatcccggcccctaaacttgctgatcactcgattaggtcctccaacttgttcagttgatgtcacctcggtccctaaacttggatttgaatatcatctgggtcaaataggacagtgtaaagactttagatttaaaaataattcataacttttttgtgtgaactctaatgaagacaaactttatatcaaatttgtagccctcgacgcgatctataactttgtagttgattttttttattttaagtcatttttgtcccaaaatgtaattttaaaattaaaatttcaaaatctatgaacatgcaccaatattttgggaccctaaacagttttaattcaaaagcttttcaactacaaagttgtagttgcgtcgagggctacaattttgatataaagtttgtcttcattagagttgatatgaaaaagttattaattattttttgatataaagtttttag

SEQ ID NO: 51272 - DNA, 5483 bp, Oryza sativa
taaatgacactttaaccccctcattcacatatataagagaaaaaaaatcgaatgcaatgaatttttttatagataatgcatcgtaatttatgtagaacgaaaataattatgtacttgcaagtgtatacgatagacattgcttaagtttgatgtgcacatgttaaaataatgggaagtatttctgcaatgttatttattcatcttggttttctcttttctagtgtatagttatatacaaattattggcaaaaaggatattttctaacagaaatattgactagaaatagccatatggcatattaagtgggcctaagaatgattttaagccaaaacaaatacttataggacctacgtggacaaaatgaaacctgaaggacctaattgaccttcggtgaaacttgagggattaaattagctattcacccatttaaatatatatggattaattgtttagaagaaaagactaagatgatgagactcaatgagagaaagagaaaaaggtatataaatcaattatccaaaaacaaaactaagttgatatgattttataagataaaaaaaggaaatgatataatttggacgatatatcaaacatccaagagttagaaataattgagatgatatggcttaatgagagaatagagaaataatattacctatacttaataagatgaattttatagatatataagaggcctgtgtgtctaattgtctatttcttccaatctgaaaataagttcaatataggctgtgtttacttcagcgcaaagtttgaattttagttaaaattaaaggtgacgtgactgaaaagttgcgtgtatatgatagattgatgtgatgaaaaagaactgaagtttggatgtaaactttgatctaaacacagccatattcacgagtaatatcaaagcgcatcaacgatcactttttacgagataaattacaacagctcgatgtgtggtgctctgctatgacatgacgttgacgtactcgttagcgctgtactccctttgtataaaaaaaacttaattcttaagtgtgtgtacaatgtttgaccgtctgttctatatgaaatttttttatgattagtatttttattattgttagatagtaaaatatgaataatactttatacataacttatctttttaaatttttttaaataagacggacggtcaaacaataaaaacagaaacccagaaattaagtgtttttgagacggagggagtagaggtgtaggttgtccgggcaacgcttgattggtgctcggcgatggcggctggctggattggttatgtcccttccttccccttctagcagaacagaggagcttatgtggtggctgcaaggagtgagaaggcgtggcactgtggcagtggttaggagcgcttagctccgttttatcttaagttttgaagcaagcaagaaaagctttaatcccagccttttaagtatttccttttcgcttgtttgttatttatgtcagttatgagattaggaaagtatgtactcgtgtaatctttggttatgtatatccacttgtgaatgttgtatatgctaaattcctatctattatttaaaaatacagtaatatcagagcattttccacataaaaacagtccagccgttgtactctttggaactgaggatccaccggaaaaaagattccatttgatttcttaagaaccaaaagacatgtggccctagtctcaattaaagattagctttcgttgtcgaagaccttgaccacttactttgcagtctcgagtgtttggctctttcctacaaagatgtgcacatgttaagaccattagcccaagtcttcggtcatctatgagctctgagggcatatccaatctcttctttctataaagctaatacctattaaacacataaaacttaacatacaagtataatatttattagcactcctaaaacttacatgcaagcatgtcacatcaacccattaattaatcacacaaaacccaatatgtaagtatatattagttatatttacattttagtctgcttcagtcacttcctctcaaccaatcggaaactcttcctcctctcgcgtcacctttccccgggtgacttgggaggcgacgccgccgccgccttcctccttctccctcctcctcccccgcctcgccaccgcctgagcgggcactggcaaagccgtgcggccgcaaggacagcggcggcggggccttctctcaccctccacgcgctcggcggccaggggcgctcctcggagcggcggcggcggcggtgtccatatccgggccgggcgcggtcggatcttgcggaggggtctctggcggcggggagtgaacgtggcgacggcggcacctggtagtggacgtggcggtgcggggtttggcggcgacggcggcggaggcccccagatccgccccaactcggcctgatctggatggcgattgccgaatggcggtcagcagcagctggcggcggcggtgttgactgctgtggtggcggatggcgacgaagcagtggctgtgatggcggcggcagcggctagcgacggcggctagtgacggcggtagtggcagacaacggtcaacttgtggcgtccgcggctatggaggccgggggtagcggaggccggcacggcgcgaggtggcgcgaccagtggcggtggaggtcggcttagcacggtgaggcgtggccggcggtgccgtaggcctgttacgacacggcgaggtgctgctggtggtggaggaggcgggcacggtgcgacaaggaggagctgccggtgggtgcggtgcggtctacgacgcacgaaggctggccggcagggggcgctgatgcagtggttccacgtgccagcagaagtttgatggtggtggagcatcggagcgccagctgtggactcgcaggtggtgattggcgggtgaaaacccagcccagtctcgaccaggccggcaacgatgacgttcgacgcgtcattcccctcctgaggacgttatcgtgacgtctcatccctcaagtgtggatgccgagcgaaagccctgtctcggttctctttgagaccttgacggatggggcggcggtgttttccatcgcttctcttcttgaaaacgtcgtttagacatcccctagcggaaacccccaagcaattgatgcaagctcgctctagatttcatcctcttatggcggcgtcctagacactataagttggtcacatcagagggcctaaggggagaagtgtttcattcttctctctcaccctctctctctaacttctgaagacttggatagagcggggtttgtgttgattgtaagggttgggttttgggcgatctcggctgtgttttgttgttggcctagcggcggtcggtcatgcttagcggcggccggttcggtgctagccttctcctggacctgtgtgttggcgttgccggtgtgtgggtggtggtatactttttttcttttcctggttacgactttccagggttgtaatcttgtaattttttttctgctctatcaataaactttgcaccgtcttttgcgagttgttcaaaaaaaatttacattttatgtcattctaaaactaaacatacatatgctaaattatcaatctcaaatcattttcataatatttcaatccaaatcatttcatcatttttgcaatatctaacatatattctgcagcaaagcgtagagcatcatctagtttatctatatctacatatcctatatagttgtatccaatagctcaatatgtattgagccgcatcatttagaaagaaaagtcatttgatcattttcatacttaatcacaaattcacaatcattcatttagtagttactattcctcgttaattagtatataagtcaacattagtgattcaattagtgtagaatattatcgctataaagaagttaggccatcaccatatttaacaccattgcatacactggtggagaaaccctttgtagtcccggttcgtaccccccccttagtcccggtttccaaaccgggagtaccaatccgggactaaagatcgctatctttagtcccgggtgaaataaccgggagtaaagatcgatctttagtcccggttggtgttaccaaccgggactaaagatagagctgaccttttttttttttgcatgcccctgttgctgcatggtttatatatatatatatatatatatatatatatatatatatatatatatatatatatatataaaccatgcatatatatgttatgcaaatgcatttgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgtaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctacaagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaag

SEQ ID NO: 51273 - DNA, 1225 bp, Oryza sativa
tcaacacgaccgaaagcatctttcaatttcaacttattcaaattacatgttgagcaatccaaaacatcaagaggttgttttaactttttagcagaattcatgttaaacatcaaactagcatgaaaagcaatttgatatttttgcaacaactttttagttaaaaaaaactcatccaaagtgcgtgtgtgcaaagcaaaactaaaagcaagagaagatctatttttcaaatcatgtgtagcattaacatctctaatttttgaaatctcattcattaaaacctcacaatttgagcaatcatcatcattaggaataagagattttaatctagcaatttcagatttaagagattcaatgataaattcctgttttctatacatcttctcacacttcttatttttttcactcaaaatattaatggcttcctcaaaagcacttacctcattatcttcatactctgtgtcagattcaccacgcgccatgaagcaaacatcggagatgttctttcccttatcatcatctccactttcaccatctacatcacttagtggctcgaaggcggcgcaaacttgttgaaaaggcttcctgagattgtccagcttcctcccttgggatgaacccttcagcttgttgttgttgttggtcttctcaccatctttgtcttctcttttgcctctcccaagcttaggacaatgcgaacgaagacgatcaattgaaccacattcaaagcaacgatttggaccacctcttttcctgttcctggcattattcatagctcgagcaattctgttagcaaccaaagccaaatcctcctcctcgatttgttcgagttgatcatcggatgtggcattaaaaacagcaagaaaagaagacttagatgaagaagcatcaacatccaaagaagaagaggaagaaaccaaagcactcgacttaaaatcaacttttcgagaaagaacattcatctcatgtgttttcaatttagtgtaaagcgaatccaaactcaaagtagacatgttaacagactcctgaatagatgtagctttcatctcccaaatagacatgtcaagaccattcaaaaagtgatgagaaatctcagattgtggataattagcattataagaagaatcaacagatctaagatcactcaaaattttattaaacctagaaagatagtcatccaaagcttctccaggtttcatctcaaatttaatgtactcctttttgaaaa

SEQ ID NO: 51274 - DNA, 2626 bp, Oryza sativa
gtatgccatatggaatgtccatcaaccacgtgcatcaactctagcctaagtatcccgcatgatctctgaccaccacggacgtcatcttatccccaagccgactcccggtccatcaccgcaaatactctcccgagacatcgagtcacctacacatgaaataaacaaagaaaccatattctgagaccaagctatctccaacttgactcattagtagcaaacaacagtattacatacgtataggatccatctagaaatcataatcatgaaataatcacggatatccaaacaaacaacctgaaaccgaaaccgacacagcgtcggccggtcagaccgtgggctggccggtctgaccgctcgatcaccgccggtctgactggcatacacaactcggtctgaccggtcacataaaatgatagaatcctacgatcacctgtgaatccaatcatctccaaaaccacttcgtgaataaattccaaataacaaaaccaatagtctccaatgcccaattgttcatcacagaataataatcaaaaacacctttgattttacaattattttatgtaaggaaatctccttgggagccttgctcaaatgtatgcaatgaagatccagattgttgaacctgtatcaatctactaatccaggaattgatacagttaaaacatgtcggttaccgaatcattagttttgggacccgacaggatttcgggccagatttagcccaaagagagggagaggattatttgtaggttgttttattttaataatctctgaaattggtttttgttgctttaatactatttagggtgctcgagggaccaatttagagcatgaaaaatttaagaaaaataatccaagccacattcgattttttttcttccctgtattttagtgtttgagatttcttttaagcttttaattatttatattattccctttagaaagtgattatatgattttatcaggacgttgcaaatccaatcccttacaagaatctcaccaccgagattcgaaagtgctagcaagaaggtaggtgtgggtgtcatcttcacttcttatgtagctttccctttcatctgaccaatctgataaaatcttccaagagaactgtttgattggtgagatttttcttcatggcatttctctagcaccaagttgacttcacaattttggaaaagttctgacgtcttcttgatctatccaagctaagcttatatctgagttgccggtacttagagacgccgctttcattatgaggttgttaactttggtacatacatctttaactgaaaacaatattttcttatgtcttgatgtcgatgtgatcttattgtagcttcgcattggctttcttatatttcaatgtttcctggccttgtgatgtggtatatttttagattagttgatgttgaagatgaaggttctatgtatcttggaaacaaatactcctcaagggaataactattcttgctgatttagtctggcatatttaccacctgtcttaaagattaccgccaactggcttgtggttgttgtgatctgtttatcttgtcggcctgatgcttcaccattggatctgtagcaaggagttcctctatattgtcgcatgtagattactttggagtagacacttaacatagcttgaaatggatacaactcgggttcaatatcttaacatacaaattaatgtctgctcttctctgtgggtctcaattatcggaatgcaccttatcctttcatataccccaaccttgatgtgactctttcattggatatatctgccagtgtgatatatggtatgatctactccctagttatcctttatcaatcacctttctgcctatccctttcttagatggtgtgaagcaaatcttctgtttcatcgcctttcaaagaaaacttgaaatggttcatcaaaagctatatcgaatgccttgtgaaaatgatagcactctgagtgggtttacaccactagggttttgatgcaacttacgaacttcactttcacttatcctgtcttactataaagttataacccactaactcctaaagcttaatatgcaaagaagccacatcatcatccactaataatcattaaatttaaatatcatgtaaacatgctataatatctataattttataatttattaaattttagagcttttaaaatgcaagcatgttaaatcatgatcccacataattcacataatatttcaatatatatcttcattattttttttatgatatttctctcttttcttattaagtcatatcacatcaattatttttagtgcttaaatgattaatctatggttcaaattatctctctacctttcttctcattaattcatatcacctcaattatttttagcctttagatgattaatctatggtccaaactatctcaatatttttctacttttataaagtcatatcaccttacctttacatttgaattatcattctatatactatttaaatttaaattatcatgaatcatgttaacataagtaatcttatgtgtctagctatcttacacattatttttattcatttttattcattgttagagagtcatgatggacggtcactaatacaaaaatgattttccatggcgtcaccctat

SEQ ID NO: 51275 - DNA, 1785 bp, Oryza sativa
tggagcaggggtctacgtaatacgacatcaaaacaaacaaaagacaaggattatactagttcaggccccttatcaggtaatagccctagtccagtttatatgggattgatgatgatgagaacaggttacaaagagagtaactgaaacaggcgataccggcaagatcatagttgagggatttgacgagatctcccggcgagttggctccgtggactccggcttcgtaaactttggtgggtgtgttggcgatgagatgcgatgccttttgcccctccctaggggtcccttttataccgtggaataccttcacccccaagcaagacttggagatatgtaaaccgacacgatatactaaagactttaccatttccgagtaggactttagcaattccttaactcgtagggatattttccataatttgaggcgaattcctaacagcatatcgagaaccaaccgtatacgcgaaggtataccttatcggtatattccataagtcgcaggatagagggtatgccttatccgtaaccctgacaggggcagcggcggcggcgccagctctcagcgtcaacgacgcagggaaaggggcggcggggagtggatccggcacctcctcctgcttccctctggcgacgacggcatagaggagggatggcggcttgcgcatgcggcagcggtgctcgagagaggcaaatccagcatcgacggaccttgggaggtggatccgccgccgccaggcctcgggagcggcgcggggatgcgggcggcgggggcggtggctctcagcgtcaactctcggctcagcggcacgggggagagggcgggagcggatccggcacctcctcccccctccccaccggcagcggcagcaaagaggagggatggcggcattaaggtggctagcgcaggcggcggtgtatatttgtgatgatgatgtattgttaatctgttctgctgatgatgccaatgttgatatttgtgatgctttgtatttggattgatgcttgaatgatgttcatatccattttcaattttttttggtaacttcctggatgagatggtagaaagggattttggggatttattttttttcctggaaaatcatttttagtggcggtaggcataatcttgccgcctgcagaagtctattttcgctggcggtccacttaattttgccaccaatagcggacgtcttagcgtggccaccagcgaaaatcgatttttactagcggtcggctacccatcagcacaaatgatgcattattttcattggcctttgatagctggcggtacagttggccgccagcgaaaacctattttggctgctagcaaaaattgtttttttaagtaatgggtggccctgacgatgaaaatggtggccccatggttagcaagctggttttggctggccaaagccaagatggcctggcatctggtttgtaagtctgttggagcctccccccggattgtcaaattttgacttgaagattgagatagtaattccattgcagatgctctaaataaatgttttgttgtctaagaccaaactcagtccagccactgagccagtgtaccaattgcaagagctcgtgaaagtttggaagaagtcaaaccttttttaactacggttttaggaggaacacagatcaacttttagaggctaggcatgttgacttgtttttagaagatgaacttgttgatttttggaaagcgcaatatttattctgttcctgttgatcacacgatgcaaagtttgttaacattgttttgtaaatcggtgcgatttg

SEQ ID NO: 51276 - DNA, 995 bp, Oryza sativa
tgaatagaattataagtctgcaaattagcctaatcccatcaggacggaatcaaaaaaatatatatttcctttaattttcacactttctcttaaatggttgtacctgtgcagttgcttttagcccaaatgctttgacaacaacagtgatattcggatttccagcccacttgatggaaggttccattataagttcttgctcatctgtggtgtaaaccttcatccctatatggaaagttacggaaatgcgatatcatctcatcatatacaaaaacacatcagtcagacacaataacatcatctaggtgcttaagagaaatatttagaattaggtagaattaggtaatgcagagcagagttatgtactctgaaattattgtgtatttcaggtaatgcggaactatcatagtggaaacatgctggtacagatagtaaaccttgaattcatatgtagcaccatatgttcatgcgcttgacttagcgagtagtaatgagataagttcatatagatactacaacacaatggcatatattcatacagagcttagtacttatcgtaaattttgtttcacaatggtaaatgaactgtcagatggcttgttggtttgcatctgatccgagggaggagagcaggaggtcatgattacccggctagcaccgtttgtttagattgctcacatgggaagcgttgggacatttcgcgttggggtctggcacatgagttcatggtcgacaactctgggataaattgggcctggtcatttggggctagcagaattccagatgaatacagtacactgaagcaacggttggtagaacagtgaaaccatttcaggcttcgtatatggctggttatactatttaccatttccaggtgattaggtcggtataaatcaaaacaagcgtcaattggtcaggaatctctgtgtcatttgcactcctatcatcacacgaccaatgtacaacttaagagtctacctggcagatttacaaaatca

SEQ ID NO: 51277 - DNA, 1113 bp, Oryza sativa
taataaatttatgcattctaccagatagtatgtacaagctgtccacttttattccatatgttctaacagaagttcaatttcaacggtgcaaattagtaaattccaaaaatacaatatggccgtcatttggccgtgcaagcataaaacagatattcaggttgtcctggaaccactccaagaataggttgtcctggaaccactggaggaaggaattactgtgatttttgtacttaggtgttttctgttggtcaagtcaattcctctgacccattgcaaaggacgaacaatattcaatctgaaacaggaagaaaagtagagcaccctgaccagctctttttttagaccaaaagcggaacccctgcttccatacaaagcaaataaaaaacaagagtactagagagaccttttgaggtcgctacaaaagggaaacaaagccgccacctccatttacagagaccttgaaattcaaaataaagtccttgaaattcaggagtactagcaacgaacatctgatttgctttggtacaaaataaagcccttgaaattcacctcatgcataacgaaaattcgtagattgcaaattcgtcttctcataaatcacatccaatcagatgattattcttcacatccacagtagagatgcagggctaattcgaaggatcccattagaacacaatcctactgttatacgatgaaagcaagctaactccagctaccctatacagcaagcccaaaccaaaggaaagaactaaacgatgagttttcaggaatgcatatcactgtatcatctcgtacagagaagcctcgaaaaccatcccgtttctcgcttccagctccactaattcaccccgatgccaaaccacaacgaggcatccaacgaaaagaagggtggcgaatcgtaccttgacgtcggtgggctggaagtagatgaagaggtagtacccaatcacaagccccatggtaactcccaccccaaacccgaagaaacccagcacagtgcggaaaaaccccatctcctccccaccaccgctcccccaacgcgagccgccgagaagagcaagaatccgaaagcgagcgcctcagatcacatgaagaggagacgtgaagcaagca

SEQ ID NO: 51278 - DNA, 1021 bp, Oryza sativa
attcctgcagccctttggattttcgagcacgatgtgtacgtttgtatgaagtgtgttttttaccacttgtgttttttatttttccaaacaccaaaacatttttgacgggtttgcccatgtgttcatcaaggaggagattgtaaaatcaaaggtgtttttgattattattctgtgatgaacaattgggcattggagatcattggttttgttatttggaatttattcacgaagtggttttggagatgattggattcacaggtgatcgtaggattctatcattttatgtgaccggtcaaaccgggctgtgtatgcctgtcagaccggcggtgatcgagcggtcggatcggccagcccacggtctgaccggccgacgctgtgtcggtttcggtttcgggttgtttatttggatatccgtgattatttcatgattatgacttctagatggatactatacgtatgtaatactgttgtttgctactaatgagtcaaattggatatagcttggtctcggaatatggtttctttatttatttcatgtgtaggtgactcgatgtctcgggagagtatttgcggtgatggaccgggagtcggcttgcggataagacgacgtccgtagtggtcagagatcatgcgggatacttaggctagagttgatgcacgtggttgatggacattccatatggcatacgatggaggtattgtgtgcgtatgggatgcagagtcgaatttggaaggagtccaaatttggtacgattggttatgtaaagttttcttgtactagagggtttcctaaggtgtttaggactcttagtatgagtttggttcgtggctttaggctgcctacctcgggtataaatagagggggaccgtgaggcttcccggtatcgctttaaagagcaattgaattgagttttgagttagggtttcgagtttagtcgaaatttttgtaaggagtactgttggtgcactttgtaaacacagagagaatccataaagtcgtcatctactttaagagttcttc

SEQ ID NO: 51279 - DNA, 2051 bp, Oryza sativa
tcaacaccgggcagaccggcggcatccactcggtcagacctgcagatcaatctcggtcagaccgacttccgtcgatttcgagggtaacttttatttccgctaaagttttcggtttttgggtataccaaccatttatccccctctagttggcttaattcttgtgattcgatcctacaataatcggcttttttttttgcttgagcgaaggtaaaggtgctggttctatttttcacatatataggtgccagctgcttgtaatggtgtagaccaatagataccggtgcacctgcgatggtttctgatagctagcgctgccttgacccgttgatctgaagcctgccccagtgttggtaattacgtatttttatatgttttatttgtaataacaataaaaagagcaaaattctgatcttacatgattcgggctgctctcagacttggcttgatttgtttgcttgggcctggcctgacattgaacaggcctagctaccactcccccgtccgcacggttttgctaaatgatagtgaaagcgacttgtaggtttgtcacgacctgatttttgttttaggatttataaattattattagaatttatattaaatattcattaatttacaagtgaagttaaatgtgagaaataaaattttctaaatataaatcatggatggatttaatttttattaaattctccacggttaattatactctctggaattttctcggatttttctgagctctattcctaattttaatcatacaaacaacattttagtaattatctacatattaaattaatcattaaatggtctgattataatcttgttaagtaccttgggtgtccaagtattttcaggatttttcttgaaattatttgagcattagaagtatttttaacaattcaaagatcatttcagtgattaatttaattggaaaagtaattaaaattcctcttttccttttcgggccgaaacaggaaaagtcctctctctttcttggcccaatctcctctcagcctgtagcccctccccctctttctgtcgaagtctgctttgtgtccctctttcaatcgggccaagaagtagaagcccagccggaagtctagttttcctccctgtcgctacagtggcatcttcaacctccagccggctggagacagagcccgatgccgccattgccgtcgattttctcctccacatccggccttatctctcgtgcattcctaaaattagttgaggggatttgtttcccttaaccttctctatcttttcccccaaaaatcccggtttatccctttgaattcgacgcgaatttggattcgttttcgagttgactgttgtgagacattaaccgtaccaaccacaagccagcgtgggcaatggctttaccttttgtatagcatgattcattgcggggtgccagactgagaagcggcgagaagtcggtgaggatcgctggggagtccatgcctctggttatatttatagagtgggtgattatgatctaggaatggtgcactgtggtgagttgtgttgtgcagagggtattgtcacagcctctattcgggtacttttcagtatcgcgacgcatggtagacatgatgttgaggctgtgtcttgtgggtacagtggtacacctctggccagagtaaaactattcgaatagccgtacccacggtcatgggcgggttgagcaatgtttttcgtgattagtcttatacctctcacaataattattgatgctataattggtaataatttgcttagctcctggtttggagttagatctgtgcagtcgggtttggttgttcagaatggttaggcctgagcagcatgggtgtgctgttcagtgttgattaaaattgatgattactctactgttttactattcttaaatatttgctaaatgctgcttttgcaaatgagcctatattatgccatcctttggtatccttgtacacttgcatatttgctgtgtggcttgttgagtatgtcatatgctcatttttgcaataatcaatcaacctcagttgaagaaaaatgatccagaagga

SEQ ID NO: 51280 - DNA, 1584 bp, Oryza sativa
accccacttattttatatgtcccactatagttgtgtgactagcttaccagagaatgatgtgggtttaatgttcatgcgaatgattgctctatgacattgcagaggatatagagtaatattgatacgccccgaccaagaccattcatacatagtgtgattgttgcgcatcaatgcaaggctaaagctatgcttaactccaaatcttattgtgttcatcacgaaaggctgctacttggcttgtacgattgtaggttacagcatattgttgtacttaaagagagagacttgactcggattaccaacactacaccaaggcatcgtaatcgtgcaccaccgttgctatcatatgaacgtaaaccatcaattggactagtgctaccatctcaaggaccgactacaccaagtcgtgtggttactcccatcactaagagatcatgccaagcatggatggagtactcaacatcattcaataaaaacacgacaaaaggttaattcgtttcttgctgaatttaactttagtattgatgtgaattttatactatctaaatggtgtatatttgatttgctaatgttcataccaaaggagatggacactactacaaatatcaacgactacatcaataccaataaagattacacagaagatgaagtgacatttgctcaagtggagatggtttacgacaacgagcagaccggttatgtgcagatgctataacttctaagggatgtgcgactcagccatcaaattcctccatgcataatatatatggttggaaagataatcaagtctagtttcacctccaacaaacggctagtcgtctcgacttcccatgagagagtaatatatatttttgtggaggctgcatagaagctgaaaggctctagcgaacctgctcgggaatgactcatggaaacccttgagctagccatatttatccccatctaggaggattgttcctattataaatatcccctatgttttatcatttgaaagacttttgacaataagaatatgaacccctttgtttagctgtgtgctagcaaattcagagatagatctctacgcctttgctcttgtgatttccatgttagattacagaagcggcgttcgacgccccccaattggtgcttctggtcccttcgacgtttttccttgattgattccaggttgtgttggttggtaacttagagtgtggttggacgaaccctcgattcaggttgtcgtaatagagatggtggttggcttcgagtacgatcgtcaggttgcactgttatctttgttgctcgcaactagttatcttgttttcgttgaggctagttatcaattcttgatcctatgccgtaaagatcgggacatcacccctaccggggtcgtatcaaatatttaataatgtaaacgtggtgcttatatcattaagtatcattatttgggtatatatgctgcgggacagtagaggtgggccgctgatggtgacagctcagtacggttattcctccacgttattcctaagacactttcccagggtgggtactcctccgtatttgatcccggttggatggctatgacgggttgtcgtaaggaac

SEQ ID NO: 51281 - DNA, 2124 bp, Oryza sativa
cggtgcacgccggcgagcgggatggaatagtctacgagcgacggcgcaacacagagtaggaggcaaaccctaaactgatttcgcgtatgttgcgtgaaggcggcggcttggtttatacagagataggtcgcttgatcagggcgcccgcaagatctccactccgcataaccgaaccagataagtcgcgcgtaacttatccggactccacgccgttttcacgaaccggattttttggaatgtttccaaaacaaaacaaatccgaatttcccgtagcaaaataaaactgcaaaaggagacttgcatttgcagaccattcgacgcgtaacatcgtgcatgcgcgccgcctgccaggcgaggcgaggcgaggcgagcgcgtgtgttcccctcttctctccaccatacacgcttcaagtggctaggagggcatccttgtttttaaggaggtccccctctcctagaataagcaagatggtactaaactccacatgcatgctatcttatgaggtgggcttttgtgatttttctaagaattaatcttagaatgtgccttatcccatctattaattccaacaatatgcaacggcaaagccagctcccagctgatcaggcggctgctcaagctccgccactggcatcaatactgccaattggcagaaactcctataaaagttgtcagcagctaagaaatgctctacatcgaccgggcttaagagtgctgccggccctgcgactgttcatatggtataacctatgcctttggttttctgattagtggattctgcatgtgtaggtacccacagtagatggaaagtcactgataaatgcatgcctatgggtgatccagccaagaggtatcaacaaaataaaaaaaacattaattattcagatcagcacgaatctgatttcaaatcaattcaagaaggaatgtagtaatgtcttggttttttctttctgcataacaagtttgaagttcaatattttaaatttgacataacatcactactgagaaccggtgcctaaaacctggaagtctggaacaatataggtgagctgggtgaataagatttgattttttttccttgcttacatttgataaaaagaaattgaagtaagtagatctgatatactatgaagtttattggaatatggagtgtgcagatgtaagtcacatcacactgatcttattgtgtgtaatgagtaatgagacaagatatctaaacatggtttccactgttggacttcaagcttggatctctctttgtgcaaaattaaatggcataccaaatgtgtgatctgaagtttggttaatacagtacattttgggattggttgggtcgaatcaacccaaccacaattgtccagcatgagccatgttaaacacctgggtccagctaggccagatattcacaaaaaagaaatacttcctccgttcacaatgtaagtcattctagcatttcccatattcatattgatgatatgtctagaatcattagcatcaatataaatgtaggaaatgttagaatgactttaattgtaaaacggagggagtagtaaactcttgggcatttcttaagtctgccaatagtggctgtggaaaagtaaagctgtaaaactgaaccgcatcggaaaccagtcctctgacaacccaatcgctcacatccccacaaaaaagtggagaaaatagagctgcataatcttttcctgttggaatttagttcattaaaattgtatctagctagaaatcgcatttccatgttgattttatggattgtgccaagcatgtccaaccaaacaatatttgtttgattcctggctacccagttcggttattttgcatgtttaccatgctaaacattagtaaactaaagtaagaactagtttatccaagtgtttcttttttcagcacttatagcaaagtaaggacatgtacactataagccacggtagaagtagcctcatgtagaccataccgtctaaggacacacataggaaactttacccccaatagaggatacttttcaaagggttcttacaaatttttagagtattatatgaagatactgcagtccacaacaggtgtcccagcccacaaagttactaatgttgttttccccttctaccccc

SEQ ID NO: 51282 - DNA, 2084 bp, Oryza sativa
ccaccacctcgccgccaccggttcctccccaccgctgtgggtctcctgcctcctcccagcgacgaggctgagggtggaaatgggaatttctgatgggagccgtgttcatgaaccacaacgtcaccaacgccgatcctaactccgtggctcgacgaaatggaccaaggagcggagggaggcgcgtgcctcgcagagttgtcacgcccctctgccgggagatggctccgacccaaaaagagacgtccggtcagcggtgtgagtaggggcatgggccaggagtacccattgtacatgggctaataaaaatgcagcagtcgaattccatgacatcgtcacttttagatttgttgtccccatggccttatttcgtaatgccttatttaaatctttttactcttgcgttgagttctttttagagcactttggaagctatgaatgtgtgtaactagtacgataaggtccttgacacacttttctttgttgatgttattgtttgaatagctgtcttgagaaaaagctgtgcggttgttgattcagattcatgtccatgtcgtaatagagcttttgtagtatttgaaatttagtcggcgaggcgtgagtgacagctgtttaaccagttggttttttacgttaacaggcgcactattgcatactgcagagcatgtgttagtgctacaagctggagggccccctcaagcttacacttgcgtccttgcccagctcaacccgttactttttggctcatccaatctcttgtccatacgcaggtacgttctgcaatacttatcctcataaagtctggtctttttttcttttatttggtttcaagtaatccacatgtgaacctcaatttgatgcctaaaacgagggttttccattggtccaacgggtttcccttttcttgtgatgaaagatacatacctaccattggtaggcgacgattgtgatgttagcatggtactggaccgtatgatctgtgtagcaatcggtgaaaggtttcatgggaaatatctgtataattttcctgaaggaattaatctgcatttttgtcacggcaagatattaccacacctaaccgtgactgttgaaacaacagcgcgaataagcatccgtaaagtagacaaatagtatgttgagccaagaaatcatttaccaccaccacctccctttgctctcgttaaaagagcatcgaacatgtagtatacactgcgctttcctgttttgctgaacagatatatacaacgttacgcaggcacgatgattcctccttcaaacacatttagcaccgaacagtcttgcctgtgtctgctgctatttcactaatcgtctcctgatgctgaaattcctgtccagatcggtgctctccccggtcttcttgtaaaacccctcgcgtcgatcgtcatatatattcggttttacagctagctgttgcagatgaggaaccgaacaaatgcagctcctgtagcacattccgattgttcgggcgtcgcgtggcagccagaatccatccacatcattgtgccttcatcatccactcatcaactctcatcagtcggaggcacacggcgctttgatttggcaagaacggctgaaaaaatgtgatgatatatctaccagttctctcgtttgtatacaatttcaaacgcaaaattgttgtgtgacgagccgtaccagggatggcacggcatcttttctgtgtgggtatgtatgtgccagtagaaacaggggctttggccggctaaagttttgccacctgatgaggcccctgttccggagccatttcggcactgtgggtcgagaaagaaagcgagcgtgggactcccgtcaaggaaaagctacgtacctgaaaaagtcccacggcaacggaccatgctaatcgtgaaactgccggccaccacccttatcattgcccacaggttgatgttgacgttgccctcctcttcttcacctcgatcggctactattgccccagctccctgaatcttgatccctctgatggagaacttcatcttcacacaaggaaaaaaataataaagaaactaggaactcgaattctccttgttgcatcaaccacctgaccgggg

SEQ ID NO: 51283 - DNA, 4876 bp, Oryza sativa
tgcaaaggctgtttaggttttgttgagatgattggtttttgaacagtcattctctcggcatgttatatgcttattttgattatgacgtgagtcatagcctaggtatttcgactcattaattgtcatgatatcatatttataccacatttgatggatctttgaaagtttttactcagattcttgtcatatgtgctgatttatggaccttgagagtattttttactcgggcctctttatatcttcgtttttggtatattaaagctaaagcagtcggctggatgttttattaaacgttgcatatgcttatctgtatgatactttggataattcggttgtaaaaccactcggatggatgttatttgcactttgactatatgtttagcctttagctactcacatagtcgggggctacacctaatgaggtgcatctatttgatgcacccgattatttatttttagcccttcacagtctttgattttggtactcgggagatcaatgcagaagaaattgaaacactcggattatcattttgcactacgagagaaggctattttatcgactgtaaaggtctcaggggctactgtgaagattatgtataccccatacctacacggcatgtatagttcgactgggtatggggtgccatgtatagatagaatatctttaaagggactcgggttaaattctaaacttgtatgtcaagcaaatacccgagatcctagtcggttacgattgtattttatctgtaactacctattccgttagggatatggactgtattttgtaatacggaccccttcccctatataaggaggggtccgggtgcctctaggggcacaatttttcacccagatcatacgatcaataatacactcgtcggatcaatccccggataggattagggtattacttcttgattaagaaggcctgaacctgtataaaattccttgtctctaaacccatccacttttctagcttgatagccacccccttttagtattgccgaaatcttgtttcgacaggcagtgatggcgggctcaggaataaaagttcgatctcgagcttttttagtcggcgacctggttttgagaaaaattcaaactacacgagatcggcacaaattgtctcccttgtgggaaggaacgtttataatttctgaagtcactcggccaggttcttaccaactcaagcgtgaagacggtactcatattgacaactcttggaatattgaacatcttcgtcgtttttatgcttaggcattacttttgtattttcctctttgactgttaacatcaagttgtcccttgagttatcagtcgggggctactataataataatagagtgtgatttttatcaattcaatttgcttacttgatttatcattgccttgtttgattttttggcttagccaatgaggactgagtttttttaaaacttttgaggtttctaggctcaataaggtttgataaaaacttttaagaaatctggagctaagtttaaatcatcaagcatagcataaatttatcagtattgtacaaattgtgcctccatcatcatcatcatccttatcatcagaatacacaatcaattagattcagttctttcatcatcagaattatcagacccagtcggcttaagatcgttgtcctggaatctctcaaccacatcagcggctatcttgtcagcggccttttgcgcatcactaataaggtcaagggcagcctcttcacttgtcccgtctgcaaagccgtcaacagcatcaatatcaattttcgggtacaaggacttggtcatcaccagcgctaggcctgctcccatactcccagtttctttgatgttcttaaaatatgtatctggagcagctctcagcttgtcgaagatttcgacagcatcaagtgaactcggaccgttgttattgaaaaacatcacctagacgagtggcgtagcggcattggcgacttcatctctggctccttcaagcttcttgattttattaactaagacatcgaattgggcctgggatttgatcttgtggtctacatgaataagtttacatcaatgactaggcatgaagattagagtggtttttgaagtattagctaccagtaccttcgacatctttcagagccgagtccctctgtttcgccaattcggccttgtctttctccagagcttggattcgcttctctagctcggatatcttggaagctttcactgtattgcctttcattggtcagttgcacatggatagcaacatgaagcaggtcagacagagacgatatttaccttttgatgaaccgctcagctcaaagttggagtcttgaagctcggcgatccgatctctaaggtcatgttcagtcttcctagcaagctctttggcttcacgcagctggtctctggttgcttcaagggttccaaggtggggaactaatttttcaagagttgcagtcttcgcctcattcctgagatggattctctgcaccacaaatttatccgtatttaagcatggtggccgacaggatgattgaagccatatatagggagacttacatttacaaggtgagtagcttggccgagtgtcttttttagcagacatacttcctcgtcctctttttgtttatttattacgatcccctgcggctgcatttcgtcatcccaccacttgactaatatgggtgggcgagaatcttcagccgattgtatccggaggacctcttcttcgtcaccgatcattgcaccttatgcattcataaataatggtgggactattgaagaaagtttgtcagatcaaagcagatttcagagagttgtgtacctgttataacttccggtcggggacgagcaggcccttgtaccctaacaggagagctggaccctggattgacgttggcatcctttttaggagggctgtttgcttgagcctctacttccgggatgtcattattttgttctgtacccgactggtttccagtcgagggctcctgattagcaccgactccagcttcgtccgactgatttccagtcggggtctcgttgctggtttctacattgtcggttgctggatgattgtcactcgggcgattttcgacagtcggcccggtttcttttcaaggacccatctccatatcagtcggctcagggtcttttccataaggatctatgtcagatggcttcctacaaatttgagttatgctatcagtgctatttcaatagtgagtgagcagcaatacaaggaaaatggccaaatgatttgtacctggaggacttactgattttcggcatgggacgactggatgatttcttcttcggattagcttgccttgattgttttccagtcacccctttgctgccagccttttcagcatcgtcattttcatcgtcactcagaaccaaattcctcttgcggaagtctgactagttagccgattgagaggtgttgggttgagtgtcaccctggatttttggtcctccgccagcttgaccagtttaccaccggggtgagcagcattgagcaattgggggatctgacttcatcaaggcgaattcctgggcatgatgatccaagttttcaatcaactttatagatgataaaagcgtgcttttgagaaaggctgagatattaaatacataccggtggaggggggttgaaagcattgtacggcaccactggcagcaagtgcgagtagctgactacgattgcatttgagaagattttatacattctctcgttcataactttgaattcaagagatttaggatcttcacggttagggtcatgcttgccatcgaattcaaaggccgcgcgagatctttcattgattggggccagccggctcttgatgaaatgccgggtgatctgttctccttgcagaccctgctccttcagcttcagcatacgatccatcagggaaagcgcttgagcagcttcatctccattggaagtgagttccaagtatcttgatacactagaggaaggcaggagtactcgggaagagctggttcgggattttgtacataaaaccaatttgcatgccaacccttattcgaagttttgaaaggcatggagaagtatttttggcttaaggttcccctcagttgaaatccagctcccccaactacatggtttgctcttgtttggctgggatttgaggaagaagatgcgacggaacagggcaaaatgcggtcttatacccctctcaagtagttgagtttgaaaatgtaaaaattatatgaatatatttgtcttgaaaaataatttcataaaaatatacatatatcacaaaccccagccaaacaagaggaaaccatgcgtagttgggggagctggatttcaactgaggggaagaagatgcgatggaacagcgcaaatgcggtcttatacctaggaaagactcgcaagcataaataaaattggcaatgtggactatggagttggggtttaggtgatgcaaactgatcccgtaaaactccaaaattccccggaaaaatcttgaggttggaagagaaaatccgccatagaagaaatgagaaaataccacgacttcatgtgtgtcaggggttggaaatgcttcgccgcacgccgcacgccacccgatgatttccttcgccgcaagaacaccatgcgctaccatttccttcaagctctcctacgtgacgtcggaggacgcccattggctctcgaagctctctctcctccaccatggatgtgaattggatgatgcgatttgctttggaaatggctgggaatggatgggggatcgatgcggtggatgcgcggaagatttctgtggagttttggaaggcggatttgagcgaatcggtgaaccctagttccgctggtgtggttttgcactgtagcggggaatggggaaagt

SEQ ID NO: 51284 - DNA, 2340 bp, Oryza sativa
atgggcttagatgacggtgggagtgatggttggagcgggatcggcggcggcaggttcggcctgcacacgcggatcctatgtgtgtctagactccataggatttgaatctttttggaacagaggtagtagttctgtgagaaatttagtgttaaacatatagttttgtgatacgtcatcttaaatatgtacaactccgtcccaaaaaagataaaccctagcacatatgtccaggctcgtggctaggattgagtttttctatggaggggtagttttgtaataatttaaatatatgtagttttatatagtttacccaaatgtaatttaaccaacggcaccggccgaccgatttttaatccaaggataacttgcttacttaccaattatttccggcccccaagggcccaatccgaacctcctgtgctgaggcgcgcagcacacagaaacaggggcaagctagcttacctagctagtgccctgaaaaggtcacctcatcagggtcaagtgatagtagtgatttctgacaacaagcatagctaggggcctttcttttttttctatttgtgacactggcttaggaagtgaaaaaaaagggacgaaagccccgcaggtattgaagcgagcatttacaaaaatgtttcccccggaccttttaaatcaaaagatttcatagagaaattttataggatacaaatcatatgcaaactttttccatttgaacctttgatacaaaggattggaggatttcaaatcttatgaaatttctgtaagttgactcattgtatgtaaatttcagactaaacttaggctgtgttaattcctagtggttgggaacactaccctccattagcatatgattaattaagtattagcttttttttcaaaaatggatcaatatagtttttttaaataactttagtatagaaacttttacaaaaacacagcatttaacagtttgaaaaacgtgcgcgcagaaaatgagggagagaggttggaaaccttgaccttcgaacgcagctttagtaagagtttcaacctcttgaattttttttctctcttttatctgactcttgtgtttttctctgactcaattaaataattatttatgtctttttttatattttataatattttgttttacatttcatttctgttcatttctgttagaattctctgttttttttaattttttttcattgctacaataaaaaagccctaagaatgaatgagattacacacgatcgaccgagcagggaaacgaaaaagcggatgaagaaaaatgtaaaacaagtaggagtagccagcagctgagtgagagcaaaaatggagaaatgcgcgcgcgcattgcgttgtgtgttgccatttgccaatcccatcgaacgcgatcgatgttcgtggcacgaacgagcgtacgatggcgtcttcttcgtcgggcgtcctggaaatgcggcacagggaaggtggaagggaggggagcgacagcggaatcatgacggggccacggtctttttgaccgatcgccgagaaagcaattatgggtgtttgattctgacactacaaaatttcgccattgatatacaaatcaatctgccagtcctttctgttgcttactctgcgtatgtgcgtgccctgcgctactctgcatgcatgctatacttacccatttctttctttctctctctctctcctactactctttctttctctctctctcttcccacgtccttgcggaggaaagagggggagggacttatcgatgccttttttttttttaacctctgccatgcatgagggacgaccgagttgatcgccatggacgctttattttttcgctccctcgtcagtgtcatcatatgctcaattcatcaaaggagacgagtagtgtaccctgagacactcagagagaggcctttggtgaaggattcgagcataatgatgcatggcaatagccacacggtggtcccttcattttctctctcttgcactcaatcgattgcctttctttcccatgcaaacagagtaaacgaaagggaaatatagctagaaagaagctaacgtgtttatgtatgttgtgtgggttcgctacgtactgttgcatgtatgtatatagttgcatgcatatgcattctcattaaggcctctcacagtgcaaactatggagcccgtaccctcagtccaaaaaattggtcctaagacacccatcccatagtgcaagcacccatatatgtgtgacttaatcggatagaggtactggtaaagggtcccaagcctacagtgggcatgaccctagtttctggaccagtagagcgaacgaaaatttatttcctccacttaccccttcta

SEQ ID NO: 51285 - DNA, 911 bp, Oryza sativa
gcgacggacggatccgcctttcccgacggcggggacggcaagggcggcgggaacagacggcagcgaggacgaagtgggtgcgggaatagtggactcttctgtgattcctctttgtgttcttatgtgattcctctcttctttgtgttcttgggtgattcatcttgtgttcttgtgtgattggcaacgaaatctgtggcgggaggaggggatttgggcgcgacttcttgctgaattttcgagggcgaataggggatttcgctaggggaatctcgcgcaagagcaccgggcggcgagggaacgactcccacagcgcacgcgcctcacatcgattcctccgcgcgtccccttttccaggcgaggttttgcgccccctagtttaggcacgagcgccctagctgagacgcgggtctgagtgacacggcagcaaaaatccaacgtggcgcgactaagacacagtccaggtcgacgcactgtgagaggcctaattgatttgcattgttgtggattgagagatggagaccgttccttgaggagcggggagacagggctcctctctgtacaagtacactgtagttcaaaaactgcaccatcgtctcgttttctctttaatgaacaatatacaactacagaatcagagctctcgctgcctgccctcttacagtacacgttgtggctgtcaggggatgcactttaagatagagaagagttgaagtctctcgtttcgccaggaggtgaaaggttggagaaagagaatcctatcgaccgaccgatgccgatcgatcagagttagcgtagtggtggctactacactgatggcttagctagtcgtatatatgcaatgcaaagcatccatgatccagccaaggcatacagcgatgagagagagacgatccaagtgaagaagaaagtag

SEQ ID NO: 51286 - DNA, 1787 bp, Oryza sativa
tctttgatgaacaggaactcttgtttgccttagccaattgcctctattatacgatcggcttggactttctgcaacattactgcacccaggacagtcttcaatagatggcaacctcataccttcattccagcaaaatctaaagaactcacaaccccaatgaggatcaaagccgcatcatcttcttcataatgcctctcctgctgcttggcatatttcttctgatatttattgataattttagccgaattcacctgaaaacctctaccacattgacaggaaaaggattgccatcaaccttcatcggcctcttggaatcatcaaatttgatcttgcctccttcaatagccgcctggatctgctgtctgaagactttgcaatcattggtagaatgagacccaaaattatgccacttgcaatacctcctcttgcctaactcctcagccgatgggattgtatgaccagtaggaagttgaatctgtttttccgaaagtagcaaatcaaagatcttatcggccttggtgatatcaaagtcatacctctcttcctttccagaactcttcacccattggcatggtataaccttcttgcttctaacccattcggctgctgctatttcggagtcatcatcatcatcatccgatccatatatgtaaggacagacatgattaaccttttcaaagttcttcctggcttctgcaaacctctgttcatgcaaggttaccttctgtgcaagatgtgacaaactatcaaagtattgggacgagaacttctccctgatcggagctatcataccctgaaaagccaaatcggctaactgggcatcagttaaactcaagctgtagcatttattcctcatctccctaaacctttggatgtaatcttgcacaggttcatcatgtctttgcttaatcgccgttaaatcagacaatttcatctcatgaaccccactatagaaatagctataaaaatgcttctccaaatcggcccaactgttgattgatccacatggcaaagaagaaaaccaagtgaaagccgatccagacaaagacaatggaaataacctaaccctcaaggcattcacagccgatgcttcaccacaccgagctaagaatcggctaacgtgttcatatgttgaagcactatcccgccccgagaattttgaaaaatctggaaccttgaatcggtttggcaatggaactctctcaaaccactcagggtatggatgccgatacagatttccagcatcctgaggcttaagcccaaactgttctctcatcacatctgcaatcatatcggcccatggtcgttgctgaggcacccctgtgcttgttgtggcacgggctcgaattgattgtattgaggagtgaactgagactgagccgatcctccttgctgatattgaatttgcggcgatggaggctaatactgataattcaaattgcccccctgataattctgaaagtttggttgtatattgcgcaccaaatgttcgggaataacttgaggtatcaccgtttaatctggttgcacattatgaaccaaatgctctgggacaacactattcacagcgtgctgccttagctgattgtcaggtgttccgaacccagccgatgcattcatcaaaccttactgctgaatcggctgaacaacctgttgtctcggtggcgtttgctgaatcggctacacaacctactgtcttggtggtgtttgttgaattggctgcacaacctgctgccttggtggcgtctgttgaatcggctgttgttggattgggtcaacaataagct

SEQ ID NO: 51287 - DNA, 4840 bp, Oryza sativa
  unsure (1)..(4840): unsure at all n locations
agcgatcgggaggagagggggaggagggagagggcggggacgcgcgtagcgcccgggagggagagggagatgggccaatcagagtgagggatgggctggtgggaaggagggggtatagaatagttattctaagggagggatgtataataatgctatatatatatatatatatatatacatatatatacatatatatatatacatatatatatatacatatatatatatacatacatatacatatacatatacacatatacatatacacatatacatatatacacatatacatatacatatacatatacatatatatatatacatatacatatacatatatatatatatatatacatatacatatacatatatatatatatacatatatatatataggggtaagactattctacaccccctaacctttatcatcggtatcctcccatcctcctccaagcctccggattccccctctttngcttcacctccctcccntcatccggatatctctcttcttttttcccattttttctgttttttctccctaaaacattttttctcttttctacttcctccgtttcacaatgtaagtcattctagcattttccacattcatattgatgttaatgaatctagacatatataaggatggcaatagggccccgagaacccagttggggacggggacggcgaaaagtcagccccgaggccggggacggggacggggagcggggctttttgaagtgtccggggacgggggcggggtagcactatccgttggggatggccccgttgccatccctacctgcaagatgtgttcacgatgtggccgaaggtttggatttgagaactactacggttgtaggaggtactgcaaaaggctcatgaaggaaattaattagaagaaaatcatgaacagaaacttcaagaggcacataattaaggactaaccattgtgcctgttgtcccaattgattttagcagtttctatagtgtaattgctcatgattaagagggagctagaggagcatacaggatcaagatgattagggtgtgggttacaagttaaggggaatggagagaagcaaggtttaaggcatgggttgggaaagacgacgagggaggggccggttgagatcaggcaaaccttgatgtccatggtgggtaacctggcagctggagccatctagaaaggccagccgccttgccctcccgaactgtgtttcacaccatcgagcgtcgaagcgtgttccacctttctcctgagccgtgtgatagaccaagctttcgcccgccgttgatcgagcaccaggtcgtgtgtcacatagggctccgcctatcggccgtttcagctgtggccttccccaaccatgctcgccatgaaccaataccataaacaccggtacaattgcaggccatgtacaagaaaaaaaaatccaattgcagttatgggtctcaacttttttcgttttcccctatcccatgtgctatgtaattttccctattattaattagcgtagtaagaacctctcctactggtttctatatataaaaaaagacacttggtgggcttctggtgcacaagaacactactggaaaatggctcttctcttcccggtattaaccccctatattcccgggtattccaccgcaactgggaataaaaattcatttttaatcccggtggttaccgggagaaaaaattcatttttagtcccggtggtaacaccaaccgggactaaaatgaagccaggctaggtccagttgctcctttttttttcattatttttaacattgaatattgatttcactccattcccaaatcatcccaaacaaatcccaaattgatcatcacatcatagatcaaaaggatcctctccaaatcctcaaatcgatcatctccaaatacatcacaaattcttaaaaaaattacatcacaagttctaaaaaattcatcacaaatacataatatattcatcacatcacacacaaatcaaatacattgcagatccgaaataaaaatctcaaaaaaagagaaaaactcagaggtgcttcccgcctgccgcaccggcccgccgctgccgcgccgcgcccgtcctccgtgccgtgccgactgcctccgccgatacgctactgcctctgcaaggaaagagtagataagagcaagaaaagaggagaggataagagagagaggagagggagagaggaggaagatggcagtggcagacacaaccattaggtaggggggtcggccgacccagctacggtccgtgtcgcttcacacttttcaaacctcattttagtcctatttctaacacattaatcatcaatctactattgaataatcaggtaaatcaagtattttaagtaggaacaaaaacatttatgaaaattcgtgtataagtagtaccaatttgactgtttctgattttggccatacataaaatttgattttctttctatttctttagcgtataatacagtttacagtaaataattaaattggtaaatatataaaaaaatcaattttactcacttgaactattttgacgaagcacttaaacccctacataatttttcatctcgttttatacctacgaactattgaaagtggttccccttattgtctaacagtatttctcatttttttatctctctacatacaagtcatatacatttgttcgactatcaatctttgttattaactttctcgatgttcgtgctgtgcgcttttgcgccaatgccgtgaaccagcgactatggtttgtgtgtgttgtgccattacctaattaaggctagctctgtcgccccatctgtattttaaacctgcatccgccactcaagatggggagaaagactttccgatagaggatttgaggataagtcctagggattatatactactgttgatgtaaaaacacgaggcctgggagatctgcttaactccagtgcaggtccaaaacttgcctttaggtatgcgagcgtgccagttgatttgatcctgcaatcaacaagaaacaaagacaaagcaaccggtagttaaatccataaacgatagccgatcggctagatgccgatgacatatcatttatctttgagcccatgtcatatatacatcgatcggcagtcgttaataagtaagaaagaactatatctacttgatcggttgtagatattaacagtatatagtccctatatcgatatatacttaaatcaagtgattgggatagatcggtcaccatgccgagacagtataaatcaattagatcgaaatatatattaataatgagactatatatgttcatagcatagccgatcaggtagatctagcatgtatcggctaatactccgatactactctatattaagatattaaaacaagtagaatatatcaaacaaaggcctaatatacttaaatgcaataagatcttacataaagggcagatttaacatgtcaacaaagcatataaggtaaatatagttaaatcaggtaagatcggctgaaagtccgatactaccctagttggcaaccaaagacaggctagagattgagattctaatcacgactcatatgatcaaactcaactgatgtagctacaagtatgaaaagaaagacaatatctagacaatcaagccgttggatgtgtcataaagtggtggatatcatatataatctaagtcaacatcagtatctatcctaatcggctgccttctactaacagatgttagccgattgtaggttaggtaacgatattgccggagattatgtatgatatgtgataactcgacaattacataaacaagatttgagtatcataaagatggaagcactaatcccgagaacgcaagccgccataataagttttacctcttgttgaagatcaaaaccgatgcagctcaacccaaaagcaagaactcatcgaaacaaaacgaaagtaaaaagggtggcgatgcgccgagattgtattgaccgtgtgttagtttgattacatggggctcggggtctatttatacccgagaattacaaaatatgtccatatcggacacgactcttatctctaacacactctaagataccataagtctttgtggcagacttttgcccaaacatatctctaagagaattacataaaatatcctaattaatagatacaactgccttctcaggactctatccatgcgtggcaatcatcatgaagcatatcaacctaacccgacaacatatgcaatgttatattatcggatccggcttgatcggctaaccctgtccgactcgaattctgccgatcttagtcgtagccgattcggactccagccgatcttcactctgtttccgggacgatctccatctcgaactccatctcgattccttcttcatctccgattcttagattaccaaatttggtcgttaacaactatgggttgaattttagtcccagttggtattaccaaccaggattaaggatctaaataatctttactcccggttggtacaaccaaccggtgtaccaaccgggactgaagtggtgatctttagtcccggttggtactaagatccttggccccctgacaggcctctaacagttggtaataccaaccgggactaaagatcaaattttttttaattgggactaaaaccaatttttggtcccggttcttattagaaccgagactattgtcgaaatcagccgacctagcaaagatcacttttccagcagtggatggagcaatctatgggcctcaacttggggtgtgctggatgtttttccttttttttcatgcttaatctcattgattctacggcggaaaggtgacatgatctctttgatccaatggctca

SEQ ID NO: 51288 - DNA, 1650 bp, Oryza sativa
tcttttttatcattcggttgtaatgaattaggagttgtactcttgctaccatcatcttcttcatcagctctctaagttggggtcaaagacttctgggaacttggcctcctgagggactccaatgcttgaaactttggacaattattcaattcctcaccttgagccaagaatgattaaactgaaatgccttaatctttttttttcctttgatgagtacaacgcctctgcttcaagaacctgcagcaaaactcaagtgttagttcacatacataaaaaaattaaggttgtgttcggtaaatgggtttgggaactaatcttccatgcatggaaaacagaacgatatattagagcactattaattaagtattagctaaaaaaacttaaaaatagattaatatgatttttaaaacaacttttctatagaaatttttgcaaagaatataccgtttaatagtttgggaaacgtgcgcacgataaacgagagaggtgaagttgggacaactgggtaccgaacatagcccagttcgtatagggatgggggagtgaaggcaacatttcatactactgaatagacggacttccgtttttcttttcacgaaagatgggcttaattgactaccctcgcctctcacctctccaaacatgtggccgggtggagagctaggagtacatggcggtgacgatggcctagaggtgggggatgagagggtgggagcggtagggtatgttgtccaagctactgaggagatttgaggagacggtggcggcgtaacggccaaggaagtgggctgggaagaagcacaagtgcgcctccacatctgctgccgccgagactgaggtgggagagaaatcaaagaatggggagagagataaggaagaatacattgtttcactgatatatgtgggtcccacaagggtcttttttttatttttgattttattgccacgccagcgccacatcatccaaaactgcctttaataccgccttaggaccaaatgtaatccggttttgtaagataggaatgcattatactcaggtgatgattttgaaactcgatgacaagatgagaggcctcaagagaacattttccttctctaaaactagaccaaaatttccaccgggcttttgagctaggaaaaagtacgaattaccccgctgaactgttatggtcgactaaattacctcctgaacccaaaagccagatattgctcaccctaaacttttaataccagacgaattacccccctcgacactgttctaagcggttttggtttgagcttgcagacgtggcgctaacgtggcaatccagtcagcaaaaagactccttgggcccacttgtcaaatctctccctccccctctctctctctccctggtccctttctctctcctaagcgccctctctctctgttcggtccctctctctctcagagagccagctgcggacgagctcgggcacactggtgtggacgggcagtgggcggtgtcgcgtggggatgcgcggtggacggcgacgcgggggaggacgcggcagcggcgggcagtgccatctcgagctccgcgtcaacggtgacgaggcctatgcagggggcggcgggcacaacgcaggaaggacgcggtggcggcgggcggtgccctctcgagctccatg

SEQ ID NO: 51289 - DNA, 1391 bp, Oryza sativa
ctattaagaggagttctaggtgatgctctgagatatgtcaagtgctcttagtgtgaaccaagtgtcaagtttccctaggagtcatttttgcaaatactccatctgtccaaaagtgcaagtccggaacttcctgtcttccaggtccggaagttctggtcttgtgaaaaagattttcctaagtgtagtccagaagttactatcttccaggtccggaacttcctgtctagtttccagttcaaaattgtgagtaatggctagatgacgtcacctagctgttatacataaccaactcgttccttggccattccactttcacttttcgaaccaagagctgttgctagtctctcccaagtgtttcttgccttctccactcaatctagagcctaattcttgtgagaaagagagattgagagggagagaagaagatttggagaggtgtgaagactaggatcttgggtgagcacttggaatatctcgtgagctgtcatctcggtgcttattactcttggagatgatctcctagacggttaggtgtcgcccgcgagaatccgttgcatattgtggatgtcccgggtaagattgtaaaggatctcccctcctccgaaaaggaactaggtaagttaatgaagttcttgtgctgagattctagaggttttccaagtagagcaacctacacttgtgacgaatttctagaagtaggttgagtgggatcttggtggtcaatcaattctagaaatttgcctaggggtgtttgtcgttgaaggctgtggatttcctctggggtttttgcacaagtgaggcaaggggttaattgagacccagctctttggagctcctcaagggagagtaggatcgcaagatccgaacttcgggaaaaaaatcgctcttgtctctttctgtgatgtttctgtggatgtttctgtgatctattctctgctcagaatacctgtgcaccatcttgtgaagattggcttagtctcctgtttcgaaatttgaattccatcctttgttttgttacccggaagttcctgtcctagaacaccggatgttccgagcctggcaaaccggatgttccggtgttctttaccaggaagttccgggtttgtttgaattttaccgctgcgatttgcttttaagttttcagtgacaacctatccatcccccctctaggcttcaccagcacgttcagtagacgccggcccgcgccgcgtacgccgctgaccacaccgagccgtttctggcggcttcagcctccatctccgcggcgtagtcgacgctgtcggtgtcgtcgtcgcccatttcgctctcgggcatcccctggttggtccccaccacccctcctcctcctcctcccccttctttttccttaccccccgtttcccaaaccaaaa

SEQ ID NO: 51290 - DNA, 5400 bp, Oryza sativa
tgcattgccttgctcgccaagaaggcgagaatgctagagagagaggaagaggagaaagaagaggggagagagtatatatgacaggtggggcccactatttaaaaaaagaaaatgctaactggagtgccacgcgtacaccacatcggataaaaccgctctggattgggtcgaggggggtaattcgtccggtattgaaagtttagggggagcaatgtttttgggtttaggggggtaattcggtcaaccatgatagttcatggggttaattcgtactttttcctttgcgccacgttaataggcttggatccaccaggagttggcctcccaaaaaagaattcacgtttacgtgaaggcctcgttaaccgcataatttcacaggaacagaacacgtcgagcataatcctgggaaaacacctgatttccaatcggggtcagttgtgaaccaacaagctgcaggcgcaatgaacgaacttctctgtccagtttcaaactacatgcaaactgttctaagtcttacaaattcaacaaatattacggatatgcaggtgagttttcaacaaaattttagtgagatcaatgatgtgccgctagttttcatctttgagtgcatgttagagggcacatttacgggagtgtgagtatgacgcagtgtgttgtgcgtgcacgtgcatctgccgtgtaataaaaaaaaattcaaagcaagcaatgtaggagtaaaacgaaaactgatgcaaagcctttggtaacccattttgttttcctattgcacttcttgtaatccacaacacagtcagctacggataaaaggagctgacatcttagtaggaaggtgcttgaaacctctagtactgtgtttcacctatcatcctcttcaaggttaataatctgaagaaagatgcttgcagcagtgagagattttgggctaggcctaagtataatggtaccacaccggtttactgatgctaagatttatactctaccctatactcttaagctgctacttggatggatccttaccaaaccatccacagggtcaggtcatgtacaattacaagttagtaacctccaaatcctttttgtcagcctgccaattttatctagcttcttgatgaaaatggcaaagaactggtcgtggtttatagcaacaatctgttgtcctccaaagctgtgtgcaatttcaccaccaaccaaatttgtaccagattcttcactttggaggtaaatcctgttatttccatcgttcttgtgtaggtagaaatttctacctcccacgtctccaatcttatcgtttttgttcaaacctgccagcaaaagattcagcttttacttctataatcagatcactcaactatgtattggcaatcgaccaaggtaacaagataatgttggaaatttgacttaatagtgagtagtcacctgggctcaacgaaagcatttctagtcacttatgttcatatcctttgttccgtaaagaaaaacatgaacttattcatgttttagtatgtaacaactagtaatttatatggtccaacgtgggagataataggactcaggtaaacaaagaactgttggataccagcatcattacactggcattaaaacctgcaacctccataattaactatgttccgtataaacccatcagtataatttaaccaattatgggttgtaagttgaaagttcatactacacatcattttactgtgttcaggaagacctgaataaattttcactaataatagtagtagccaaactatcatatatacctgcagtaatttcatttcactcgaaataatgctacaattcttttgagtttcgcataccattcttctagttctatgttcccttaaggtgcgccacagcttttggatgcgtttcttactagattcactttacccttactcacaagtgcaattcgacatatattaagcgacgaatgtgaaggctcgtgttaaatgacttactctggaggcagaagtgggagtggtggagctggaaggcctccgcggcagctggatccaaacgtgggcttctcccctccttcgcgtacctctccaccacggctgcgatcgcctccccaacactcgcacccagccgaaccatcgccttcacaggcccgacgctcccctcgactgtcacgctcaccaccacctttgattcctgcaccaaacgaagcccagccaattcactcccgcgaaccgcgcggctaacaacaacaacagtccacttctgtacctccctgggattgcagttggacagggaggcggcggaggcggagcggccgaagggggagtccggggtgaagacgtcgaagcaggtgtgcggacgctccagcggcggcggaggcggggacggcggggagagcccccgcggctcggggtggacgcgcccgccgctcaacaagagcgccggctcggacgcggagcgcgcgagggccctgctcccctcccgccgcggcagcgaccgcgacgccggcgcggggcgcaccgccagccgaaccctccgccctccgctcccgctcccacgccgtcgcgacggcgacgaggagagccccgccggcgatcgacctagccggatgcttgcgaaccgggaccggctcttcctctccggcatccagttcagattcgagaccgcttgtttgatcctgtgctcgcgcgtggagatcgcggatggacgcgatgccgcggagctcgatgtgtttttggtcggtcggcggacggtggtgtcgtcggcgcaacgtttactttcgcgtcgccattacggcgagcttttttctgtgctttactcaacaaagggaggaagcttcccttcatggtgatcctcttccctggaactggtcttatggactgtactccatccgtggtacgcgtggccccacgttgtcagtgagaaaaaccgcgtaaaccgggagtaggcgtggaagagagggagttgtctcggcaagaatttggggtgggggtgccggcgtgtggtgcggaattacgtcaatgggcaccgtaccttcataaataacgaatgtgccaccgggtgtttgtagcttggttttttttctttttaagatcatgtgtttttagggatttttggagcttagaccttagagggtagtatggggaggtgttacgtgcgtgcgagcgggattcttttccatgtcgctactcgcgagaagatttgttgttttcttttttcgttttttcgatgatacgaatgcggaatttctatttctacgtcagaaaatccattgggccgtctaatatatttagagattcatgttgagagatagacctatatacttctcatgggccgtctgtatgggctattttttttgtgtactagactatatgggcctagttctttgggctctataggtggtggtgagcgagccattactgttcatttttttaaagtccgcatctacttttgctcagttctgacatcccacacatgtaagtgatttactcaagatataaggatgaatgataaaatttaaccaaacttacaacgggttgtaattattaggtagtatttgtgtgaattttgccaagatttaatgttgtaccaataatttttagaaattcatctagcctatctctatatatgtgttcccactttagaaatggatctaagcatctataaaaattatatttaaactcttcttgacctaaggtgatgttgttaggtttgatattcagttcatgatgcacatgtcacaagttacttgcttaatgatttgtatttatattttgtattatgttaagagaatgtttataattaagatataatatactctatgtgagttaatatgtttattaagtcctatgttcatgatatatgttcaggtgagtttgtcaagttagtttgtatgaatttgccactgattagaccaaaaaattcaaaatattaacaagtatataaagattagaagtaaaatcggcttgaaggccaatagatatatttacacagaaatgtttcaagtgttttgagcaaaaattttttaagatttatattattacatcaacccaagaaattttggattgtcgatatcgcgtgtaggcggatgtggtttacttcatcgatgatctttgcatcttcggcatccgaacctggcacaagcttcatagctttggtttgagcaggtagatgtttggtcaatgccttcaactttgatctttgctcttcaatggccttgggaagatcggctaaattctgtttctccaagcaatatattcttgtgagtttgttccaattttgccaggagatcgggttcttgctgttcaagttcattaatgcgcttttgggttgattctgggccagcaattagttcatcaagtttggttttgcttttgtttacttgctgcctgctagattggagagtcgattccatagccttgagttcaaggcgatctgctaatctttgttgaggtcgttgaaactagaatcgacgcgattcaagatgagctgccggtgtgatggcgtcaattatatcatcgggcagctgatcttggacttcttcaagtctccctttgatcgggccactgtcagtcactaaagcatccaatgaagcacccagtcgatcagctatgtctaacagtcgtgctctcaagtcatcagagatagaaaatttggtcttgcttgtgatgtcttcatcatcttcgtccaaaaattgccttatgtaagatgaaaacatatcggctagcttctgcgaagtatgggtgaaagatgagaaaaagcaaagatggccaggaattgtgatatgggtatgcttacttggattgggggtacaacagcagcagttatttcttcttctccctgttggctgccgatcgcggaagtagtacgttcacttggtgctcgtcgacgaggagaagacgatggagccttgggctgaaaatgttggatgtcagaattgataatatcagctgaaatgaaaggatagaaataaaaagaacttgccaatacatgagtaggagcgcgaggtctaacaatgcttgtatcggctgcttcattatcggctgagtctttgtcatctgcctctttgttttcattggtaggatcatcaaccacagtagcaggagcatcatcgacttgttcttcttccacttgttctgtcaagaactcttcaacttctggatcaatgggagaaagattatcatcggcagatgttttggatttagaagtcttgggtttcttggatgttttcttggaaattgcttctttacgctttcccagtgtctggattagtgttgatggtcgttatagaccagcttcgactgtcaatacaactaaaataaaagagaactagctatacttgcaatgcatattttgctttagagtaatatattttcacttgtacttggggtattaattgtttgcagagatttctacataaatgggggctgcagg

SEQ ID NO: 51291 - DNA, 890 bp, Oryza sativa
ttcacattagcctagaattatttaatgagagaatttaagtcctttgttttgggtcactctacccatataattatatatatagccaatttattttacacccctcccctagaaaaactaatttacacccccccttccaaagggcaatcccaacttccccaacctccatagggccaaatcccccctcccacctcagtcaaaggctagtcaaagcaccctcccaccggtcaaacccgagtcaaacccacccgttgactccctcccccgcccaccactttgttgttcacgtctcgcaggaatctgtagtaacataacggtcatcgtgcagtaacaggatagctttctcacagtaacaacatcgaaaaatagtcatgatggatctagttttgttaagcacttttttacgaacatcatagtgcaaacggattagaaaaatactatataacgtgagagatattgctctctaaagattgagatttacttttttttagttctcatcttgctgaaacggcgtagtaataggacgttcaatgtgcagtaacaggactactttcctttctgtagtaacaacgttataaaatagtcatgatggatcaagtttcgttaaggatttttgtctcaatgatcgtagtgtagtaacatgactattgtcttgttgtaacgttgttttaaagcattatggtgaaaacggttctaaaaaataatatgcgatgtgagagatattgttgtttaaagattagaattctaaaagtttacttgtattgagcttgctagatgtacttttaacacttgtgttaacttgtgaccagcacatgcacttttttaacacttgtacacaagattgagatttaaaaatttagcaatgtacaagcagtgatactgtagtagtaccg

SEQ ID NO: 51292 - DNA, 1567 bp, Oryza sativa
cggtctcatcgcgcgcggcgaccccatctcgcttagcatgcatgcacgcccaaacaaacgcctacttttgcacgctttcccgctgctcccgtttcgattggcgacgcccccctgccctgaccccggaccccggtcggacccttgcatgcatgcacgatgcctatgcattcattcacgtacggtacgggcgcacacgctgttgacctgacatatgatcaagcaatatatatgtcgatcgaataatttagcatttgcatgctagtagtacccatgccacccgtagcgagccgtatgtttgcagggataatatcgtatcatatcggagttggccttttgccaggcccaaacagtaccggggaagggaaaagagcttttttttttgacaaattagtccttttaaaaaacttattttcaaactaaccctcgcaaaaagctttaactagaaataggcatgggctcagcgccgatgtcattagcgctgaggtccaaagggtcagcgccacatacgttggcgctgaacccgtggccacgtggaaccaaaaccgatctgcataccgacgtggcacgagttaaaaagctcacaagtctaaactagcattaatgatattgtagtgtggtggtgtggcctctttggttgcaagctagaggtagcaagttcaactccttcaattagcagaagttatcaatttttttgcaacttttttaccgtccttttctttaggacccctttttttccccaagtttactgtcatcaatttttttgcaacttttttaccgttattttcttctggaccttttgtttcccaagtttactgtccagctagcaaatcttcttgagcacttcccccagcggtacaaaccactttaaaaaagcaaatcgaattcttaaatttgatcccggtgttttttccccaagtggttacaaaaatattttgaaataatactgtaaaaaaagagaaaatattgtgagaaaaaagaacggaagtatactatatattccgaatgtaccgttggagtatatatgtcggaaatagtaacgtgggaaaaaataatggaaagtattacatttatttttgaagtatgcttattgatgagaaaacatgcaaaggctcccatcggatggcttaatcgccaaagcgaaacccaaaatttaaattttcaaacattttcatcatagtttcttttacaacgttggcttttaagtcaccaataacacatttataaatagtttcatctacatattcatttttatttcctaataagccgttttggcttattaggaaataagccaaacgatggggaccataatataagaatacttcaaaaataaatataatacttcaattatttttttcccacattactatttccgacatatatactcctacggtacattcgaaatatgtagtatacttccgttcttttttctcacagtattatctccttatttttcttacagtattatttccaaatgtttttttaaccacttggggaaaaaacaccaggatcaatttaagaatttgattagctttttaaactgatttgtaccgctggggaagtaccggaa

SEQ ID NO: 51293 - DNA, 1221 bp, Oryza sativa
  unsure (1)..(1221): unsure at all n locations
ctgcagcccgactaatttgtcaaaaatagttaggtatacgtacgtagtaacttgctatgataatccgtgcatgtattactcgtctattccgccccgtggtggtccttattgttccttgcttttgccaaagtcgtcctctctggcccgtgtcgtcgtcgacagtcgccatggtcactacttatccttccaaaatacttgcccaggaaaaaaatattttgctggtcgaccaaaccacgatagtccccggtttaaaagattatntttagtcccggttagaaaccccacagccattctatgatatttagtttcgattgatgccgggactaaagatcattccctgtcaaatgcatgtcagggggcctaggatctttaagatcaccactttagtgccggttggtaatactaatcgagactaaagatatgactaaagatcatatctttaatctcggaactaaaattcaacgtgtagtatataatccctatcacttatcctctcctccacaatcgcaaatcacacagatcgaatctctccccctcctccttccccttcctgctcccctgttatacagatcttctacagatcagatcgatcctctcttgctcatcccctcccctctcctccacctcctcctctctcctccccctcctccccttcccatccggcagccggcggggccacgcccggcggcgggccggcggcagcggcgttgttttctgtctttttttttttgataatttgtgattcacagagatgtataattttctgattcattgtatcatatggatatgagatgtataatatgtgatgtatttgatttgtgtgtaattttttaggatttgtgatgtatttgatttgtgtgtataagtaacttttaagatttttgatgtggatttgggatgttactttgatttggggatttggggatttggggtttgatttggggatatgcatgccatttgattcgggagaaaaaaaaaggaaaatgggaccatttgggactgccgctattctctacttacttccggttagtaacatcaaccgggactaaagatccctctctttagtcccggttgctgttaccaatcgggactggatctttagtcatgcccatctttagttccgaatttatactcccggttgaaatcctgggactaaaggggttatcagccgggagtaaaaatggtttttccaccagtgttgtcttccccccattcaaaatt

SEQ ID NO: 51294 - DNA, 2964 bp, Oryza sativa
cccccctcccttccaagggtcaaacccccctctcacctcagttaaagatcggtcaaagcacccccatgtcggtcaaagcccggtcaaaccacctaccaattccccaccacccacctcttttcaggtatcttctcgcggaacggtgcaataacgcgacagctatcgtgcagtaatgttgtgccttacgtgcagtaacaacattcaaatttagttgaaatatagtcaagatggatctacttttgataagcacttttttctaacataatggtgcaaacggtttaaaagaatcatacatcacatgagagatattgttcttcgaagcttgggttttttggatcacatgatagcattactactcgttactactatctgttgtacgttactacaatgacatcgcgatgttactgtagtgtgcagtaaagaccataacatttgtagtaccaatgcgtcttactgcaattcttgaatagcgttactgcataaacatatgtagtaatacttccactttgttcggtaccaagtatatttagcatgtgagacttttaacccttttttttatttttggtttactacaatttcaccacgatgttactgccaaatatgcagtaatgttctatatgttctactgtaacaaagtgtgttactgcaattctggatagtgttactgcataaacatgcagtaatgtgtaactgtcaggtggtaacgtgtatatgccgtgcagtaacaattttacttttgtgtagtaacaagtaaatagttagcatatgaaactttgaacccatatattcctgatttgatttactgtcaaaagtgtagtaacgtcatatacatgcatgcagtaacactatattagagggagaagaccggttttcttaagaagagggaggaagaacggtttcttaaggaggagagtatgtagaagttgtgggcactgcttgctggcagatctggacaaaaaggaattatttaattttcaacaacatccagctttcaatccacttgtggaggattggtttcaaagaggatttcactcttcttatgcatagagtgaaggaggaagacaaacaaaaatatcaatcatggaaagactcaattttctagatcccttgtaaagtattttttttcttttttttctctcttttgtaaatatctttatatatatatatataatctattaacacagtaggagcctctcctactgtttctcatcaaaaaaaggagagtatgtagatgcattttgaagttctatcctccacatacagtaacactatagcatcattgtgaaaacggttttaaaaaataatacaaaccttatgagattttgcttttcaaatattggcattttgaactttaacactccatatgcagtaacagaatatgtaatttgcagtaacatgggtatatatatgaagtaacatagttttatcaaatgtataaaattgttcaaaacactcctacatcaatcagacctcactcaaagccacctacagactttacccatagcacacctattcaatcttcatcttgtaaaactgacatagtaaaactacgattatcgtgtagtaacataactacttggaagtggtaacatgcacctattatgtagtaacacttctacttttgtgcagtaacaaatatatagttagcatgtaaggctttaacccatatatttttgtttcgattcctggtctactacaattttactacgacgttactgccaaaagtgcagtaacgtcctatgtgttctacagtaacgtcacgtgttcctatactttcacaacaatgttactactggagcatagtaatatgttatgagtttcggtagtgaaagatattagaattgataatcatattactttctcacaaaattcttaaaacaaatagcatcattagatgaattggttagaagaatgtgctttgaactatgaggtgatgggttcaagtcttgattttggtaatttattttttattttagtactccctctgttacacaatgtgagtcattctagcatttcccatattcatattgatgttaatgaatctagatagatatatatgtctagggatggcaacggggccatccccaacggatagtgctaccccgcccccggacacttcaaaaagccccgctccccctccccagcctcggggctgactgctccccgcccccgtccccggcctcaaggctgacttttcgccgtccctatccccaactgggttctcggggccccatggggatacacacctgcacggctgcaccattggctagaagacattgcgaggagcaagatccccattcatgtctagcaggcatgcaactgaagccaacgaagctaatgaaaatcaaacagaaaggttatgcggctatgcacaggcgccaatgaatcaaattaatgcattctatataaaaaaataaagaaatacaaaggaaaatcaaagaaacgcatcaagtgttaacatccatggaaccagttgaagttattcatgttcaaatcttcgaccgggactcggtcggtggcatccgcttgctagccctccgttacagtcgagatggctctgataccaacttgtcacgcccggaaattcactagtaatttccgaacttatttgtgcataaaatcctcatccaggaatcagccgaggtacacaaactgacaatttaatatacagattcatcaaattaactaaaacgataagtacttacttaagaggcacttagtcctcaccatgaagaaaactgcagcggaaaataaaatctagcgaagctccggctccactcccacaggcagctcaactggggtataagccaaacgtcttctcctctggatccttattcttcaactgaggttgattgattattgcaaggtgagcatatgacatactcagcaagccacacagcaaatatgcaagtgcacaaggataccaaaggatggcataatataggctcatttgcaaaagcagca

SEQ ID NO: 51295 - DNA, 5194 bp, Oryza sativa
  unsure (1)..(5194): unsure at all n locations
ccgttgtccccgagaaatctcacaccgtttcctctgttttcaccgccgaagcaaactccgtcctatctctctccggtgatcccctcggtgcacaaagcgatttctaggtgatctcttctccggccaaatttccgcccgcggcgatgtcgacctccaccagcccgtctaccgcgccatcagccgaatacgctgaggtatgtgcccatcagcagatccctcttttctgcacagtagattggttttcctcatctcatcttgttttcttctctattccttctggattcgtagcacatttccaatctagttgcaattccaagtctatcgcatgagagacattatttccttggtctgatcggcaatctcgaccctactgatttcatcattggcgaaaccaatagaatccctttcaaattggccaaccctaatctaggtcattggaagagcaccttcaagtcttggccatctcttgaaaaaacttgtctgtgaaaatcctccgagcaggggccgagctatccacattggcacccccagtcactccccacccccaacctagaaacttaggggtgatatttgtcaagcccagaaattcactagtaattcccgaacttatttgtgcataaaagcctcgtccaggaatcagccgaggtacacaaactgacaatttaatatacagattcatcataaaaataacgttacatacttacaaaaaaaagaaactgcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaaaccacacaacaaatatgcaagtgcacaaggataccaaagaatggcataatatagggctcatttgcaaaagcagcatttagcaaacagttaagaattgtaaaacagtagagtaattaatcatcaatattaatcaacactgaacaacgctgcacaggcccaaccatcctgaacaaccatacccggctgtacagatctatctccaaaccaggaatgtaccattccaaaccaggagctaatcaaattattactagttatagcatcattcattatggtgagaagtgtgagactaatcacaaaagacattgttagacccgcccataaccgcgggcacaattattcgaatagttttactctggccagaggtgtaccactgtatccacaagacacgattccacacatgttaccatgccctgaagtaccaccacggcactgcaaagggggaaatcgtgactgtacccttcgcacaacacaactcaccacattgcaccattcccggatcatagtcacccccttataaacaaggtatggactccccagcgacccccgtgggcttatctccaccacttctcaacctggtgctctgcaatgaaccatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtaagtcataagttatcccaatagtgtgctaatgtttctaagcatggctaagcaatcatatctaatatctagctgaaccaatatataaagctcaactagtcaagttataatatcccaaggtatcaaggaatagagtaatcaatgcaaacaggccataacaaaggaataggttcacaccacccggtgacatttgaaaataaatgcacagttgaaataaatagagaatttaaatataggatcaacatgctcaaaggattgtgtttaggatctgtgtgacttgccttgcaataatcggtcttcaattaatcttcttgaatacttctggcgcactcgcgaaccttcgccacgacggaaacgacaagctaacacgcaaaacgaggaaaaagactaataaaaaccaaataaacaatacataaaaagtaaacaaacatgtagatcataattttagatgaattatgagacttgaacggcctcattctgacttaatatgaatttaatatgaattttacaagattaaatctaattaaagcccatttaaaaagaattaaataaatttaattcaatttatggacaattttaatatgtagatctttattttatataatttttgcaacttgaaccacattaaactgagttcaaatgaattagttatgaattttcaaagattaaatcggattaaaacacttatatggattttaattgaattatgacgcaataatgaattatttttgaaaaggaaaagggaatttattgcgtcagcggctagggtttcgcggtggaccgggcgcacggcggcggttcacgcgaacggatggccgagatcgatccatccaaaacggacggccgagatcgatcggtccacaaccggctcacggaaaagggcaacaataacttcggcaataacgtcaccaccggcggcggcggctcaccggctcgaacggcccaccctcgccggcaaacaacggcgcgacggcccaaacggagagcaccaacggttagagcgcgacgcggcgaactcaccggtgaccaaagcaactgctggatgagcaacggatggcgcctgtgacgatgaagatacngcggcggtttttctggtcgactgtgacngcggtgctccggctgtctccggcggcgacgaagaggcggacgaggacggcggcgacttggcgaccacgatggcgacctgcccgagcgacgacgacgaccggaacggcggcggcgcatggctggagcggcggcgacgacggcggctcgaggttacacggcgctagggcgcttccgacggcaagagacgaaggcgagggtggcggcgggtaaaggagacaccggggatccttttaaaggggctagcgagctgcgacggaggcccacggcgaccggagacgggaaggaaaggttagggttcggaggaaagaaaccgatccgattcgacctcgaatcctcgagtttccaaaccgaattaggcgattattccataagagaaaaggaagaggagatcgagaagatcatttcccctctattgatttccccggatcgggaaaggatcgaccggatttggaaggagacgacggcggcgcgacgctagggttcgagcggcggccggcgcgaggaggaagacaggcctgacaggtgggccccacctgtcagcggcaccgagagagagaagagagcagcggctcgagctgggccgactgggccgagaagagagagagaggaggttttgggccggctttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacagattaaaattagatcttctcttctaggcttttaaaatcatttctaataattccttttaaacaacaatttataatttaaggattttaaacaagaaaagctcttaacaaatataattagatcattaaaatcaaataattactgaactgttctttgtatcatttaggaattgagctccgaaaaatccgagaaaatttcagagagttgacttaatcatggagaatttaataaaaattaaatccatccatgctttatattaaggaaattttatttcccacatttaacttcacttgtaaattaatgaacatttaatataacttctaataataatttattaaataatttataaatcctgaaacaaaaatcaggatgtgacatatttggtccctcagctgcggcggtgagctttgagcaggcgacggcggggctgcgagcttggaagcggcgatggggtgacgcggacgaggccacgcagaacaaggcggcgtctcgcgccctcgccctgtcgcctggtcgattggatctgagaggagggggatgggaagactgagaagtggagacggtagaccagggtttgctcagattatatatgtggacctaattgggccagtctaattgggttgtgggcttaggaaatatagcgtggcctatccacctcggggacccatggggattcggggcctggggactgttgaacggctccgcccccggcccacccgatgagggcttttcttttttgccgttttcagccccatggatggtagttttagcccatttacatcccctaatagagtaattccccaccgggtgtgaggtgtcggggccccattgccatccctacttgcaggaatttgtaccagccagccaggtttatcgtccaattgaccacacgatcacaatcgaaactttggaaggttagtatactacacccaacttaagtgtcgatcaaattttattgaatgattctttaagcctctttagcaattctactagtaatcttacacgtgcaatgcacgtcttgaccaatatgaattaagtccagtgtaatacaattgtaaaaatatgttatatcaaaaatcaaatttacggtggtatatcgtccaaagctaggatgggcatttcaataagccaatgtaagtgtatacgtggaatccacatatgtaataaaacaaccaatgtgtaatatttgataaattataaatgcaatgagttaagaaacaaataaacaacaaatgtactatctgcattttaaatatatgatattgttggcttttggacatttgaatatttgtctaattcaaaattttagtatgaatacgcaaagatataaatataagtcatgcttagaaggacttttaagcatgacttaaatttacataatttttagattaaacaaatggtcaaacgtcacgtccaaaaatcaacaacgttatatatttaaaaaggaggtggtaatttcatgcatcaaggtgtgacatcaattttttttaatctgccccatttagtattacaccattcagaaatcttggtgtaaataaaaattgttcatgttgcgtacataaattcttattgtttcctatgtgaaaagaggggcaataaaac

SEQ ID NO: 51296 - DNA, 2178 bp, Oryza sativa
  unsure (1)..(2178): unsure at all n locations
cccttggtaatcggtggtttcacccatataatcccataccaattggattaggctattacctatcaaggggcctgaaccagtataatccctgttttctgttggctccatgtggtactaggtagatcttggtaccaacataccccaataccatctatatccggtctacgggtatcccccgtcgacacatataatggtatttgagcaatggcaaacccctgaaatatgtgttttgcatgtcattcaccgataaaaaaagatgccaaattagtgttaaaaaagacatatattgatgatcggccgtatatatgttacttgcaagtatattagttcatctgtcaactacctaaaaaatgcaatcaaacttttgggatatgtacacacaaaagaatcaaatagcatgaatagtaacagcacatgggcaccctttgtggagagtgactcgctaggcgagcagcatgcccatagatgaattcaggaatatagttcgactcaaaatgtgatgggaaatatggaaaaaggaatttcttaaattgatagctgctgacctgatgttccaagaggaattggataaaaatcaaagcagtttggtaaacatataatttagttcagcaattatatataactaaacattattatacagctaaaccattcaattgctatgtcaataatcagtaggaattttgatgattagtaccattataaccccaaatcaacggatctacccttcaattttcctcactgaacaacctcgaaatatgcaactcgctagctcaaaacagttttatgccaacccaactaacttggtgactccagtcccaaccagctcaaaatagcacggtagcacttgcatgagaataaacagggaatctagaaggatccaatacctgagtgagatgatccccggccaacccaatgggcgcttcaccttgtgaagaagtgcacaaatcacaagttcccaagaattttgaagaaggtttggcggaccgatggccaaacttggacgacgcgggcacaaaacaccacggcgccatcggggaaagtcccggccaaggctctagcggaaagnggatgcgtgcggcgaggagtcacggcagcggtgcgctagtctagcggtgcatcgttgcagatctgtcgcgaggaggagggagcatgctgcagagcgaggagacgaggaagatcggggggcggagtcatcgggcggggaattaatcaacggagttggtggaatcccttattaatagcatacaacgaggaagataacggacggattagattagattagatagtggatacacagattagaagacaggggatgatttcacgtgtaagattgctagggacaacttctttttatattagtatatagactagaaaaattgcccgtgcattgcaatgggtgaaggctattttaaatttaataataatggacgggttaggtaaggttcaaatcaatggtaagaattggttggaataaatatttttttagaaaatcatgagctgcaattaggagtctgatcatctcaagttagcatgtaagttttttttaaagcgacttcttatacaactgcttctgcattttcaaaagggaacgaacttaaaacccgactcaaatacagatttgtatttccaaaagcgaacgaatttaaaaaccaactcatacatagatgatgtaccaaagtacggacaaaaacatctttaatttttataatagtttcactgtgagaattcgcttgtatatatgttttttagaaaatcatgagctgcaattatgagtcagatcatctcaagttagcatacaagttttttaaaacatattttttatatgactccttctgtatttccaaacgcgaacggatttaaaacctcactcaaatacaaatctgtatttctaaaagcgaacgaacttaaaaaccgactcatacacggatgatgtaccaatgtaccggtaaaaacatcttcaatttttataatagtagagatatgctcaattggttcagtttagtaagtctgaatttcacatgaattttatctgaattctatttgagtataatagtagagcttatgatgttttccatgcatgagtaaatgagtaatatgaaagttctgctgaatttgtttctgtaaacctaaagaaagaaacaatatcgacaatcttgtacacggaggatcaacgggaaa

SEQ ID NO: 51297 - DNA, 1606 bp, Oryza sativa
tccagactttgaccgggtatgcttactctttgggtgaacgtgaagcttatattttgtcatgccatcttaagtttctattttaataggcctatagtctaacgttactgattttaactttttgtttatgaagattgattggcttaacaagtttgtcgaaaacatttggccttatcttgacaaggttggctcatacaagctagtgcaatattatttgtccaagtttttatttggcactgttttgtaaatattgtcttttacaggcaatatgtaaaactgcaaaggaaatcgctaagccaattattgctgagaacactgccaagtataagattgattcggttgaatttgagacattaacattaggttcattaccaccaacatttcaaggttagttctactcttatatcttagttgcagacattttggatcaatttaattacacagaagtactttttagccaaaagttgctacatcgtaaaaagacttttcatgctaagaatgcctaactaatttgatcaagtaaccatggaagattcagatccacggctaattgaaacaactatatttatgaactttatgtgaaatatcacatttttgttgaagagtcagttatgaaactacatagtcctttgtcagaatagaaagagtatggcccaaagggccagttacacttagtttatattatttttaaagttactttattgaatttatagcttatgtgccaaatgtgagtatacctagcaacagcaagttgtttaggtgtacattccagtcttacaactctgttagcaaccgagacttccaatctcaattccactcaaatatgcaagcatccagtgcaatagcaaccaaactccagtaaatagaggtggagaggaggatgaactaagggaattcaactggtggaagatgccagaaacttctggaaggaagaggaagaaggaaggtagggaggaagaagatcgacagggccaaccggccaccaggtcgccgccaccgttcgccattcgccgattgctcgatcgatctccccctagaagtgcatactctgttgttttgtagttcctctcctctcgggctaggctttggaagcgacggagccagcccagcccacttatgttcctaacaaactcatgttattggccctactcttgctcaagcactcaggcttctatctggatttggattatcaataatcactaataaaatgaaaccaaaaataaagtaactgcctagcttaacttaggcttccaatccaggtaaacctatttgaagtttgaacactcatttccgcgtcaatgagaaacgtgcaggattatggggccaattaagcacttttgtgataaagctctcttcgacctaccttaaaaagaaaaaatgtatgttagcggagttatagcatactagcatatggcctgtgcgtggcaccggatttttaatcaaaaaaaattatcattaacatgttattaatatctcttaattgttgaacatatttgttaatcacatgtggacctttttagtcccgcataaatcctttttccttcccacgaaaagtagagagttggtgggagtagttgagatgtggcccctctagccccacatatcattt

SEQ ID NO: 51298 - DNA, 1807 bp, Oryza sativa
actccactaaaccactcgcagttttctgcttaagtgcctattcatccggttttctttgattattccactactacattttagcctaaattttcacctgtctactctaacttaatctgtggcgttttttcttcacaaatgttgatggtgacatgtcggcaactgttgacttttccctaccttgcaggagattatcaagactcaggtagcaaacatgtacttgtggccaaaagtacttgaggtgccaatcatggatccagcaaagtaatgcatgctataatctatctactattttgcaaggcatgtccttctggttgctaatttggtatcttctttttataacattgaattgaagagcacaaaagaagcctgttggaattttgcatgttaacatcgtacgggctgtcaaactcaccaaaaaggattttctgggaaaatcggatccatatgtgaagttaaagctaacagaggaaaaactcccatcaaagaaaacgtcagtgaagcgaagcaacttgaaccctgaatggaatgaagatttcaaattagttgtcaaagacccagaatctcaggctcttgagcttactgtttacgattgggagcaggtaatggttaataattttaaatatcctcctgagctgtttaatccagatgctttcaatcctacataaaattttcttatcaggttgggaagcacgacaagattggaatgagtgttatcccattgaaagagcttattcctgatgaggcaaagtcacttacacttgacttacacaagactatggatgctaatgacccagcaaatgacaagttccgggggcagctcactgttgatgtaacatataagcctttcaaggaaggtgattctgatgttgatacaagtgatgaatctggcaccattgaaaaagcccctgatggcacaccggaaggtggtggtttgctggtagttatcgttcatgaagcacaagacgttgaaggaaagcaccacactaatccatatgtaagaattgtgtttagaggtgaagaaaggaagaccaaggtatgaaaaacaggtttaaatgtgtaataaactttcaccaataacatttactgtaggaaattttgaaatcaatgggtagttttagtcactacattataaaatataatgtttgatcttgtaatactgtttatgcagcatattaagaagaatcgtgatccacgttgggagcaagaatttcagtttgtctgcgaggaaccacccataaatgataaaatgcaaattgaagtcattagcagaccaccaagcatcggtatacattccaaggtatcatttctgtgatctgattatctctatttgtgttgtgacatcaacttttagtgtttaaagattaatggagatttgtacttcctagttgtgtaatcctattgagaaaaacagctaagctataactagtgaacactattgctaggcacaccagttcccactgcaggacagcagctggtcagggaaaataaagttctatctgacaattctagctgcaattctaataaccagtacggggagaaccactggaaacttgttgataactgcaaaagcagttttcagcatctcatttcgttattttttatatgaagttattactaaattcagcctccaagtttgaagttgtttttagtagaacatttttttttgcggggaaatagaacagattattaacattaagagccacaagaaatatttgaatatgctaatttaaggaacaaattttctgtcgtgggaatgtatttaaaatcacgggatacattcactactttgcagggcatttaccccccg

SEQ ID NO: 51299 - DNA, 990 bp, Oryza sativa
ctatgcttttcattgtttcccccagattctcactggttggtatatatgattatgaacagaaaccaggaagcctgaactaattatggaattggtattctgtatgagaatcgatgaatttgtgttatttgtactacagcataacaccgagttttaacggtgcttgtcagtgcctattagaaattgtaggctactagatataccatttgtgcactactgttgcgtttgtacttttcaaatagttacaatatagctttaattatttttagaaagctaaaaatcaacagtgatgttatatttttgggaaaacagcttatagggatcaatattttattaaccaccagttttcgaatataaaccatgctagttttgtaaacttttttacgacaagcctgcttttatttttgcatatttgagtatttattcgcaactattctgtctatcatatttggggtgctcacttcttattgccattgattgcttttaaatttataggcgaaacggcttattaacaacttgaaaaatattttatgaataaaaaacttctatgcaagtgtccatagaaatttaaatgttaaaataaacttcaacaaaaaaaaaacctagaataaactaagttttaaaattcaaattttcacttatagctaatgactaaatgaatgtgtaaatatctgatgaaaatagcatataatgacaaaatagaggagtcataattatatacgtttcaatgctgtttagttattccctattgttacttgtaaaaggaatataacctagcactccatcatatacactatgttgtatgaaaccttagaaaccctactttttttaatggtattattaattctcagtcactgaaatttctatacatatagtcacttgatattgaacagtatttggtgaaaagttatagtggaaatgagtatgcaaatttggatagatctctgttatcaaatggatgtcattttataatgggtgcagatacaccttgaa

SEQ ID NO: 51300 - DNA, 7492 bp, Oryza sativa
cctcaatttgatgggacacattacgccgcttggaagcacaagatgaagttgcatctaatctctttgcatccaagtatttggaaagttgtttgtacaggtattgatgtacccaatgatgacatggagctcacctcggagcaagagcaactcatccaccgcaatgctcaagcttccaatgcaattctctccaccttgagtccggaggagttcaacaaggttgatggacctgaggaggccaaggagatatgagatactttgcaactggctcatgagggatcacccgccgttcgtgaggccaagattgagttgttggaaggaaggcttggaagatttgtgatggatgacaaggagacacctccatagatgtatgataggataatgatccttgtcaacaagatcaaaggacttgggaatgaggacatgacaaatcactttgtggtcaagagacttctccgtgcttttggtccaagaaatcccactcttgtatcaatgatacgggaaaggaaagacttcaagaggctcaccccaagtgacattcttggaataattgtgtctcatgcgatgcaagaagaggaagctcgtgaagtgaggcaaatggtgaagaatgccgccatgatcaaaaatcaagaagtagctttgaaggcaaaacaagaagaagtgtcaagttgtgaagaaattgaagatgaagagatggcttttattgtcaagagattcaagcactttcttcgcaagagtggctatggaaaagggaggaaggatgatgacaagggaaagaggcaatcaaagagagcttgcttcaattgtggcgaatatggccacttcattgccgattgtcccaagtcaaatgaagctaaggctaagggaggcaagaagaagctagagcgtgctcatgtggcagaggtgtggtactccggagatgaaagaagatctcccaggtcaagggccaagagctaaaaccaaaaacaaaagtttaaaagaagaggggggtttcgaccctgtcccttaaatgatatcctctaagagaagagagtgtcttttcacacttgagagaagtggggaggagtctccatcactacttttgtgttacggccccaagccccaaagtgagatgactcaaaagccctctcacatctctcttgatgttgattctagtgatgaggaaagtgataatgaattagatgatgtgcttgagagctttagcaaacccgctatgcaacatttggctaagttaatgagagctttggatagtaaagaacaatcactcgaaaggcaagaagaattgcttattcttgagaagaaaagaaaccttgccttagaggagagcctagctacaaaatgtgctaaaaatgaacaactagctaatgagcttaatttggctaatggttctctagctatccttagggatgtcaatgaaactcttcaagacaaatttgctaatttagacaaaagtcataaagatcttgaagttcaatttgacactctttggaatagcacctctcaaccaaatgtggtttctaatccttccaacccatctactagcaatgattgtgctaggtgttacaatattgatttgaactcttgtgctactaatgttgatgctatgcaagctcttaagaaagagaatgaaaggttgggcacattggtaaaatatggatacatgaagacataccattcaaaagatgccctttataagaccatcaccgctcatcctaacaaggatggacacgggctcgggttttctagtggaagtcctgtgtctaagcgtgtgatggtaaatgggaaagaatgcttgatgtttttgagagaaggtaaagctccacaagcaagtgaggtgacttgtcccttcactggtcagacactcggaagttccgggcaaaatgacgggaagttcctgccctgtaagacaggaagttccgaacattttgtcaggaagttccggacttctgatgagtcgaaggggctgaccggaagttcctggtataatgccaggaagttccggccagaaggtctttactatgatttatatgtaatttccaaaaattcagagggcaaagtggttgcttattttaatgggaattacaatgatgagtaccgcacttgtgtgtgggtgccaaaggctttggtaactaacatcaagggacccaaacttatgacgggagagaggtgtatgtttacaagtcttgatgagcagggtggaagtcgtgaaaatattttctttggagatgatggtaaaggaaaggtaatgtgtctcggtaagattgccatttccaagaatcagtctctatctaatgtcctccttatcaattcaataagctacaatttattatccatgtctcaattgtgtaagttaggatttaattgcttgtttaccgatgtggatgtgaccgtttttaggcgagatgactcttccatagcattcaagggggtgttaaagggtgatctctatctcattgatttcgatgtggatagagtgaatccggaggcatgcttgattgctaaatcctctatgggttggctatggcaccgtaggctagcccatgttggaatgaggaatttggcatcccttctaaaaggggaacacattcattcttggtctatctaatgtttcttttgagaaggattgtgtgtgtagcgcttgccaagccgggaagcaagttgggagtccgcatcctatcaaaaacatcatgactacaacaagaccactcgagcttcttcatatggacttatttgggcccgtggcctacataagcattggaggtaacaagtatggttttgtcattgttgatgatttttcacgcttcacttgggtgtactttctccatgacaaaagcaaagctcaagatgtcttcaagcgtttcgcaaagcaagcccaaaacctctatgacctcactatcaagagggtgcgaagtgacaatggaggagaattcaagaacactcaagtggagaaatttcttgatgaagaaggaatcaagcacgagttctccgccccctatgatcctccccaaaatggcattgttgaaaggaagaaccgaaccctcattgaagccgcaagggcaatgcttgatgagtacaagacttcggatgtcttttgggcggaggccatgagtactacattctaatgtttcatattttcgtgtctttgggagcaaatgctttattttgagtaagatgcctcgctcatctaagttctcacctaaggtggatgagggattcttacttgagcaagttgttgtacatattgtaggtgatgtggatccaagtcaagctataggtactaaggctattggagacatacgactagtcgagacgcaggatgaccaagaagatagggatcaacctccgtcatcaacatccaatagccctacaagtgctgtgtctgctgagccggaagttccggatcctattgaccagaacctccggacatctccaggcccggtagttccgggttctatagtccggaacctccggaccagtggcagtgaagacatgccaacggcgcaagtggatgggatcgatgctgcgagcactttagagcatactgatcaggcttagatccccccagtgcaccatccaaggatacataacactgtccaaagagatcatcccgtcgacaacatacttggtgacataagaaaaggggtaactactcgctctcgtgtcgcatgtttttgtcaacactactcgtttgtctcttctttggaaccaaccagggtggaagatgcgcttggtgatccggattgggtgatggctatgcaagaggagttgaataacttcactcgcaaccaagtatggactttggcggagagacccaagcaaaatgttgtcggcaccaagtggatctttcgcaacaagcaagacgaacatggggtggttgtaaggaacaaagcccagatagttgcgcaaggattcacccaagtcgagggtctcgattttggtgaaaccttcgcacctgtcgctcaccttgagtcaattagaattcttttagcctatgccgctcaccatgatttcaggttattccaaatggatgtcaagagagcctttcttaatggacctatctcagagttggtctatgtggagcaaccaccggggttcgaggatccaaagttgccaaaccatgtgtacaagctccacaaggcgctctacgggctccaacaagcccctagagcttggtatgaatgtctccaagattttcttttaaaaatggttttgaaatggaaaagcgggatattactttcttcattaaaaaatttaagagtgatttattcataggccaaatttatgtcgatgacataatatttggttctactaatgcctctttttgtgaagaatttagtagtatcacgactaaaagtttcgagatgtctatgatgggcgagttgaccttcttcctcgggatacaagtgaagcaagcccaagaggggaccttcatctctcaaactaagtacgtgaaagacatactcaagaagtttgggatggaggataccaaacctatcaagacgcccatgcctactaatggccacctagacctcgacaataatggtaaatgtgtggaccaaaaggtatatcgctccatgataggatctttgctttacttatgtgcatctcgtcccgacatcatgcttagtgtttgcatgtgtgcccgttttcaagcggaacctaaagagtgccatttgattgccgtcaagagaattctaagatatttagttcatactcctaatcttggcttatggtatcctaaggattgtgactttgagcttttgggctattccgattcggattatgccgggtgtaaggttgatagaaaaagcacaaccgggacttgtcaattccttgggcggtcccttgtttcttggtcatacaagaagcaaaattccattgcattatccaccaccgaagccgaatatgtcgccgccggttcttgttgtgcccaactcctttggatgaaacaaaccctacaagattttggctataacttcaccaagatcacactcctatgtgacaatgagagtgccatcaaaatagccaataatcccgttcaacattcaagaaccaagtacatagatatttgccatcactttttgagagatcatgagactaaaagagacatatgccttacccatgtgagaaccgagacccaattagctgacattttcactaagcctttagatgagaaaagattgtgcgagcttaggagtgaactcaatatcttagactctcgtaacattaggtgatgggtggttgtctaattcatagcaaaacatgtatcaataaaatgtaaattaaaaaaaaagagcttttgtgttttgagatcacttcttggtagaagatggtcttgataccaggtataaaacttaaacattccccctcatatccaaaaacccttttgtgaaaatttgcgaaaatttttgtgtgtgtttttattgcgaaaatttggtttttatccccgtcttgtgatgtatattgaccattgttatgtaatgatgattgttggctggtcatatgcatcataagtctttatatgtccataggtttctatttctaatcgttgaattctcgtctattcctttgaacttgggcctgactgccctctgttctgtcaggccggaagttccggtcaccctagtccggaacatccgggggtcgggggtataaatacccagggggagcccgagtctgttatctctctcctcacttcttctcctccgcgattcccaaaccctagccaccgctacagtgctcctctcggcgattttcacttccaaccatggaaatttgattcctctccgtggaatcaaccacattggtggctagaaggttcatcccgcgatcgttttgcaatttcctctcccaaggtagcacttttgatcctcacttttggttcatcatgtttttgccccgatctctaaatatgtgaacctagggagaaaaccttttggatagaattgttcctgctaccttgtagattgccgatctataggattttgtcacatgcactggcctgtttgaatcctctgtgctttagttttgcaggccggaagttccagtgttcttggtccggaacttccggtctctatccagccagccagcaaaccttgattcctccaatttttattttaaccattgcacttcaaccttgttgattcttgttgcagtggtcagtatgcctcatgagaagagacagaagctttcacaggatgttcctgctgactcgagtcccccggttcatggtcctaggaggagattgggcaaagaaaaagttggaaatttttacagtgggagtcaaattcctattcattctaggagggctggtagcattgtcattggtgatgctccccgctctccctctccagttgcatctaagtcagatgatggtggcaatgaggatgagcctagttctgagagcaatcctttgaggctttacaagacaagggttgttgatcctgatcctagacgtccaagtgtgaactatttgaagaatctgctcaagtgtggaatggacagaatggtgagtcctgacacaatgcctgctgactctcaggatgacagattcaggaccgtggtgcaagttgattggtataattctgtgatcatgggaagatctcatccagtggtagagatgaagtggctagactggcagtacatgtccttaaagaacaacttagttttcagtgaggtacgcaaggtgtgtgagcgcaagcacgtggcagatctgttggccttgcagtattcctggaatgaggaagtcattggtcagttatactccaccgctttctttggcaccaccaagaagggcattgaatttgtgaagtggaccattcaggggcagcagtatagggtctctatggcacagtttgctgcagctctggagttagatgatgatgacctgagtcgtcctcatatctttgtagaaaatgctttgtcaccgaccagcactactttcctgtatgagaaggatgctcccaaggattgtttggggactactcgtgggttgcgtccatactatagagtgctttattctatcttcaggtggtcattgctccccaaagtgggagatactacagcacttccagataggcatgcgctcctcctcagtcgcatacgctacaacaagccagatttcagcatcatgaagcttatctggagtgagatatatgagatagtgtgtgaactaaagaggggttgtatctatgctccttatataatgaagatgattgaggcaaaaattgggattagttatttcaaggacaaccagcacaagccttttcgtcctcatgttccctcctcttcagctcctccttctaccagggcgactcgtgcttctacttcagctgctcgttcttcctctgcagctccacagcgctctgagtcttcttcccccataaagaaggctctccgggctatcttttgcatgtgtgctaagacagctaagaaagtgaagaagatagagaggcgtcaaaaggaagattggattgcagcaggcaaggatgtctct

SEQ ID NO: 51301 - DNA, 1681 bp, Oryza sativa
tgctatgagtgtcttatttgttgtttgtgatgtgatgttgattttattccttttaagtgctcattatgtcatatcatttgcatatcatatctattcttctgcttatttgcatcccacgaatgagtagggatgaaggaaactctcctcggttgctcccttatatatatgcatatgagtttcacttgtatcttccacatgcatatactaaaggggggtttcattcacctctaaccattcaaaacaaaatttatatcaatctcttgtaagctttaaccatattgtcatcaatcaccaaaaagggggagattgaaagttcattaattcccctagtgggttttggtgattaatgacaaatgtggttaagggactaatgagttcattgagtaactttcaggtgcattagtccaaggtgtggaagatggaagcttggagacccccccaaaagtataaaaccaaagcggaccggaactcgagaagtgcataggatagtttatgtattgcaatcgagtttttaggaaaaaccgtacaattaagaggggttccaggtgatgctctgagatatgtcaagtgctattagtgtgaaccaagtatcaagtttccctaggagtcatttttgcaaatactccatctgtccaaaagtgcaagtccagaacttcctgtcttccaggtccggaagttccggtcttgagaaaaagattttcctaagtgtagtccggaagttcctgtctttcaggtccagaacttactatctagtttccagttcaaaattgtgagtaacggctagatgacatcacctagccgttatacatatacagctcgtttccagctcgttctttagccattccactttcacatttcaaacctagagctgttgctagcctctcccaagtgttttttgccttctccactcaatctagagcctaatttttgtgagagagagattgagagggagagaagaagatttggagaggtgtgaagactaggatcttgggtgagcacttggaatatctcgtgggttgtcatctcggtgcttattactcttggagatgatctcctagacggttaggtgtggaccgcgagtatccgttgtatattgtggatgtcccaggtaagtttgtgaaggatcccctctcctccgaaagggaacgaggtaagttagtgaagttcttatgctgagattctagaggctttccaagtagagcaacccacacttgtggcggatttctagaagtaggttgagttggatcttggtggtcactcaattttagaaatttgcctaggggtgtttggggttgaaggctgtggatttcctctggggtttttgcacaagtgaggcaaggggttaattgagacccagctctttagagctcctcaacggagagtaggatcgcaagatccgaacttcgggaaaaaatcgctcttgtctctttctgtgatgtttctgtggatgattctgtgatctatctcctacttagaatacctgtgcatcatcttgataagattggcttagtctcctgtttcgaaatttgaatttcatcttcaatctgtaacccggaagttcctgtcctaagaacaccgaaagttccgggcctggcaggccggaagttccggagttccttaccaggaagttccgggtctgtttgaattttaccgctgcgatttgtttttaagtttttaggga

SEQ ID NO: 51302 - DNA, 4636 bp, Oryza sativa
tgcttcattctgcaaaaagcctagaacaaatgacatccacaaccctactcataggcttatgtgacatccccaacccatttaggattaggcctgtgtggctcgagttcgccttgtgttcttgctctgtctgtggtcatgaagagaggatcactcgcctattcaagaagggatcaagctctcaatcaagctatcaccaagacgagtcgggtacacattcatccgtcgatgtttcgatggatgatgcggacattccacccagacttcttagtgactccgatctcgatctcatgggtgagcgagagatgcaagcctaccatatgctcaaggataggtcgtttgctcacacccgagcatacgaccctgaactgcttcgaaaggtatgtatggatcttgatttccgtgaggtttggaatgggtaggatgggagaaatttgttgtggtagataagcctggttctcgtttgcttagtttgcaatttccttgtaccttgctagaggtagccgatggcatttattttcagtttttctgtaaggagtatcatctttcttcgagagaattaagtctacttttgggttttcaccataattgtaaaatcaattttcggaatgcaacttctgcttttgaaaaacacaaattttgggaagatatttcggttgcatcattctgcaaaaagtctagaacaaatgacatccacaaccctagtcataggcttatgtgacatccgggccaattaggattagacctgtgtggcccatgtgagttgtgagcgcatgtttagtaccaccttgctagtttagcaagagtggaaccatcttataagggcttgtccctccaaccatatcactcccgggttaacccttttacaggaagcgaggataaaaatgtaagtggggtggtatgtgtaagtgtgcccgcctgtcggataggctggctacgcggtactagagggagggttgttacaaatggtatcagagccgatcctcgcggttgcgcgtacgggtcaatgtgcgggcgtatggcgcatgtgggctccatatggcgctggcactggacgtatagacgtgcgctaagaggggccgtattcttggacatttgcctatattcccgtgtggctacatgggtaagttgggcgacggggatgtcgagtcctttgagagggtggggggggtatgtgacatcccgaccaaattaggattagacctgtgtggcccatgtgagctgtgtgtgtatgtttagtaccaccttgctaatttagcaagagcaaaacaaacttataagggcttgtccctccaaccatatcactcccggcttaacccttttacacgaagcgatgatggaagtgtaactggagaggtatgtgtaagtgggcccgcccgtccgatgggctggctacgtgattcttgagggacggttgttacagcttatgcataaatggcttggcatgactttattccggttgttacagcttatgcataaatggcttggcatgactttattccttagagctgatcttagacccattcatgaggatgagttgattatcttgttttccatggttagaaaaattaaggttactcctgtgcaatgcatgatttgccagtggttagaaaatatcaagtttactggtcctattgaatgcacttctttaggtactcgcatagccaatggacttggggttatacagggtaatctaattgcctatatttccacaattcgttcttatgttgatgaagcttatttagtgcaaggtcatacagttaaccacgggccagataatacacttgtgtttttctttcttggctatacaaatgaatcccgttacctaacccgaggtatcatttgtacaactgccaagagctaaccatccttttgcagacgatagaggattttcgtgcaggtacttcgcatagggctacccacaacatggcatgggaagaacctgaggaatcaacgtcttcaccaccagtgatgatgtgtgaggccgactgggccccaaccaaggatgctcctggttggacccaagttccataccacgacgccggaagtttggcctggcaaagcgcgattgacagccggtggcaagcgcctcatgacacacactgggggcactctcgttcttctagttccattagcatgcccccattctccaggatgtggagctcaagttcctctcgaggaaacctgggtaagctcactaggaggatgggcacgctggaactgcaagcaggagaaatccagtacacgctcgaaggacacatagcacaagcacataagtggcaggaaaatattgatgcatgactctccaaatttgatgacatgatgcatcaatagtaggccgacttgcaggcctactttcgccatcagggattctatcctcaccctggaccctgagcaacaagcaagcttgggggagaaggcctctctcccgctaaggggacttgtatctttccatttcccattgcatttatatctagaaaacaacataaaaatttgaaaaacataaaagaacaaaaatataggttagattttatcatgctaggtaagactgcttagatctgtatgttgaaatgatgaatattggctctgtttaatatctcttaaggattggttcatagttaagtattgtctcaacttttaagtcgggaaggccaaatattatctgggaacctgagagatgtgagttgcacattgcatgatctgagcctaagttgttgtgagatatgataaggtaaaatagagttactataatcttgttctgaatttgactgcaattccggatgtttttatttttcaaaataaactctaaaagttcctcatttgatataaattcctaccagagccaaatattattgacattgcaaaatcttatattttggttgcttgcacttccattgaactttgtcaacattttgtgacctgtgttagatccttctcatactttttgatcaagatcacacttccacacatatgttaaactttatgatcaagctagcattcatttcatccattttatccacttcatctatttgtcatccaccaaataaatactccatgatatttatgcctcttttttctaaaagctaaataaaaagaggagagtggctaaagagagagagagagaagaaagagagaagaaaagaatttgtaccaatacaaaatatggggcaaggactgtctcaaaatattcttcttaaaagaaagagttaggcaaaaagactctctctcagatgctttcaaaaatggagaaagaggtatgcaccaaggagtaaattcatatatcccttccattttcactaccatattccacacacattttgcacgatcttgatcaaaggtataatgttttgctatctgctttggtctggatttttgacttagtaataaatgtgaatacaagtatgtgtcctttgatccctaccatactccacatatatgactttagaataggaatcaaaatggcaacatcttggtgaggaatatgcacttatacaatttgagtgattgagagaatcatttgaggaacttagtttttatttacaaaatcatttgaaaacctccggaatgaaagttagataaagaatgagtgattagtgctctaccaactgttttgtctcccaaccgctcaagataaggagaagcatgtgtcccacgggtattggccgtatgggtaagccactgtgcctacttacttaacttgactgagaatactcatactttacacctgcacctttgagatatacatcatggtagcaactcctgatcaatacttaagtttgtttttgtgaatcctttactcgggacgagcaaaggttcaagcttgggggggggggcttgttgatggttgttatagacgaatttcgaccgctaatatatccaaaataaaggagaactagccatgcttgcatgcatattttgtttaagaataatcaatctccacttgtacttggaattttttttgtttgcagagaacttacataattggaggagaatcgatggaaattaaccgaaccataaatcgaaatccgttgataggtagacttatgggtggatgggcttacaaatccagtgaaataacaccaaacgggtccaaccaccacagcactatgccctcctggtgtttcgagagaccaccccagattgccgagttccttacgacaatccatcatggccatctgaccggaaatgaatacggaggagtacccatacagggaaaatgtcttaggattatatacggacgtgaaggaatacccgtactgagctgtcaccatcagcagcccacctctggtgactcgttgcatataacctcaaaaaataatgatatctaataatctaagcaccacacttacacttaaatggtgttatcttcgctggcggtccactttacccagccaccagcgaggatcgatcttcactggcggtccttatccccccacccctttgttacattttcacaagcgaatctatggtttggtcgccactgaaaattatattgtgctaccatgaaaaacccttttttgtcgcgattggaaaaatacctttttccaatctctagtgccttgatctccgtcctaggaaaaaccagggtacacttcaacaaacatgatacaaaagccaataatatttacatcattacaaa

SEQ ID NO: 51303 - DNA, 2818 bp, Oryza sativa
cacaccaacttgccttaacccaagacctacgatgagttagatcgaaccgacagccttatatagctgggccccagctcatcccaagtcaacccaagccatccattccaggttttagttgattaaacaagttttaagagggaaaccactaacttgcgtacattgctaggattgctcataaccaagggcatggctattcgaatagattatactctgatcagaggtgtacatctttacccacaggacacgccttcctaacgtgttgccacgcgccacataccactacgttatacggacggatggcatgacatagttcttcactcatcctagccttgaacaaaagtaccgactcaacgctcgcctacggccagggttcctaggataggtaggttatggttaagctccatggcatcaggacatcctttggaagtgaccacccggatgcccgtcatgtgccacaacatctcgactaccgaacacccgcacgtgtagccttcatttgcctcagagatatctatcacccaacttcatccatctctatatgtgtcatcctgttcatgactagactaagctacaaactaagcctaacccattagacatgtggaagtacggtagtgctttgcaatagaggctcaagattaattcttatatttggcggggtgctaacttcccacaactggcatgcactcaaaccccactagaaaataggttttaggggttttgaaagagaaagagagtgccatgttcaggccaattaatgttatggggattaatatcaccttggaaatgtggtgaggaaatctcaagttaaatagggaactattagagagcccctgttgaccggttgaggtgatggtaggattgctacatgcgcgcgcatgcgcgcgcagaggcgatacaaagcgaggcaggcggttgctgctactcctctctctctctctattttgtaacggacgggaattgaatcgacgttaattcggctaatcaattacgtaacggacgagaattaaatcgatgttaattcggctaatcaattttgtatgaatgagtgaatgaattccaacggattgatttcgctattaatttacagagttgaatccgattagtttcgatttaattactcctgaacgagtaagcactatataatccgccacacccgttcatcctctcacaccatgcttcctcgttgtttcctctccgttttgttcttgcgctagccactgctttccccggtcctgttcacctgcgcgcacaggtaaacgggacgagcaggcctccagaagtccgtcctcttgtgtacctacacgagtaggcaggcgatcaagtttttggggagcgctctcaggtgcgacggctctgtgttatctacgtcaggctctgcttcccctacgtcaacatctctgctgctgttgctagaggtggcttaggcgcaggcagtggtggctctactggaggagactgatccgggaacgtcaacaccaacggaggcaatactgcctcatcatctagcggaggaccattctctaggtatacttccactctcctattgtcactaggggtgtgtttggttgcctgcatggtacctggctcgcatgcatgcgtggatgcagtggatggtcgtttggttgcctgcacgtagctcccatcctggctgagtggatgcaaaaatgccccgttagccaggctgagcaggaacgctcgatttgagcttcgctgcccagccaggcccgcgcgatgcattgcactgcacccatacatgcagcattgcacccacgcatgcaagagcaggcattggagttaccaccctgcccctctccccctcttcattctacccaacaagcaacgagactatggacatggcgaagaggcagcgaacggctcgaaggcgacgaagcttgacggggggcacaacgacgagcacaacagctgatccgtcctgctgctgcatccctcctcctcttcatgccgtcccccaaccttcaatcgccgggcaccgtcgtctcctatctttaatcactggcctccagatctgatggagcggagcggcgagcggcgggcgaatgggagcgtggggagatgggtggagtggtgagcaacagggggaggggagcgacgggaatatgggcgcatcggtagcaggcagtggaggggagcgacaggcagatgtccgcatcgacagcggcgagcggaagggagttgctgatggcgacgaggcaacgccgatcccctttccctttttttctctcgttttccgctttcttttttctttcggtttttctctcatataactaaacgctgtatgtactactaatgatttttatatagacaagatagtgattttccagatctaatattatataaaagattatctaattttttaaataaaaaactaatataattatatatatatatatatatatatatatatatatatatatatatatatatatatatatggtgtataggtaatctcacccaactaaatgaataggtaaccgcactcgagtcaatacaactaaccaaacacaatctcttccaaaccgtatctctcatgcgagtaactaaatacaatctcatgtcaacctggctagactaatgtaaacaaccaaacaactgcatgtgcatgctcagagataggtcaaattcagcctatatgagagagatgacccttgcttaggggatgcgagcaaccaaacacacccatatatgttaatggttaatgctcatcgcaatgacagtattgtgctatcatgtgaatgttgatgattattttataaaaagcacactactacacaaccgatttttgcgtgcggctaatatg

SEQ ID NO: 51304 - DNA, 2254 bp, Oryza sativa
ttcccgcccgtagccgagggagagggagggaggggccgagcgccgccgctgtattgtccgtcgccgccggtcggccgggagaggaaaggagaggagtggagtgggaggagaggagtggagtgggagagagggagagagtgagtagggagggaggcagtgggcggaggggcgcggaggatatcgctcgaggtattttcatgtacgggtcagttaacagccccgcacgcaaaaataagtttattttcatgtgcgggcctgttatgtgattgattttcttgtgcgggcgatggcctggcgtcggtcccccattttcctgtgtggttccacttacgaaccacatggaaacaaaacgggaggcgtctaggaaaatcaatgtagtagtggcatgatcatgttgttcagtaccgtcactagatctactcatattataaatatcatgtttattattatgttattatggattaaaatatgcagaattataaccatatttccaacaattactccccttttgccgcaatgaaaagggtggaacgtacgtacttgttgcgtgatgtttgtatagctagtagtccttgcttatagatcgtgtcctgctggccgaccggagccgttgaaatatgcaaacgaaagggtgtcgaacgactaaaatttgagttaaataatttgtcatgttccgtccggaatttagggacaaagctagctgtatagctgtgttgtttttttttttctttgttgaaacgatcgcgttacggcatcaacgacctcatatttttagctaccgttttcgtaccaatcgggagaggcaacgtacgtacatatgcatgcgtactcggccaattggtacaaactctatctcggtatagctagtttatgatgacatctatagagatatttacactgtaaagtttgtggcctatatattattttggacatttgtggatccatcggaaatacaagctagcgccgcgctcctcaccaaaaaagaagtaactctaccacatttgatagtgttttaattgaaaagcttacaaatttaacttaataataatactgtaacgcaatataacttctaaaagagaattcgtatgtaaccaaacaaattgagtgtgcggcctgatacctagtgccgtgagcatttgccaacaggttatatggttcgactttgagtccctatgcacgatcgagatacgtatagaggttttccgactagtccacaaatcttgagaccatccaattatcaaaattgagaaagttttttgaagaaaaaattgccgaatgctatcttgcaattccacaaaagaaaaagaatttgatacatgttatatctagctagacaaatactttgagcggactgtaccatgtctcctctctaatctcctactagtagctattagtagcagctagctagacagaaatatcctactaagctactccctccgtcccacaatataggatttggagtttttcttacaatatttgaccactcgtctcattcaaattttttttgcaaatataaaaaacaaaaagttatgcttaaagtactgtagatgataaagtaagtcacaaataaaataaataataattttaaaagaatttgaataagacgagtggtgaaacgttacaagcaaaaactcaaaatcccttatattatgggacggagggagtagtagtactgatttatgcacactacccaagtacaggacaatccaatggcacatcaagcatacttcgtgacttcgtgtttagttcacccccaactaccttaaacttttaacttttcatcacatcacatcacatctaaaatttttctacacacataaactttaaattttttttcaaacttccaactttttctaaacttctaacatttttcaaggaaaacacaccccatatactactactcgaaacgatgacgcgcgagctggccggactgacccacccatatattcataagcgcacccgtatgtggacttactgttgagtctaacacaaattaaagctagctagctgctagctacgtacccccatctcgcatcacgtcatgcagggccggaattctcaccagcggacaacacatacctcacggacacgaccacatgctacttattcccaatacaatgtacatacagtatatatatacacgtttaatttatactcccttcgtcttaaaatataccaatttttttgttggatgtgatatatcttaccctgtttagattcgtagtactacgtagtactaggatatgtcccatct

SEQ ID NO: 51305 - DNA, 1310 bp, Oryza sativa
aaatgaataaattttaaagttcaatttggacaggggctggattcactgggatttggtttttcttttttacagaccgagtacttatatagctacctccttcgtcccaaattacctggctttcaagaatggttaacatattctaaggtttaaaaccaaaaactataatacccttataaaataatttacggttaaggatagaaggttggttgagggtgttgacgatcaaatttggtaagatgtgaactaggttcgacattgggatcgaggcggattcaataaagagatcgattcgaagaacagggtatgcatcggatgcgaaggcatcggctgaagtctgcatcggcttagatggatcggtcagagaatagccgatacggctgatagaggtgatgcagctgattccaatgaagacggttttaaggctctttgaatcgttcaaagtgcttcacaggaattgccacgatagagataaagctcttggtttaggcaattgtatctattaattaggatatttcatgtaatttccttagagatatgtttgggcaaaagtctgccgcaaagacttatgatatcttagagtttgttagagataagtgtcgtgtccgacaggacatatcttgtatctcgggtataaatatgatccgaacctatgtaatcaattaacacacgttcaatacaatctcggcgcatcgccacccttttactttcgtttacttttgatgagttcttactttcgggttgagctgcatcggttttgatcttcaactaaaggtaaagcttgttatggcggcttgcgttctcgggattagtgcttccatctttatgacactctaatcttgtttatgtaattcgttgagttatcatatatcctatataatctctggcaatattgttatttaacttttaatcggctaatatctataattggaaggcagccgattaggttaaataccaacattgacctagattatataggatatccaccaccctatgaaacattcaacggcttgattgtctagatgttgtccttcttttcatacttatagctgcatcagttgggtttgaccttataagtcgtgattagaatctcaatctctagcctgctttttgttgctgattagggtttcatcggactttcagcgatcttacctgatttaattactttatatcttatacgcttgattgatatgttaaatctgtcctttatgttaagatcttgttgcatttaggtatattaagctccatgtttgatatattttgcctgctttaatatcttaatatagtggtatcggagtatcagccgatacatg

SEQ ID NO: 51306 - DNA, 764 bp, Oryza sativa
aacaagattcttagcaatattgatagcactagtattatcagaaaagagaggtactttctcaaaagtaaaaccataacctttcaaagtagataaaagccaaagaatctgtgaacaacaactagcagcagcaagatattcagattcagtagttgattgagcaacactagattgtttcctagaagaccatgcaatcaatgatgtaccaagaaaatgacatgttccactagtatttttcctatcaattctacaaccaccaaaatcagcatcggaatatccacttaagcatatagaagatgaagtagaataccaaaatccaaactcaagtgtatgattcaaatacctcattattcgcttgaccgcttgacgatgtgaagcacgaggagaagcttgaaagcgtgtacacaaacacacagcaaattgtatgtctggcctagaagcagttagatacaacaaagatccaatcatacttctatactccttttgatcaacagcttcaccatcttcatcaggatccaacacagctgtagaaccaattggtgttgaaattggcttgcaattatccatcttgaaccgtctcaaaagatcctttgtgtacttcgtttgatgcacaaatgtaccttaaggtgtttgcttaattagcaatcccaaaaagtacgataactcacccatcatgctcatctcaaattccctgcgcatagtctcagcaaactccacaaccaaaccgtgagtcgaacaaccaaagatgatatcatccacataaatct

SEQ ID NO: 51307 - DNA, 779 bp, Oryza sativa
ttctctcactttatcccaaattttgcgcagaacaaatttagtgctctgctagactgctacaaggtacagaccacttcaacattggtaacacttgattaattacaacagctggagtattacaatggtacaaaacaccagatgagaaaacaacattaatttaacataagacaatttattgtacaattcatcttcatcatgtattccctttcctccaactaaatcatgcattcttcacttcgtgaattactgcattgatatcctacatcactcatgtcctcgatggtcaatgaaatcaccatgggaagttgtttccatttcatttctttataatggattttcctatgaaaacatggtcacagacttaactctgctgaaaaagaattttctccctgccctcacattattgccttttgctcttgcaatctgtaatgtttttagtctcgaacaatggtcacaaatggatcatcttttatttcacaaaattcatagaagtaactataggttgttatccccgaaaaaaaaaactatagcttgttatgacaagccgtccttagagcttgataatgtcatggcactttaattagcaagatcatcaagtggagctcgttcctgtagagacattggtagttaagacttgaaaatagcctataaagagtatagatggacacataaatgtataattatatatactgtaaatgataatattatggttcagcattttcataaaaaaagatagtatggttctacaacttgaaacaatgcatattgtcagggttacg

SEQ ID NO: 51308 - DNA, 7830 bp, Oryza sativa
tcctgcagccccatctattataagcatctagctgaaccaaaccaatatataaggttctagctaatcaaattataacccataggaaaataaagtcatctttggccctaattaaatgggaaaggctcaccacccggtgacattcgaaaataaatacacagttgaaataaatagagaatttaaatataggatcaacatgctcaaaggaattgtgtttgggatctgtgtgacttgccttgcaataatcggtcttcaattaatcttctggaatacttccgatgtactcgcgaaccttcgcaacgacggaaacgacaagctaacacgcaaaacgaagaaaaagactaataaaaaccaaataaacagtacatataaagtaaacaaacatgtagatcatgattttagatgaatttagagacttgaacggcctcattcaatatcatataaattaattatgaattttacaagatttaattccaattaatcctattaaagaaaagactattcaaaattaattaaaccgtttacaaatgatttataactgagataaagattaaaacaacctccagaaaagattagattatatttggtagatgacatatgataaaaagaactaatatgccattgaagagagggaacggatttatatggctgagattaatcttgaccgagtcgaccaagatcggattagattaatctggcaagcaagcctcaagagataccgactcaacgagtcaattctacgtgacacgggatcacccaaatgatcaaccgaaaccggcgaacggaaccggcggctctgaacggctctaaactaaaggacgactcaacatggacgaacgaacgaagcacggggaacacctctttcgaacgaacgagcgaacgacttaacaacgactgcgactaaaccggtgagctagacacgattcacggtaaagcccgggtaccgcaaacgataggccggtaggaatttagggatgcacctacggctagacaacttgactaccgagcaacggttaaagcggcagctaggttaaagcggcacacagctgcgacacggcggcactagggcgacttggcttggctaggcggcggcgactcggcggaggcacgcggctagggttagggcaacggcacagcgacgacgacacacaacgacgacagagcacgaaagcaaggcgcagcagctaagcgtggcacggcggcggctactcgacgacacaaacgagagattaaaaactaaaccgagggaacacagatagacgtctcaccgaaccaaagcgatcggagaggaagggtcgacgatgacggtccggcgacaacacacggagacgatgacgacactagggccaaacaagattagattagattagatgggattaagaccctagggataaactacaccagtgaacgacataggagcggcggttgccggcgaaccatggcccaataatgcaaacggagggcaccgggaggtagagaaggcgacggcgattcttaccaacacttacgcgacgatggacagcgacggaagatggccggcgatgagcttcgaagggcggcgaggtactgtccacggcggcgatgattttccggcgacaacacatgaagatgatgacgacactagggccaaattagattagattggattaagaccctatggataaactacaccgatgaacgacaaaggagagaggaaagctcactgaggggcagcgtgacgatggatgatgacggcagacggccggcagcgaggtagaggcggcgacggggacgggtcagcgacggcagcgacgtttctgcaatctttggcaaagaaaaaccggtggccgggcttcaccttgctcctgcgaacccaatggagtcgacggcgaccgaaagaggcggctaaggcggctgctagctgcggctggaggcgcagcaaaggccgaaaccttctggttcgcgtcggcaagcggcttccggcgggatttggcacaaaggaaccaatggccggggtggagctcgactttgcggagccgagggaggtggtcgcgctgaccggcgacggtcggggcgatggcgcacggcggctggagcggcggccggaggtggagagagagggagctcgcggggagagtgtttccggcgacggtggagatagggagaggtggcggccgaaagaggagaaggagcgggctctatatatagccatgggagcccagggatcgagcccacgtcgacgggaaaaactcgggaaagtttaggatcttcgccggaaaaaggaaagattgatccgcgaaattggaaaggatttccatagaaacttgtgggatttcttggggaaaaggaagaggagattgagaggattccattcccacaactaatttggaaaaaggggcaacgaggtggccggattagtgggaggaggcggcacggctgcacaggctcgggacggctcgggctctgtctggaggttgaagatagagtactgtagcgtcagggaggtcaaacagacttctctgcgggctgagaggagaggagggaatgggctgaattcggcccaagactaggaaggaagattttattgcttttccaaataaattaaccaataagatgatctttcaattgttaaaaatacttccaatgctcaaataattccaagaaaaatcttgaacatacttggacactctaagtatttaacaaaattgaaaccagctcatttaatgattaatttaatatgtgaataattactgaaatgttctttgcattattaacattaggaattgagctctgaaaaaattcgagaaaattccagagagtataattaatcatggagaatttaataaaaattaaatccaaccattctttatatttagaaaattttatttcccacatttaacttcacttgtaaattaatgtacttttaatataaattctaataataatttattaattaatttataaatcctgaaacggaaattcaggccgtgacaaaactccacccgagaaaagctagattacatggtacaagcgtgtattggctagcaagcaaactcattgggacgagattggaatcggcgaagcacttgccctcaccacagcgaattcagccaaagatgaacacttaatggccgctgccacatacttctgtctaataccatcaatgcctttttgttcaatcaagggccgatgacaccaaccctaatagatatcaccatgattactggtctggacgtgtcctcgtcagctaatcccatgaatctgaacaccaagaatcagtacgacttcaggaccaagagtataggtggttggtctagttatgtggcggcatatatgggccagggatccattactcctcgagaacatgtggccttcttgctcatgtgactagaaaagttccttttctgtggatccagttgtggtcctgcaaccaactggcagtttgcagccgaggctctggaatcaaaaagagaatttcctttaggcaagatcctcctcggctacttataccaaatgctgaacaatgcatcggccaagatagatgtcggctcagcggttggagcaggtggaccatggtagctgctaaaatcttggctcaacctgatggtcatgaaagtcgtcaatcggctatctatgacagaagctgtattccctaggctagagccgattgtagaagatgatgaagaagagcgcacccatcgtagatgcatgtcatatggagaatatgcatccacaccagccgatgctggagcaaaattattggctgaattgctcaaagattggttctgtagtttttatgaggactttcaaaacgatgctcgagtttggtttccttatgaagattcaatgcatcttgacctcccatcagacttcagatttgaagatatcaaccatgaaaaatttcaaaaatctagagaagtcttctcagctgcaattagcccatgcattcttcctatcggcatacatcaagggaggaatattcaggtttcttatgaattttatcacccgatgagctctgccagacaacttgggatgggtcaactaccaatcggcttgttctttgctgataaaatccaatgccgagaggaaatttcatcaaccttgatgatggatcagctgctcaatctccaaggacctcctctgggcagcattgaaaatatagagctggcaagatttaggagcagaaactttgacagatgatggggtgaatggaagctgcatctgttccaccaaccggcctcaatgtatatgacagatctctttcttgatgttatacctgaggtaaaccttaacctcattaatttcatttgaataattgtcaaccgattcataacttgactaatcttttcttctattttgcagacaacagaatcttcccctccacaccaaagcaatagcggcaaagatatcaaatatgccccaagtctaattccaaatggaggtggaccatctccccctgtcatcggctatcatgcccccaagacttcaactcttctccaagggctcattagagaactagccgatgctggcaaaaagagaaaaaccagagcatcatttgtagacacatcgactctggctccaaagaagaaaaccaagtcaaagaagaccaagtcaactgatgatctgtctgccctagatccatccattgagcaagctttggatgaacgagagatcaaagaggatgttgatgaagctgcagctgaggtaagtgatacagaaagaactccatcggcttcacctaaacaaattcctctgactccctctgctccagctcacttctctagggtaaatatctttccttgattcccttttataactattttatcctcaaccgattatttactaatcttgtctttgcagaaaaaaagaattgccgtgaagaagaaatcggcaacaacaactctcaaaccggctccaccagtaagatgttcttaatttctcattagccgatcatagccaatcttatcttaacatttatctctttttgcagcctcctgctcctccttcttcccctgtacaacaatcaccaagtaaccaaactccatcggctacagggagccattatgttgaagaagaagaacaaccagctgcccctgctatccaagtaagtttccctttgatacaagaacttagattggctatgtctatttagctcctaactctcttgaaattgttcttgtaggttttagccgatctattctcttttgacatcaaggactactttgatgaggtagaagaagaaaccacaagcaaggctctagcccccttggatgacatatcaagaaaacacttgaagatatatcccttcgggtagagtcttcattagacaatctggtagccgactgtggttcaattcgggcacgatatccagaaatccaagccctgatcccagacgatttggcaaacaccattactctagcagtattccttgagcaacaccaatttgagctggaaaaggctaagcaacatatagacgatcggcgagagcggatgaatatcgaagtcactattcaatccaatcggcagctcatgcatgaagagaaagccaagttagatcaactctctgttgggccgattcagttgaatatagattggcttgaagctcgcaaaattaatctaatagctcaacttgaggaatgcaacgctgaactggatcatgaaaaacaaaagctagccaatcttccaagtgccgttgaagaacagaagtccagactgagatcggctatcaagaatgtggctgacacgactaaatctctcaagatcatccctggaaccaacgcccaagacatccaagccatcgaagaaatagatcaaatcaggcaacgggctttgtcggctatccagcgctatctgtctcaatgacattttgtgtaatagactctaggaatttttgtaatcggctaagaaactctggctcttcatctaactcatcttgataatctttatgccgattcaatataactccataattttgctcaaaaatttgcaattttgcatatatgtgaccccctaattttacaatgtcaaaagcattgataaaattataatttgaactaagggcgatataacaatatcggccgtacatcggcaaaccaaaaccgattacaataaaaaaaacggagggcgatataacaatatcggccatctcaaggcgatgtgaatacattggctatcatgttttggcaacaccagccgatcatgcattaacccaaacacttgggtaatatttcttcaagtatttgtcatttagcgctcgtccatagacttctccatcgagtccttgcaacatgtaagctccctttgacacaaccttatagatttgaaatggtccttcccaattcggtgaccacttgccgaatttgttatcccgagtcccaatcggcaaaatcaattttcatacaagttctccttccgaaaaagacttgagtaccactttcttgttataatgtcgagcaactcgctccttatccttggtaaccttggcaagggttcttaatcttggctgaaccaagtcttctctttcatcggccatgagattataatattcatcagctgtcaaatcattttgcaactccgttcttcttgagccgattctaacttcccatggtaaaacggcctcatctccgtagacaagcttataaggagggacttggatcgatccatgacaagccatccgataagaccacaacgcttcggccaatcgagtatgccactgccgaggataatcagaaatctttctcttaatcaatttgatcaaactcttgttagatgcgtcggcttgcccattagcttgtgcataatatggtgaagaattcaacaatttgatacccatgctatcggcaaactgaacaaactcatcggacatgaagattgaaccttgatcggttgtaatagtttgaggaataccaaatcgatagattatatgctcttgaacaaattgtatagcatccccagaatcaaccttcttcaaagcaatcgactctacccacttggtaaaataatcgattgccaccaatataaacttatgccctttactcgatggtggattaatcataccgatcatatcaattccccaacctctaaatggccatggtttaatgataggattcatagctgatgccggtgccctctgaattgctccaaatttttgacaatcttgacatcccttataatatttaaaacaatcctccagcattgtcagccaaaaataccctgcacgtcgaagcaatcacttcatcttatgagccgattgatgagtgccacaaatgccttcatgaagctcaccgactgcaaccttagcttgatcggcactcaaacacttaagtaacaccccatcaatcgtccgataatagagttcatcatccaataaagtatacttcaacgctctatatcgcgatttccgagaagccgattgagatggattctgtaaatattaatgtacatcatatctccaatcatcggctgttaatgcagcaacctcaattttgacatctttgatcatcggcttatatcccgaagtcccttgggccaaatcattaacatcaatattctgctctcgagatacatgcttcaaagtcaccagccgaaactctttcatcaattctcggcacttctcattataaaccatcaatgtatcatttttgcagttatactcccctgccaattgactgatcactagcaaagaatctcccataatctcaatagcatcggcttcaacttccttgagtaactgcaaccctttgagaactacctcatactcagtctgattgttagttgcataaggtttaatagtataagcaaactcaaaacttgccccccgagcagaaattataaccaagccgacaccacaaccat

SEQ ID NO: 51309 - DNA, 1419 bp, Oryza sativa
attttcttgattgcattaacactcctttgagtcacctcaatccctctctcatgaacatgaaatcccaaaaactggccagcaaatacaccgaaagcacactttgtcgggttcatcttcaaaccatatttcctagttctctcaaaaaccttcctcaaatcggctatgtggtcctctatctctttagacttataaccacatcatcaatgtagacttcaaccaaccagccgattagatcatgatatatataattcatggttctttgatacgtagctccagcacttttcaagccaaaagtcattaaaacccactcaaacaagccgattgcaccaggacaccaaaaagccgttttatggatatcctcttcggccataaaaatctgattgtatcctgcatttccatccataaaactcaatatcttgtgccctgaagcagcatcaaccaactgatcggctactggcattggatacttatcttttagagtagctttgtttaaatccctgacgtcaatgcacaccctaaccttgccgtttttcttgataacaggaactatactagaaactcactcggcatatcagcaaggacgaataaaaccaacatcatataaacgtttaatctcagccttgacaggttcgagcatatcggctttgcatcttctcggaggctgttgatgtggtctaactcctggtttgataggtagccgatgttcaacaatcgatcggctgagtcctggcatctcataatactcccgaaaaaaccaatctctgaatttctttaagagctctatcaacttggttctaaattctggagaaaagttcttactgataaatgtcggccttggtcgatcgcctggacctatatcaattccttccaaatcatcggccgacatgaaaccctgtctttgcttgtcatcgagatcatctactgtgtccttagtgcagacgtttgaaccctccacgacgccctcaaaataatagcttgggctctccatcttcaattggctgtatatcacaatcggacacttttagaaaatctccatcccaaacttttctagataagaaatcgagaccatccatctcccaaagagctaaattggcattggcaacgttgactgacctgtcggctggcacgatttcaatcttgtcgccttgccactgaatcaagcattgatgcatggttgaaggaatacaacaattggcatgaatccaatcccttccgagcaacaagctgtaggaacccttcccatcaatgacaaaaaatgttgtagggatagtcttgctgccgactgtcagctctacattcaaaactcctttggttttgatggattgccaccaaaatctttgagcaccatgtttgtcttgatgagatcctcagcatttttgcctagcttcctaaatgtagcataaggcatcaaatttactg

SEQ ID NO: 51310 - DNA, 2926 bp, Oryza sativa
  unsure (1)..(2926): unsure at all n locations
gaacaacatatcagatcattaggtgattccctttttgaaatcatatggataccaccagatctgcgagtgagcgggttctgttcatatcttatcatacttggaaaaccagcaagaaaaatcatctgccaacttttaaagttgttggagattatccatgctgccaacagatttgcttccaggtttacaatagctgatctggtgttcctccctgatctgggttgtatagcttttaagaaaggagtaaaaataaggtggaacctcaggagagaggagtacaaactcaacatggtgatgtagctagcataattagctgctggttcaggtttaaccgcaggaagcttgaagcgctggaagcagggatccatgagcttcgtcctggccaaggtgactctccaatgtttgttgatatattagttaaggatcttagaagccccacacatgagactggtctcagtgccaattatagaggtttctacaaaaattgtagtgctctgagatcttgttcggcccacatgaatttgttcacctctttggacattcgtaaggacttcatggttggttctgctgattggggtaattttgtcaaggctttgggtgatatcaaacttccaggctggtatcgtactgctatgcgatcacctgaaatgaggaaagtactcttctttgagtttaatgatccacatactggggagttacgaggcaaaagatatcgtgccttatcagttttttcatggcttgaatttgcgcggatatttattaagcacatgaagaaagggctggtaaaatcactaacctcatacatgttttagtatagacttttatttgatggttttacttgatggttctaatatagacttttattttttgaagtgtaccgataaacaggcaacagcacttctctgtgtgatattctcgaatattgtacctgttgtggagaagaaacttacttacagttacaggccaccagctaaggagaagagcaatgaaagctttacagttgaagaaatcctggacccatcatagtcataggtatgaagtgcagcttgtttctttgttttccttgcatgcatgtccagtaattgttctgtttgctgctcctagattctgcaagttatatatatacgtatgtatatactaatgcatctggggataaagcgagcatacattttctgttggacactatacatgaatgtaggtgacatagaatgatttatatatccactgtccaacaagaaaagtgagttggtttatatatctactttccaagatgatagcaaaaatgcaattagagttttgcaaactttgtaatcagagaaacaaccaatcacatcctgtgtgattaccctttggtttgctttgcttggagtgtaattagggatatatgtggattagggatacccttgcagtataggcaacaaactcaatgtatacactatgtggattagggatatgtatgttaatataaaactaacagaggaaaaagctactgtgttgcagtatagacaacaaagctactgtgacaatataaaattagcagaggaatacattccctttcttactcttaatatacatcggccggctattcgccggcccggcgaaaaaaaaaattagcagaggaaaaagattagttagaatggactttgacaaaaaaaaaggggagtttagcgtgaaatccttttacaaagctattaaaatgcaggcggtagcctctgatataacaggaatgtataaaaaggtgtggaaaattaaggtcccattgaagattagaactttcatttggttaatgataaaaaaacagcatcctgaccaaagataacttgaggaaaaggggattgaagaaaggaaacgataattgtcaattctgtggaaaaaaaaaagaaacgatacagcagttattttttgaatgtcctatggcaagattcaattgaaatgtggtgatttgtgctttcaatttaaaaccagttaaagatctgaagcatatgctttgggttgatgggcactgaatggtgatacaatgacatagctattgttagttggaattgctgctattctttgggcaatttggaaggccagaaatattgcttgttttaaccaaatacttcccattgatcccactgaaattattttatgtgcttgtaattggatttcaacttggtctgttttacagatgtcggaggaaagacagaatgttgctgtaagctacaaatctcagtatggttggaggatgactctgcaaaggttggagtatgtatgacaaagcgcgaagaaaaagctttcaaggaaagggtttctgaagtttttattggtttgaacagatcctggaaatgaattcatatggatggggagctatatcagttgtagaagttctttttttccttaagttttctgtgtttgtcagtttagcctggtagtgatagactgatagatcctgatgatgtagctgtgtgttagtttgaacgattttctgtttttaagctttttgttcgatgccctggaactgtccaggcatgagtgaccttgtagaaactttcacatttcttttaatagaaatggaggggtattgcccttttgataaagaaaaagggatataatatgttgggctggtattcctgttgatttcaattattctttttatagggcaagcaagggttaaatatggtaaaggtcaagtagttgctttgttagctgtcgtgacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51311 - DNA, 6203 bp, Oryza sativa
agcttggcgcccttggacgccagcgacagccttccgtcgcagggggagagctgcacgccgccggagaagaagtcgccgcgcgccgcgaaggccacgccgaaggtgaacccgtccccgcgctgcaccgccgcgtccgcgcacggctcgtacacgccgttggtgtcgcccccggctgccaccgacggcgcgatgacgaggaggacgaggagcacggacgccgcctccgcgcacgcgcgcctcgacctcgacgacagcgtcgccaccgccatggccggcgcgaattgggtgcctcgggcgcgacgaggtcgttgacgagaggggctttggctttgctgttgctagttactacagctcacgaagaaacgcgtcgtggggaggcaaggaataaaggctaaaaaggcggttgcttgcttgttgggctcgctgcttcttaggccccgtagtcctcatgggccttgtgtacttctatctgttcggagataaaactaattattagtattagtactactttggggaaaaaaagaattatttttaagggcttggtaaagcttgtatgacccgtttggtaaagctctaactcttaaatttaattttagaagatagatctgtaaagttatggagcagtctaaacctagcttcacatctctagttcattttgtgatagcgctccaaccaactccactcctattttaggtagagttgaaactatttgactggattctagctccagaagaggtacagctggagccatgccaaacagactcttacttcaagattcttgttccatagagttagagctgaatcaaacactttcaagattctggataatataaattgaagttgttcttcctaaaaaaaattatactagatgaagcggtggtagtatatttttgctactagaatatttcaattattagatagagaaaacccttttgtaattgatgttgtaatttgttagagcatctccaacactctctctaaattcgactctccaaatatctatttggccaactctccatctcatttatcaagtcaaatttgttatttactccaacagcttcttcatccatcctctctattttgagtctatgacagcagtacccatgcatcagcctctatacccattcttcctcatctttctccccctcttcctcttcctctctctctccctctatacactcccgagacggctggggacagtggcggcggtcggcgcagacagcggcggcagtcgcggctagggatggcggcggcgggcgcggctggggacagcgcgggcgcgcggcggtaggcgcagacggcggcggcggcggacagcggcggcggggacggcggcagtgggcgcggctggggacagcgcgggcggcggtaggcgcagacggcggcggcgggcgcggctggggacgacgcaggcgacggcggcggccggcgcggttggctccggcgcctcgctcctccatgccgtcgccgtcgtgcggttcctagccgtcgcggacgacggcggcgggcgcggccggcggcggccggtgcggttggctccggcgcctcgctcctccgtgccgtcgtcgtcgtgcggttcccgtcgctgccttcttgcgggtgcgacggggagagagagatggggtgggagggagagtggtggggcccacgaatagccaggcagagtgactcttgactctccaagttagtgagaggtgcaatttggaggttgttggagggtattttttctccatacttgctaaattttaacttggccagccatttggccattctatgagttgctcttagaacggataacttttcaatggcaaaacaatagaatttctcaaagggagtacctatacatctttcgaaagatttttataatcgtatcacacagatttttaatctttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttaccgtgtaagtttcataaattacactgtaacttacaagaaaatgcactgtaaatttgagtgagaaaatcgagtgagagataagaaaaaatctttcgagtgagatatagcaaaatcgtttctcaaataaaaactgtaccagtagcatggcatggaccaacacgattcataggtacaccaatcaaaaacacaaagttgttactattacatagtcttagttacaccttacaagtactacaacactaaacaaatagtaaaactctatatgtacggttccctcctctcagacacatatttgtacttctaccaactggtctcatctctcatgagatggtcagttgagcctgcatatctatatggccaagaaaagctgcgatgaatgcaaagcaaatttcttgaaatattggatagatcatcacagtccaaggctgccaatatatccatgaacgatatctcaggtgaaaatgttgccaatgactatggatgctctttggataattggattggctgtcaagtctgcagctcaactcttctaggcaactcaattgaactggcaagatgatgtttagtgacctttagggaccggttaaccgcagatttattcgtcatgcgcttgcctgcttcgacacctgagagttagggaaatttggttagaaaattgcaagtgtatgagtttgagccttaagaaacattgtatactagataaggtcagttatgtcacaaggaggagaaaaggcttaacatgaacacatgcagatgatgcgagatttttactcacagctggcaggtaaggagaatctcttatttccttgaggatctaaatgcccagtcctctccttaggattactactcgacctagttccaagtcccgaaggacgagacgaaatttcatcacatccttctctggatgacagtttcagttttgacttagccgatgccgaaccaccagaccggttcgatgaggaaccaccgccctctgagtttggtaggcaggtcttctggttcagtatgtttgaatgaagtgttgaagtttgtcttctaacatgtttcttatgtggagtatagacagcattttcctcgtcttgcattgctccactactaacaggaattccatctgctgcataagagcccaggaatcggctctcccatggacgaacagccatccatctctctagccaattccagccccagctgttcttgtcaggttgaaatgctgtaatggctgcatgttgccttgcttgccactgcgaaaggaggaaaataggttcaggtgtcaagttttttaatgacctccctttaagtcttattttattatcagaaatggaattaagccctcaaaaagtatggaagcacaccaaagaccaacacaaagtgacttgagatgtggccacaactgatgagagatcagttcttacagagtcattgggacagtgtatctgacatcaatgatgggaaggactagaaaaattcttaatctactacctgaaccaatgaaaacttttagagatatgaattcatcttatttctggaaggggttactgcatgaaaaaattatttgacctcaaccacatactggaaaaaggctcccttttcttacttctccaacatacggtgaactgtctaaataatttcatttatcatgattggattctttttctccagaaggagcatgcaaataggtctcatcttagctacatactgaaattacaattaaacgctaaccaacagaagcagaacagtacagaaagtcggaaacaacaagcagcctaattattaggctaacttggagggagagacaacatcatctgttatccatgaaagcaacgtttggaatccagcaatagcaacttagcaagcatgcttgttgttacatgctggagatgacagtgagtcgattactttcatgatatcaagaagctatacttggatgcagaccaatttgattggtgcactacagtatacgctataatccatggttcatatgattaattggataatcatagctgagtattgtcctggtgtaaaatgtttgataaagttacctggtgagttagagcataggccatggctcgttcgcgtttggctgctgcctcctgcctctttaatagttttgcttggatatcttccacagatcctatgctatcacaccaaccatcctgcatttttaaggtaaatagcataagtaaacaactcaagccaaatcactgcactttcatgccagttatttccttgtgaaaattgagaagagcatgcatgcaagcctacctggaaaactactgaaagtgcgactcacctcgatttcccgcacatgtgtctcatttattttctcttgtagaatagcttgctgatccgtctggctttccaaagcaatgcgcactcgccttgctctaacacgggcttgaaccctcaccaaagcttgcatacacctgagtgttatagcagcttgctttctcactatatgaccccttacaagggcttgaagcctaactagtccttttaaagcccgacgggctctcctagcctgaagagaattcaagttaaacttgtagtaaagcctgaagaaccaaacatttgggaatcatgggaaaatccataattccatttcagcaattctatgtttgcatatactttgcattggacttggactagttactaaattggcagagagagaaagagagagagcatcaataccaggaaggctctaaacacagtctgaataactgtagcagcccagatctccttgagttcttcttcagtctgaggcacaggcacgttaggtgaactaaaagcgggttccgagcacgaaagtgcattgctatcaccttctgatggaccattttcatcaggaaactcttctggtgctccaaggttatcatggtcttgaccgtgctgattttggcagtgaaaatggttagcaccgtcccttttctgcaatttcacagttcacaagttattacaaacccagccaaataaaaaaaagttattatatacgaacaatgcaatgctaaattgttaacacgatggtttccatttctttaaaaaaaaaaaagacatagtggtttccatctttcaacatttttgtcagtggcatagaagccaaaaaaaaatgatgcagatattatcatccagatctgcagtaacttcataaatttacacaaggcaaacaagcaatgcaagaagtaccaactgtagtcttaatttagcggagaacgaataccccaggttgatcactacaacaaagaattccccatgacatgatcaagattcacttccccatttcttttcagcaaattgttgtcgaattttaacacgaactaactagtcgaattcccggctacccccatcaaaatcaaccaaaaatgccaagaaaaatagaaggacaaggagcagaacaatggatgagagaacctgtgctactcgcccaccatctccatcctccttgctctgctgctgctgcttctccaccttcctcatcccaaccaacgacttgagccacctcgccgagatgcccatggcgccgcgcccctcaaccgagacaaaaacctaaagccgcaatctttctcatcagcaaccaaccaatccaaacctcaaaaatctctccacaaaaaagaagcaaaacaaaatcacccaaagaacacgcaccaagaacttctaggtgcgtgttcttcttggcaagaagagccgtgcccgcacaccaccagatcgcggcgagacggggccaagaaaacggtggtcgacgctggccacccaatgagcggcgcgccttgcagatcaagggtggtctactctactcctcccggtcccggatcatcacgccacctcgctactactctactctactagtagtggccaccaccaccaacacccgggaacccggccattactgccgcagctgcagctgccaccactgcgtgcgcattattgctgccatcggtgggcttgtgcttgtgtgcgtggcagtgtggcacgctctgctgctgctgctgcagagaggaggatgagattgattagctgattagtagtagtactagtataaaaataagcaagaaagcaccgcgcttttcttgcgtttcactttcggcgcccccggtggtcgggaaagccaagccattgctgttgttctcttttgtttaccctctagtttttcactgcat

SEQ ID NO: 51312 - DNA, 12435 bp, Oryza sativa
agtgcaaactacgaatttttactattttactaccgaagtgtgcactgtgcaagatggatttgctttgtcaggttaaagatctgaaacatgtagttctacgttcgtgctgctgctacaattattcacatttattgttttctacatttactactagtaggtttttacgagtgccaccggtttataactgttcaactctgagtgaagaactattaccattaccgctccatcaattaaacatgtcatggcatttagtatcacttcttttcaataatgtcttttgctacctcataggaagccgagagctgaatcatcaactgctaccactgcttccctacacaggcagaggccgcaggaccacttcagagttcagaaagttcagagattgtgatcttaagctcaatatctctaattaaatccgtttatctgcctcgaattaaagtcacttaaaatgagaagatttcaggttgtttggcaaaatgcgaatttattagaagtagatgggttcagttggcaataaaatgggatatctacatgcgagtcaccaccgaaaactgacatgacaccagtgacagggcgcatgatggttatggatgggatgttcataatgccgtgctgaactctgttttcgggtggtttgcataagtaatcacgtgattaaattggaaatgttggcattagaactcagattaatagccggtgttcagaaatgaacagagattctctagtttctacagaacaaggatcttgattgagtgtcatgttacctgtcctataccatgacaagctattagtttatccaccgaatcttttcctttgtttcttcctcactgaaaaacatactcctaagtttttcctttcagttttttctgagatattctaagataaaatgtacgggagtactttagaatttggattttggagggtgtcaaattcaaatccatgacatgacaaacgggccaactagacacttttaaggcaaaacgagctgattgcgctcggatatcgtacgggactaacaagctttaagaaaaggctatcaacagagggatgtcttttaaccgtgagatgttggggctgtttggttctcagccacactttaccattacttgccaacaaaagttgccacaccttgcctaaggtgaggtgatcaaattgttagccacaacttactaagcctaagggaatcttgccacacttttttgagccattgacatgtgggacccaatttgttggaggggaatcttgccacaactgtaactacaaccaaacacctgtcaaatttgcctaaccttaggcgtggcaaactgtggcaaagtgtggcttgcaaccaaacacacccgttttaagtgacatgaaaagtgtataaaccacagcgccttttgcagaaaaaaaaaactagagctcaatgtcatgtgtcacttttcttgtccaatgcttaggcttttctacgacaattgatctagaggcctggtttagttcctaactttttcttcaaacttctaacttttccatcacatcaaaactttcctacacatataaacttttaacttttccatcacatctttccaatttcaatcaaacttttaattttagcgtgaactaaacacacccagagtaacaaataacactgtaaagtgtggtaacttaaacagtataaactccatattttttccattttgttaatccaatgtgcattgtcccttgaggtataaccgtagaacttcctcttttacacgtggtggaccatagtatatttattttgctagaatgaccatcctgatcgtactccgtctggtttaactatgtactgtactaagttaagagcctcattggttgccttaataagtcaaagccaaaactaaaatttaaatttccaaacttaattttaaaattgattttaagatattttcaacttagtttcttttatagtgttatttaacttttaagtcaataagagcacatatataaaagttttacctaaaaactaatttttattttctaatgagccattttggcttattagtaaatatgggcaaccaataagaacctaaagtatgaggaaagtagctcgaataacaatctgctctttcacttatatgaaataagattgggtaatttttacagtgtgagtcaccttttacccgcaaaaaattcgctttggatcaccctatatttgatctttacacttgagatatgtaatttttcctttcttacactccgaactatcttgaactttcttctcgagcgcatcaatgcctttaagcgtattggcggctacatgtcggtaatttccatgcaagcaaccctttatcatatgagagactatatgcgactcgagaacagagttatggtggtacaaagcgaaacaaatgcgaatttaccaagccaaaagtgaaaatattggatttaaaatgaaaagttgcatttaattgtgtgattagaaaaggttccatttattcagtgaggtcgaatagaaggccagtgactcaaacaggaaaaaaaaattggtggtatgcaagtggggtcgagggaggatgattataatctaaccatcatggtttaaattctcgtgtccatgagtattacacacttatgaacatgtgtttagtggggtgaggcatttgtcgctatctccgtcttctatgtgcaaatgaaaaaaagcgtcacaaatctctcttcaatggagaaaattatctcgtcgcttatgaagcataaagtttcttgtaaagaatttaaaaacagaaaaaacacagccaccatttttgcatgatgcacatataataaccatgaaaaagatacgaagtgagtgtagctctattagtttggttcaagtcctagatttgatatgggtgatcgtatttacggctatctattatttattatttcagtgctaagcaatgttaccgttgacggtgaggcgcatatagtgacttcgtcaatctcaatattttataggtgttcttagagatagagtgtgcgtgtataggggaaattgtgcgcgcgttgtgagtgtccgtgtttattccatgtttctaaaaaaaacatgaaaaaatgaatataaacgtttttcacataatgcacaaataataatcacaaaaaagtgaggaaaaaaaatcctataggagtattcgaaaacaattaaatccagggaaacttgataaaaataaaaaaacaaaccaaccatattagtagtatactttccttgccttttctcgacagcgcaaggtaagcaagcatcgccaaggcaagaaaaaaggaatctctctgaagagagggaatctccttaccgggttgctcccgtcgcaccggacccgacaaacgcaacccgaaaccggagtcaagtcaacacgcgcggacacacgcgcttcccttccccggaacccgcattgcctctcccccaccctctcgcaggaagaccccggaaggatctggaagctgcaacccccaccgtccgatccagatccgacggccccacgcccgccgcatccgcttcacgcagcttccagagcattcactcctccgccacccgtttcttcctccgctataactacacccctcctctctcctcctcacaaaccgcttccaacccgagaccacgctccccgccggatcgagcagctagggtttcgacctttttttttcccaccaggagggcgacgagatgttcgggcgcgcgccgaagaagagcgacaacacgcggtactacgaggtgcttggggtgcccaaggatgcgtcccaggatgacctcaagaaggcgtaccgcaaggccgccatcaagaaccaccccgacaagggcggagaccccgagaaggtgagctcgcgagcgattcgtctcttgttttttcgtttcgatctgtctgcggcggcggtgaggggcgtagccggtttggatggaggtgggggatttgaggggggcgttggggagttttggatctgtgatagggttgaagaattcgatgggtttaggagggtttggagtagcgcttgcgtgtgctccgggaatgatggatttaggtggggggaagtagatttggttgtggaaatgtgttggattcagagcacgataagtcgcccttccccaattgcttgccaatcaacgaaaaccatgtgaacgtttagatgcaattccattactggttcatatatcgaaatcatctatggtttgaactgtactattcattagctgttgatgataagttgcccttcctcaattgcttgccaatcaaccaaaaccatgtgaaccttagatgcaattccattacttgttcatatattgagatcatctattttttgtatgtttttaactgtactattcattaactattgatatgcacatttaggggctttgctgatgattatgacagattagggtcttggaacattcttgttaattcagctaattgatagccaattctagtgataagtagtattgagaatgatgtgagatattgttcatttggctgatgcaaacattacatcgtcacctgccaagtgccaacctgattttgtattgcgagtttgtgaccatgtgtactatctatcctgcattgtcatagttaggagcctagttactgtggcatacaggctggtgtgttctattatatatattgttttacctcataattatcgctgatatcttatgagtaaactggttaagctttatgagtactgaattgccaatgctttatctggttaagctgtatgatggggacaatagctttcttgatgagatggcaaactaaaattcttgccttcatttcagttcaaggaattggctcaggcttatgaagtcctgagtgaccctgagaagcgtgaaatctatgatcagtacggtgaagatgctctcaaggaggggatgggtcctggtggtgggatgcatgacccatttgacattttttcctcattctttggaggtggctttggaggtacgagacatgagaagcagctcaattcaacctcctggtgattgtggtttgcttagattttgactggctctcattgtggtctgcaggtggtagcagtaggggcaggagacagcgtaggggagaggatgtggttcaccctctgaaggtttctctggaggaattgtacaatggcacatcaaagaagctctccctttctcgcaatgtgctctgctccaagtgcaatgggtatgtcatcagcttccttttgtgggtcctaaatattgcataaactgtttgactattctgatatctcacactgttctgtgctcatcttgcagcaagggctcgaaatctggtgcttccatgaagtgctctggttgtcaaggttctggtatgaaggtccaaattcgccagttggggccaggaatgattcagcaaatgcaacatccctgcaatgagtgcaagggaactggtgagaccatcagcgacaaggatagatgcccaggctgcaagggtgagaaggtggcgcaggagaagaaggttcttgaggtggtggtcgagaagggcatgcagaatggacagaagatcaccttccctggtgaggctgatgaagcggtatgtctgtgttctgactcctcgcattgtacagtacatggttctaaggtgtagtactccatgtgcttgtcaacactgttactgaccaacctgtgctttgtgcagcccgatactgtcactggagacattatcttcgtcctccagcagaaggagcatcccaagttcaagagaaagggagatgacctcttctacgagcacaccctgaacctcactgaggccctttgtggcttccagtttgttctcactcacttggacaacaggcagctgcttatcaagtccaagcccggtgaagttgtcaagcctggtgagtctcccttcaaagaaagatcaccatagagtagcagcattttggaaaccatctgattgtttttttaagcattcattttagaaactattttattgtttactcatatcggccgtcatcttgtcgcagattcattcaaggctgtcaacgacgagggcatgccgatgtaccagcggccattcatgaaggggaagctctacatccacttctccgtggaattccccgactctttgaaccctgaccagtgcaaggccctggagaccgtcctcccgccaaggccggtgtcgcagtacaccgacatggagctcgacgagtgcgaggagaccatgccgtacgacgtgaacatcgaggaggagatgaggaggcggcagcaacagcagcagcaggaggcatacgacgaggacgaggacatgcacggcggcggcgcccagcgcgtgcagtgcgcgcagcagtaagcagcaagcagcgccgtgcatacatatctgcacggctttgacggcggcgacaaattgtttctttccgctctaggggcgataatactatcaagttttccatgttaggcatatgatgatgtgatactacttttggtcttttatactgcgtattaatgacgtacatcaaccggacctactggtccatgaaacaaaatctctactgcttctccttcctgtgtgtgttagtgcgctgcgttcttcccatgtgtaggatttgctgcttcctcgagatgagcagtagcagatggcaccgcgaatggaactgtcaatgcgcaatttgactcggtgcaactcgttgaggctcggtcatgcactgtgtcagggcccccggtgtcgggatctaacaacatggaacatgaaagaagaggctcctgcttagcaatggtaaactaaattgaactacaactgcaaagatagtgagagactacaaatcagacgcccaatttgttcctaaaaggaacaaaatcgtgcgttgtttcatttctagcagaaaaaagtttcaccactaaataaaaaagttccaatctattaaatgttgtgaatcatgatagcagaaaaaagtttcatcactaaataaaacatttgtgaatgatgatagaaacaatccgttgtaacaaacggaacatcgagcttcagctgctaaaacagcaacgaatatgcaagaattgatgaaacaagattcaaactactcagcgaaacattttgattccccaagaaacatcatacttacattggttgaaacattgaaaatcagaaaaatgcactagtctagattgggttccttcctcttctccagtgatcacattttcctttggtctccgctgcagatctagaccgggacatgcgaggctcttctattccgccgaggtgccgtagccgccgctccacggagaccccgaggcttactcaccccgccgttgccggtcccgagccatcttagtcaccctgccgttgctggtcccgagtcatcgtcatcattcggatgaacaaaaactccgcccgccagatagtcgcatggggaggacgcctcgttgctgtcgaatggtgagctatttcgcttgatcccctgcaaggatcatcgagagagaaagaaagatgcatagaacgagcggataaaggagtgagagagtggataaggggggactagaaggctcggtatagttataaagtggaggtgggcctactgctagcatcgcaacatctgatcttttttagttgtatcggacgatagatatggagctttatcacagagataatagctatttttttaagaatgggataacaatcgtttattcttgtaaaatggataaagaaaattatttcaaattaatttcgctgaacatctactgaataaagcactcatgtaccatccagcaaattaaggatccaccataaagcaaaagaaggatcatggaaaagtaatggtaatgtgaacaactattatttggctctcccaaattctcgggagggacaacaccgcagcctcccgtggaacggctcttaggcttgacggtggactttcaacattgaggtggacggcggtgacaacctccctagtccctacaacttaggcttgacggtggactttcaacattgaggtggacggcggtgacaacctcctagtccctacaacttccagcattgaggtggatgacgcggcaacctggttcaaaaggatgcaacaccctccctccgtcttagagatggaaggcggcactagcacctacactaccataacattaaatttcactttgggattacctttattaccggtgttccattttaaatcaccctttaatcaatttcactttaaacatggtatcttcattttaaaaaagatatcttacctttatgagaccatactctaactcttttacccatctacattaaactaatcatctagggctcacgcatgaagtcagtatatattgaggcgaaacagagtgctcggtcatgtctcatcagttcctcgcattggcttgcatgggcatgtcgcatcgggtgatcatgggaaagcttgtcatgctgcggttgtcaggtgcttgcgtatctatcatttggctaggttaggggatagacgacgatgggtcgcgcgatcacttgtattcttgttggatgttgtgtggtccgtgtggagacggaaggggaaggtggaaggccaaacggcatgggcctagccgcctaggtcttgcttgggagcaaatagcatttgatgctggaacattggatttgatcggacggcttcaaaaaaactgatgacgtggaccaacctggagcaagttttataggaattaatgatgtagtgggtaccaactatgtaggaagacggatatagttagaccctaccacgagaagacaaaagtaattgtaacggcgaaagctagcgtggctgtggggattttaaagagacagaggtgaatctttttgctattggttggcctggcttatgtagtgtggggaggtgaggaaagcggaaatagaagcagagtaagacttggtacaaaattagcatataattgtggattgtaaggattttagcatatagccaatggatttagattaacatggaattatctacaactttttatagccaatggacattttttttaatttaaatttgatcctaattaacgataaatgtaagatgtgatcgtagcctagatcaaatttttccaggagaaaatatcgaaatgcaaacagaccctggatgttagctgctccagttttgatgctgcatgcaaagcatttttctaagtgaattctgttgcctcttcatgtccatcggtattgccctgcacgcgaactatgagcatgccaaccgtttgcacacagacagagagagagagagagagagagcgcttaggctcctagacggacactgcacacaccaggtaatcctagaaagttagaatcgatcggcaccatcctctcgccaccgcggctgaaacttctgcagaacaaaggctgctagctcgtgcttgcagctcgggcgacacctcctcgtggataaacttcgtcctctccgatgttcacatggacatatccatgcatcgaactgttaatcattacacttagaagtgtttggcaaatgagaaagagaaatgatttcccacctatctttaaatcctaaccatttattctccatgtttcatttaatcctaactcttcattaatttttcaatcccaatcccaccccccatttctcattatccaaacacatccttaggcacatcagcatctgcgggggaaacggtacggacgggtcaaaggagaacacgagcatgtcgtgaacaacaacgcggtacatcctgtcgagaccggtgtggcggggtgggttgttcgcaactacgtacagaaaacggagtgatctattagcacgttattaataaagtattagtttttttaaaaaaatgaatgaatttaattttgtttaagtaactttcgtatagaaactttttttaaaaaaacatgtcgtttagtagtttgaaaaacgtgcacgcgaaaaacgataggttaggagaaggggtatccgaacacagcctagtcagctgccgatctcgccaatcgccattgacgtcgagccagacggccccgacgcgatcagcacccgtacgtgggccgtgtccagagccgatggacgacaaagaccggcattacacttctcctaatatatgggattaggtgatcgagaaaaatccatcgtgattccaaccaaaactacgatcgcgcgcgtgctggcctgctgacgtggtaacggcacaaacgtgcgtgggagaattctgatctgaatcaaatttgcgatcgtgtgctacaggcagccgattgggaagtggaaacctatctggtttcgctcggacgacgacgcgcgtggaatgcggatgatagacgacgtacgcacgcgtgtgctagactaatggaccaccaaaacatattattcattttattcattggctagcggtggcgaaccaaaataccgacaaaaacctcttcatttctttttatcttaactaattaaaagatttggatttttcctttcgtcacattaatttctcgttcgtatgtccgatcgagcgaggcctgtgttcccacgcgccatgaacacaagcgatattgcacaagtttaaagatcggtacaaaatccaatcggacacagaacacagaggaagagaaaactacaaacaggaagaataataaaaataaaaatcacacagaaaaaaccttgactggctcgaattgagccattttattgagcccgattctcttcattgactcctcaatgccccaatcccccaatacaatgccccagatcctcaaattgaaggtgaaaatattaacaacaaacaataatccccatatccttattttaacatatgaacaacccagatcctcaagattagaaaaaaaagcatgaataaacatcaacaaagcacaagagtaattcattatcatcactgctccttcttctggtgtgggaggaagaacgggacggggtggcgtcaccatcgcatctcccagatccgcctgtctccgacctccacaccgatggatccaccggccaagccaccgagggaaagtagaggagaggaggggcatttgtcgcacctgcaacccgctgtcgccgtcagcccgtcaccatggaggtcggatgcggctaaatctgacggccccagacctccacgccgatggatccgtcggctaggtcgcccgtcatcgcccgttgaggccgtagccggtggcgggacgagtctggaagaccgagtcgccgcagccgtcgcctcgagtcgccgtgccctcatcaggaacggtgagcgcagggagatggaggagaggagcagtagaggagccggcgatgtggccatgcctgcggctggatccagacgaggaggggcgaggctgctccaacccgctcgtcaccgaactgcctctgagcaggaggaggagagccctggcagcggtgcgacgaagcacgggccgagcggcataggcaggaggatgccggagcccggagggacgggcgccggggtagagggagggggctccgccacggttggggagggttggagccggtggtggatatgtgccggcgacatgaagagagacgaagaaagccagggacagagagagtaaagcgatagagataaggctgttctcaccaaaaaaaaaagagaagaagatagagataaggctagctctgtgactgtgaccagggccaccaggcaacaagtcacgaactcacgatattttcccttcttattaaagtaggagcttcaattttttcttaaaaaaaaatacacacacatgctgtcccaaaataagttgattcatgggtttccgtgtacaatctttgacaatccgttttatttaaaatatatatgaaaaaattttaaaaaataagttacgcataaagtattattcatattttatcatttaatctatatctataactaataactaatataaatattcgtatttttcctttcgtcacatctaattttcgtccgtgttttcatctgtatgcaatccgatttggttagcaataacgatggaaaaaaattgcaaaagaaaaaaatggtggccgcagatgccgccgccggaggaagccgccgctgccggatccgcccgcggtcgccgccactgctaacggatccacccgcggacgctgcagacgccatcgtcgccgtcgacgcttgccttagggacggccgtcgccgagggagcgcggatgccgccgttgggagggcaccgtcaccgagaggtagggagggagggatggccgtcgaggccgacagggagaggaagaggaagagggggagggacggccatctccgccgtctccgccgtcgccgcgccacgccgtgagacgggagggagagggggagagggagcggtctgccgtctccgccgcatcctgccatcgccgcgccgtgccggtgagacggggggagaggagagggagcggcgccgctggaggggaggggagggaagcggcgccggtggggaaagggggagggggagaggcggcatcgggggcgggcgaggcggttggctcggctgggagggaggggtccgctggagggtacgggaggggaagcacgccaatggggaaagggggagggga

SEQ ID NO: 51313 - DNA, 18815 bp, Oryza sativa
gggggagggttagggttctcatcaatttggaacttatccgagccgtccattaaaacgaacggctcagatcgatcgagcgttgggccaaaccacttgggccgtacgcgggccggtggtccagcaagcgagaggaggagtatggggatattaattagactttggtcgcttgagggctgaagaagaaagtgggctgaaaaaggcccatagagataaagggatttttatttagatttttatttcaataaatgctgaaatgatgtttgtattataaaaatagcaattaagctatgtaaatttcaagaaaatttcaatgagtgtaattaatatagaaaatttaataaaaaataaatccaaccataacattttatttctcacacttactttacttataaattaatttaattatatacctacctacttaaaaaatacccaaatatttcagaaattttgtgtttcatttaattataatttaatatttttctaattcaattttatttttttcttttcgtttcaacgcacgaccaattttgctataatttcaaatagtgtaattaatattgcagaaaatttatatttcattaaattagaatttaatatgttttaattcaattttcttcttttttttcattccgttgcaacgcacgggcatttttctagtaataatagagatatagataaagatagctagagaagtagaacttggtccgtccgtctacccttattaggatattcatggggattgatttggggagtcaatctcccgcgactttgggaagtcgatcttaaacgactctacatattcgcaaaccctgggaaaatggcgaaacttaagcagagcttcagccttctcttgctcatcgaacccatcgcagtatgggccacaatatattttctcatattttgaagcaccctcgttggatctgtgaagagcctctgcatttttcttgaatatcttgaaccggtgagtcatctcagcaaggtcacgcttcttatcgtaagccttgcaccagcgctcatacatggcccctatggcttcatcagactcaaaatccttgtccgtaaaatcgtcagcagactcatcaaaattcgtcaaaaaggcacctggctcatgaccatcatctatcacaatggaacaacattaatactgtcaagaacagcgagttggcttgcaagtttcaatttggttcctaatttgcgagcataaatgtctactattgtaaacattaaagatgtttttgtcggtactttggtacgttatccgtgtatgagttggattttaagttcgttcacttttggaaatacatatccatatttaagttcggttttaatctcgttcacttttggaaatacaaaatgagtcgtataagaaattctttaaaaaaaagattcgcatgctaacttgatatgattttctagaaaaatatatatctaaacaattctcacggtgaatttcaatgaacaataataagattaaaatagcttcacctgttacaacgcacactttttctagtctaaagaaaactatcctgcctaatatgcccatgccctgatgatggcaatcagaaggcccgtaagagcaggtacaatagcaggctataagccagctataaacatattttaaagagataaacgaagagagagaagagcagcgggctatagatctgtagccagctgcagcacggactccaagacgtaatgtgcgtatgacaggtagaaccgagtattaatagtatagtaagcaactattatatgaattggctattacattagctatagatgatttgtagttagtagttggctatactattaaacttgctctaataagattggggggattagcttacctgatggatcgtaatcgtcgaggtaacataccgcgcgtgcagcgtgacatgcggcgacggcggcttggcgtgctgcgcgacgtgctgcgatggccgccgagtgtggagattatggttaccccatatctacatagcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctctcaatcatacaatcaataacatactcggcggaatcatccccggataggagtagggtattacttcttgaataagaaggcctgaacctgtataaaattctttttctccaaacccatccactttcctagcttgatagccacccccttttattattgccgaaatcttgttttgacagttggcgcgccaggtaggggttgcgtcaagttctcgccgactaagtgcgatgggtttcgtttctggcatcgacgactgcgccttccttcctgggcaggcgttccggttcggcagcctcaacttcatcaccaacgacttcggcaagatctctctccttgactcggattcaaaccagttggggagagaccaggtcctcgtgccattcggtattccgaactcggccgaggcctactccaagatcatctctcccaagtcggcttcaaaccactcggacgagatccaatctactcttccgcgaccagatcaagacgacgggtcctatccctcaatcctgatgaaacttcctgatgatttggccgctgttttcactgtcaagacatctcccactcgaagatctaggagagctccggcttcggccccgatccaatctagatccagagaggttggcgttatactccaacctcttgggacagtctcgacggaagagttggatggttaccttagctcccccggcgtcagttctcgaccaaccgagatcctcgactacaacgatttcggctaccactatgaccatggcgacctcgacaacttcgatgacagctctgaggataactacacgcccctcttcttcggcgtattcatggctgacaacgaaatggaggaacagcgccaagcccgagaagcggaccaagatcgcgcaaggcaagaagctgaacgtcgccgactggaggaagagcgacagtgacaggagcgagaacgactacagcgttagcaacaagatcgcgaacgggttgcaaaggaggctaaagatcgacggcaacgcgccttggaatctgggcgccgagcgagagagctcattgggcaacaagacgtcgatggaacagcggtctttcgcaccccccagcagaacgcggttgcagcaatcactctcctcgacaccctcctcaaggaagacacactcaaccaagctgatcatgttgtcaacatcttgaatcagacgaagaccatgatcgctgcctcggttccagccaactccgcaagcacccgtaccccgactagtagccgagtccctcacttccgatctcatgattatcatcagccaagcctcagcatcatcggcacaggatctagtcgcaggagcaggggtcacgacgaacgatcttttcactcgcctcccgaacgtcacagggagcgccgagctaaacggcctcactctccacctcaccagcgtcccgtcgaccttcgcgacatgatcaaccagcgccgtgcagcgcgaggtcaccgccattcaccaaatcgctacgacgacgacgtggatggagtagctgccttcactaatgacctgcgtcgagtggattggccagccagctttaagccgactggaattgagaagtatgacggcaccactaatccggagtcttggctcaccgtctacggactcgcaatccgcgcagcaggaggagacagcaaggccatggcaaactatctacctgtggccctagcggactccgcccaatcctggctcaacggactaccccgtggcacgatcggatcatgggcggaacttcgtgatcacttcattgccaacttccagggcacctttgaacgccccggcacacaatttgatctctacaacgttgttcagaagtctggagaatcccttcgagattacatccggcgcttctccgaacaacgcaacaagatctccgacatcaccgacgacgtcatcatcgccgccttcactaaaggcattcgccacgaggacctagtcggcaagttcggatgtaaaccccccaggacggttaagcagatgtttgaaaaagccaacgagtatgccaaagccgaagatgctattaccgcgtccaaacagtcgggcaccacttggaagccaaagaaggacacgccgaccgcaggagggagtggaagtaacaaccacaaggatcgcaagcgtaagcctgaagaacttgtggcgaccacctctccatcatcctgacaacgttcccgcgtcaacaccttcgacaagataaagaactcccaatgtccgcatcatcccaactccaaccacgtggccaaagattgcttcgtctacaaacagttcgcggagcaatacgtcaagaacgcacgtaaaccttcagacggagatcaaggcacatcaaagaacaaagatgatgaagacgatgccccgactggtttccaagatcatcgcaaagaacttaaccacatcttcggcggacccctggcttatgagtctaagagaaaacagaagctaacagaacgggagatcaatgcggttcagcctaacacgccccaatatcttcggtggtcggagatagcaattaagttcgaccgctcggatcatcccgactgagtggtccaccaggggcggtaccccctggtactagacccagtggttcgcaatgtcaagctccgacgaactctcatcgacggtggcaacgcactcaacatccttttcgtaagaccctggacgatatgcagattcctcgcacggagttaaagccgagtaatgcacccttccacggtgttatcccaggactgtcagctacaccactcggccagatcactcttctagttaccttcggcacgggggaaaattttcgcacaaaaaatgtctgtttcgaagttgctgatttcgagacagcatatcatgctatacttggacgaccagctttagctaaatttatggccgtcccacactacacctacatgatgatgaagatgcctggtcctcgaggagtcatatcactacgaagtgacatcaagcaggccgtcacatgcgacaaagaaagttgcgagatcgcccaaacccacgagactattctcgcccgcgaagagatccgactggctgcgaccacgacaagcgagggagaagtgcctgcaaccaagctgacgaagaccgaagaaagcgatgccaagacgaaaaagattcccttagatccctccgatcctgataagactgctgtaataggcgctgagttagattgtaaataggaaagcgcgctcatcacctttcttcaaaataataaagatatttttgcgtggaaaccatccgatatgcctggtatccccagagaggtgattgagcactctttacatgttaaggaagacgccaaacccatcaagcaacgactccgccgttttgcacaggacagaaaggatgcgatcaaggaggaattaaccaagctgttagcagcaggcttcattaaggaagtccttcatcccgactggctggctaacccagtcctggttcggaaaaagacggggcaatggcgtatgtgtgtcgattataccgacctcaacaaatcttgtcccaaagacccttttgggttacctcgcattgaccaggtggttgactcaacagccggctgcgagttactcagcttcttggactgttacttgggatatcattagatccgactaaaagaatccgactgcttgaagacctcgtttattacgccctttggagcctaatgctacatcaccatgccctttggattgaagaacgcaggagcaacctatcaacgcatgattcattgatgtttttcaactcagatcggtcgcaatgttgaagcttatgttgatgatgtagttgtcaagaccaagcagaaggatgacctgatcgcggatttagaagaaacttttacaagcattcgtgctttcaggatgaaactaaacccggaaaagtgcatcttcagagtaccgtcaggaaagttgctcggatttatggtatctcaaagaggcatataggccaacccggagaaaatcaacgccatcctcaacatgaaaccgccaagcttccaaaaagacgtccaaaagctgactggttgcatggcggcgctcagccggttcgtctcacgactcggcgaacgggggatgcccttcttcaagctgctgaaaaagactgacaattttcagtggggacccgaagcataaaaagcctttgaaaagttcaagagacttctcactactccaccagttttggcctcgccgcatccacaagagccgctactgttatatgtgtcggtgacctctcaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcagaaaattatctcactattttcaaagtcactcggtcacggtagtcacatcgtttccactcggagatatacttcacaatcacgaagcaaatggacggattgcgaagtgggccttagagttgatgtctttgaacatatcattcaagccacgaacttcgatcaagtcacaagctttagctgatttccttgccgagtggaccgagtgccaagaaaacatgccagaggaaaagatggaatattggactatgcatttcgatgggtcgaagaggcttacaggcactggagctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttagttgttaatcaagtcatgaaagagtggtcatgtctagatgataatatgactgcttatcgacaagaggtacgcaagttggaaaataaattcgatggactcgagctcacccatgtcctccgacataacaatgaggcagccgacagactggccaattttggttcaaaacgggaagcagctccttcagatgtgttcgtcgaacatctttataaaccgaccgtgcccagaaaagagacagtcgaagccatggatgctcaaggcgtaagcatgattgaagctgactggagagaaccgtttataaaatttttgagcaaacaagaactccctcaagacaaaaatgaagccgagaggatttccaggcgcagcaggctttacattattcatgagactgagctgtacaagaaaagtccatcaggaatactgcagcgctgtgtgtctttggaagaagggagacagttgttgaaggatattcattctggtatttgtggtaatcatgctgctgcacggaccattgtcggcaaagcttaccggcaaggttttttctggcctacagctgtgtccgatgcggacaagattgtgcggacatgcgaaggttgtcaattctttgccagacaaactcatttgccagcccaagagttacaaaccatcccgttgtcctagccgtttgcggtctgtgggcttgacatggtcggcccgtttaaaagggcagtcggcggttacacgcatctctttgtggctatcgacaaattctccaagtggattgaggctaaaccagtcatcacgatcacagcagataaagctagagattttttcatcaacattgtgcatcggtttggggtacctaatcggatcatcactgataatggcactcaattcactggcggagcatttcaagacttttgtgaagacttcagtattaaaatttgttacgcctccgtggcacaccctatgagtaacggacaagtcgagcgcgctaacggcatgatacttcaagggatcaaagcacgagtttttgaccggctacgtccctatgctggtaagtgggtagatcagctgtcgtccgtactctggtctttacgcactactcctagtcgggctaccggccagtcgccgttctttttggtttacggtgcagaagcaatgttgccgagtgaagtggaatttgaatcgctacgatttcggaacttcaacgaggagggctatgaagagggccgagtagacgacatcaatcgactagaagaagcccgagaagcagctttaattcagtcgactcgatatttgcaagggttgcgccgttatcataatcggaatgttcgatcgcgagcctttttagtcggtgacctggttatgaggaaaattcaaacaatacaggatcggcataaattatctcccttatgggaaggaccgttcataattgctgaagtcactcggccgggttcctatcgactcaagcgcgaagacggtactcttatcaacaattcttggaatattgaacaccttcgtcgattttacgcttaggcatttcgtttgtatctctcctctttgactgctaacttcaagtttttccttgaagttttcagtcagggggctactataataataatggagtgtgatttttatcaattcaatttgcttacttgatgtatcattgccctgtttgatttcttggcttagtcaatgaggactgaaagttttttaacaacttttgcgggttttaggctcaacaaggtttggcaaaaacttttaagaaatcaggaactaagttaagatatcaagcatagcataaattcatcagtattgtacaaattgtgcctccatcatcattaatcatcaaaatcattggtacagtaatcagtatcagtcttttcatcatcagaattatcaggaccagtcggtcgaagatcggtgtcctgaaatctctcaactacatcagcagcaatcttgtcagcggctttttgtgcattgctgatgaggtcaagagcagcttcttcgctcgtcccgtctgcaaagccatcaatggcatcaacgtcaaccctcgaataaagagatttggtcatcgccaacgccagacttgctcccatacttccagcttctttgatgttcttgaaatatgtatccggagcaactctcagcttgtcgaaaatttcagaagcatcaagtacactcgggccgttgttattgaagaacatcgcttgaacaattggggcagcagcgttagcaacctcatcccgggttccttcgagttttttgatcttgccaaccaggacgtcgaattgagcttgagattgatcttgcggtctgcatcaacagattcacattaataagttagcatatggaggataatggcttttgaggtattcattgttgataccttcaacttcctttaaagccaggtctctttgtcttgccagttctgccttgtcactttccagaatttgaatctggttctccaactgagatatcttggcagcttgcactacattgatcacggttaatcaagattgcaaagataacagtatgagtcagttgagcagagtttgtgcgtaccttttgatgagccactcagttcaaaatttgattcctggagctcagcgatccgatccctcagatcatgttcattcttcctagcaagttctttcacttcgtgcagttgattcctggtggcttcgagggttccgagatgagggactaacctctctaaggttactgttttggcttcgttcctaagatgaatcctctgcaagatagtttaattagcgcgtgaattaaatggcaaacaagatggttgaaatcaggtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatacgggggatttcttcttcatcaccaatcattggtcctaatgtattcactgacaaaggttagacaatcgatcagagttatttgggtcaacatggtttcagacaaagtgtttacccgtgatgatttctggacgaggacgagcggattcggatgcctttaaaggagatccagatctctggttattgtccgcgttttgtctgcgagggctgtctgcttgggtttcgacttctagaatctcttggcttggccctgcgtccgactggtttccagtcgggggctcctgattaactccggcttcggcttcggccgactggtttccagttgggggttgatcaccgaattctacattatcagttgccggatgattgtcactcgggtgatccccaacagttggcccggtttctttggaagaattcgtgcccatgttagtcgggtcagagtcttttccagacgggtctatatcagatggtttcctgcaaatttgattatcagtattattgccgcaatgggtgcgtatcaatacaagagagatcgttatatgagttgcacctagaagacttcctgatctttggcacatggcgactggatgttttcttccttggagtagcttgttttggtagtttcttggtcgtctctcggtcttcaggcctcctggtggtatcatcggcttcgtcgtcacttagaaccaacttcctctttcgataatctgactggccgactggatcagaagcactaggttgagtttcagaccgaattcttggtcctccgctcccttgcccagtttggtggtggggagatcggcgttgagcgattgggggatccgactgcatcaaagcaaattcctggatgtaatatccttcattgttagctgattcaacaagaaaacaagatcatattttgagaaagattgaagtgtatgaatacgtactggtggaggaggattgaatgcattgaacggtacgactggcagcaagtgtgagtagctgacaacgatggcgtttgagaagagcttatacatcctttccttcatgaccttgaagtcaagagaatctggatcttcacggtttgggtcatgcttgccgtcaaattcgaaggctgtgcgagatctttctttgattggagctaaccgacatttgataaagtgccgggtgatctgttctccttgaaggccctgttcttttagctttatcatcctctccatcagttctactgcttgtgcagcttcgtctcccattagcagtgagttccaagtatcccgataaactggaggaagacaggagtactcgggaagaacaggctcggggttttgaacataaaaccagtttgcgtgccagcctttatttgaggtcttgaagggcatggagaagtatttttggcttagtgttcccctgagttggaaaccagcacccccaacgacgcatggtttgctcttatttggctggggcttgaggaagaaaatgcggcggaataaggcgaaatgaggcctaatgcccagaaaagcttcgcaggcatggataaaattggcaatatgcactatggaatttggattcagatgatgcaagctaatcccgtagaagttcagaataccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgtcgtgcgccaccatctccttcagattgtcttccgtcacatcggagggcgcccactgactctcgaagctttctctttcttccgccatgaatgagaactgatgatttgatttagttcgagatacggctggaaagggatggggaatcggagcggtggatgcgggaagagatttcgtgaagttttttaagggtggattggagcggattgatgaaccctagtttgcccggcgcaattttgtactgtagcaggaaatggggaaaatggcgagagtctcagcggggaagacgaaacgacgtttggacttcggtgtttttagggtatcgggagtactaatgggccctggcctgtacagtacttcagcccaattatgttttcagcgtggcccgttgtgatccctagggacttaggcgctttttgctttggcaatatgtgctcacaatgatgcggcccgatgctgttgaaatcctttttaacgcgattcaataattctttggaattattatgatgcacatgaaaaggtgcccaacataaaggtattataccatttttgtaagcttttttaggctacgaaagctgttgggttaatttgagatgactggtttgttagtagtcattctcccagcatgttatatgcttattttggttatggtaagggtcacagcctaggctattagactcattaattaccatgattttctatcatgtttgatgggtcattttatgagattcttactcggattcctatcaaacatgtctatttttggacctttgagtgtttatcactcggcccttttcatattttttgtccttgatatattcaagtgagaagcagtcggctgggtattttattgagtaccatgcatgcttcgatataagatcactcggttcttgactatatgtttaatttttcaactaatcacatagtcgggggttacacctaattaggtgcatctactcgatgcaccatgttttattttcgcccttcacagtcttctagcactcggtaagccggagcaagttgaattgaagcactcagattattgttttttgtttcgagaagactattttggtcaactgcgaaggtctcgggggctactgtggagattatggttaccccatatctacatggcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctcccaatcatacaatcaataacatactcggcggaatcatccccggacaggagtaaggtattacttcttgaataagaaggcctaaacctgtataaaattctttttctccaaacccattcactttcctagcttgatagccacccccttttattattgccgaaatcttgtttcgacaccgagcgtgcacaaggactagacgacgcgaccgccgaggagcgcgcggcacgggatgcggcggccgcagctaagcgggcggcggctcgcgcggccgatacgtcgcgggcgagcgacgccaccagcgccgccgttgacatgggcgagggataatcgattgaagaggaacggtaaaccctagttctccccacccgtcccggccgactgatccgattggagtatatatatatatatatcattaatatgcagtagtatcggccgagacggaacagtggatatataacaatctttctgctgctccgattttgtttcatggatactactgcttcatcgaagaggaccagtagatgaacaaaattggagcagtggatatatagcaatctttctgcgccgactggtccatgaaacaaaatctctttctgctcttcctcttatgtggtgatgctgcgttcttgactgccagtgtagtagccatgaatttttttccttgggtaagttcagttcgtaggttcacaacacatgctaaaattttctaacaccaaaaaaccgatacacaagtacaaatttaatataaatgcgataaaaatcaacattcaacaaccacaatttacaaagtgcatactcaatcattctcagattcatgaatcacaaatcgatttatgaagcagccgggagcggagagctggagacgggcaccggtagacgccacgccagacgggagacagcgggcggcggctctgcgacaagacggcaaccggccgacgtcccgcagcaaggcggcgactggcgatacaaggagaagttgtaacgtcgtcggcccccagctcggcgccgcgatggcgcggacggcggacccacgggcgtcggcgctgtggtgtggctcggcactgggctgcgccggcgctaacagcggacgcggcgtggcgccggcgcggacagcggtcagtggcggcgtggaagcgggcatcgggcacgaagggaatagatgctggaggtggaagcgctccaggctccctcaactcaaccctagctgtttgtgggctgttagagatgcctctaacggagtggttatttttgactctctaaatatctatattgccaggctgataaaaatttagagagtcaaatttatcttctattccaacatactattcacattccactctattaaccaatggattccgcctgtcattctcctcctctttcttcttcctcccctctctccaatccttagcccgtgctcctgctcgtgccagcgggtttggcggtggcgaaggcgtcgagcatctcaagttagcatttttctaggagtttgactttcatttcaagttagcatttttttaaaagaaatttcttatacgacttcttttgtatttttagaagtataaacgaacttaaaaactgactcaaacacagaactgtatttccaaaagcaaacgaacttaaaaaccgactcaaatacggatcacgtgccaaaataccgacaaaaacatctttattttttataatagttgagataaagataaagatagagaagtagaacttggtccgtctacccgtattaggatagatttggtgattcatggggattgatttggggagtcaatcttccgcggctttgggaagtcgatcttccactgctctacaaattcgtgaatcccgtgaaaatggccaaacttaagcagaaattcagccctctgttgctcatcgaacccatcgcagtatgggccaaaacatagtttctcttcttctggagcatccttgttggatctatgaacaagctctgcagtttccttgaatatcttgaaccggtgagccatctcagcatggtcacgctccttatcgtaagccttgcaccagcgctcatagaaggcccaaatggcttcatcagattcaaaatccttgtccgtcacactgtcaactagatcagtctcaaaatccttgtccgtctcatcgtcagctggctcaggaccatctatcacaacagcacaacattaatactgtcaagaacagcgaattggcttgcaagtttcaatttggttccttaaagttatcctgcctaatatgcccctaacctgattatggcaatcggatcagaaggcccgtaataagatgggggaggattggcttacatgatggcaatgggctgggaggagcaggagttggctcgtagtcgctgtagtcgtcgaggttataagacgggatgcgtgacaccgcgcgcgcggcgcgagatgcggcggcggcggctgagcgtgccgcgcgacgtgctgcgacgacggccgccgagcgtgcgcaaggactggacgacgcgaccgccgaggagcgcgcggcgcgggatgcggcggccgcggccaagcgggcggcgtctcgcgcggccgatacgtcgcgggcgagccgcgccaccagcgccgccgttgacatgggcgaggcgagtgatgatcgatcgaagaggaacagtaaaaccctagttctccccacccgtcccggccgactagctgctccgattggagtatatatagaacaggaataagttcacttgccaagtctaatttaacgcttttgctattctgatcgcgacaccggggggccaagacgcgatgcttacacggccgagtcaattgcgcattgacagtccattcgtggtgccatctgctacggcatacggctcgtcatctcaaggaagcaacaatgtctcacacagcagtcaagaacgcagcaccaccacacaggaggaagagcagaaagagattttgtttcaacgagtcagggatttccaaggagaagtggatgtagagctagctagcttccccttcatgaatggccgctggtacatcggcacgccctcgatcgtcgttgacagccttgaatgaatctgcaacaagatgacaggcgatatgagtaaacaataaaatggtttctaaaatatgcttaaacaatcatatggtttttgatatatgcggctatgaatctgcaacaagatgacgggcgatatgagtaaacaataaaatggtttctatatataatgctgcttaaacaatcaaatggtttctgatatgctgctgccctatcgtgagttttctttgtagtgtacaagttgggacttgggagacagctaaacatcgtttcaatgcttgaaacaattttgccatagcaaattactcccccatcccaaaatacctattttattgtaaaagcctatccaaccaacattgccacgtcaaaattatctctgcctctctacatacatgaatatctattcggctttttcttcatacgtggatttatagtggtacttatcagccatatcgtctcataaaatgtggttgtgaggtgaaatcgggttagagtcaactaacctaaggacgagcttgagtcaaactaacctcatagctagccatataactatccacactgatatggtccgctgcgaatccatgtcagaagaaatgggttgaatcaaatgtttgtgaaggggatggacttggcagtgctgagtgagtgggcttttgcaacaaaataggttatgtggtggaatatcaaaacaagagcgataattaatttggatggtttacataattttttagtgctattgttcttgtaaaatcgataaataattttaaattaaatttgctgaaaatctactgaggccctgtttagatccctccctaaaatttttcaccctgtcacattgaacatttgaacacatgcatgaagtattaaatactttgcgactaatttacgagacgaatcttttaagcctaattactccatgatttgacaatgtggtactaaagtaaacatttgctaataacagattaattaggcttaataaattcgtctcgcggtttaatgacggattctgtaattagttttttttattagtgcccgaacactctatgcgacaccctatataatacctgatgtgacacgccaaaactttacaaccctagatctaaacaccccccgagtaaagcactcttgtaccatcaagcaaactatccatggaaatgcagtgcctctgtgtcatgactcatgagagagagtgactactattttttttctttttaccttttcatgagtgttctttgcttgatccaaaacacgggggcgcatttagggaaggcatcactggaggcaggctgctcaagtaatgcattatccatattcgattcaacccaaccaaacctaacccaaaataaaatgatgcctatatacttctggcagttgaccttccatcctgactagccggcggttcaacttatttttcagaatctgcatcgagacagaacagaggagaaagattcagaaaaaagaaaaagaagaaggatgtaacacatctgtctctgagcaaccattgttcggctctcaagtaccagtcggttggtcagatggaataaggttgctgcagtagcagtccatttctcttgatcttgatttgagtaggtgtgaagcaaaacctcgtgtcaatttggatgactttgtatatatgtagctgtcattgaacttcacttctgaaacctgctaaatttgaagtcggtatctttgcccatgtttacgctgtatctgatcaaaaccatttataagcatctgtggtttcactcaacccggcgaaaaagatgttatttagcgatgaatcagatattcagttgtaaagaagtgctcgctatagtattcataagtaaacaaactattttttggacaatacaagaggtgacttctattcttctagaatgcaaaggaagcaacgatttgcaaacaggtcaagcaagaaaatctcttctttttttttttttctgggccggccaaaggatgattgaccaatttcattaagagaggggaaaaaataaatagccaattacggagtttgttacatcgacgtgaaggatgtcgagggcgatcaaggccaagccttagatcaaagtcgttgtaatgtgaagcaggagtagtaccgttcaccaaaaaaaaaagtgaaaatagtacttcacatgccaccttgagaaattccttgttctcaaggcactgaaaggactactataattgcaactgaaataaaaccttggcttgcaatgcagaaactggactcgaaactcctcaaaatggccggtatgcttcacacgactttggaatataataaaaaccgtaagagaaatacaacctgtcgaagcaaagtcaaatcccaaacacacacatgattgcattgaccattacaaaccaaacaattcgacagatagtaagctacgcaaggacaaacaaagccacagcaaatcacacacaaactcatcttattttaaacatatttgaatctttttttcaaaaataaaaaaaaccatggccatatgcccatatgccattgacctcgaaaccattgcacaacctcatcgtctccttctctctctgtccaagttgtgtgtttgcaacatgcaaaagcgttgacgtcgcactcgcaacctccccctccctcgctttggatccaaacaaaaaccgcaccaaaccatcgagctcagccgcggcgcgcgcgcggcgacaccaccaactcgctggctcggcgtcgat

SEQ ID NO: 51314 - DNA, 7116 bp, Oryza sativa
caccgcggccgatgcagcggcggcggcgggatcgtcgcggcggcaccgcggtgggggtgggggcggcggcggcggcggcggcggggccgggcacgaacacgacgacgtcgagctcggcatcgacgaggcgacgctcaaggggtacccggaggtggtgtacggccagccgaggaaggaggcggcgaaggcggcgtcggcggcggcgacgaagaagggcggcgcaaccacgtgcagctgctgctcgatctgcctcgacaactacggcgacggcgacgtgctccggatgctgccggagtgcggccacctgttccaccgggagtgcgtcgacccgtggctccggcagcatccgacctgccccgtctgccggacgtcgccgctgccgagccccttgccgacgccgctcgccgaggtcacgccgctggcaatggcgaggccgtcatgacacgtggaggttctttgcttggttttcattttttaaaatttttttcttattcatataaaactaaacttgaggatgaaatttgtgtattctgcaaaatggaatgcataaaagaattcctcaagatagggactagaaatttcctcttggtaattgggtgtaaatttgggttcagagtagattttcttttctgatataaacaaagtttggcataggattctctttggaattaggattcactttggatttttggagggagattatgtatggattacaaatttggatgaaccttctagagatctaatttttatatcatcaagcttagtgcagaagaacgaagatgagtgtaaacaaagtaagaagtaggaacatatttgcagaatgctttatatatgtaaaattctatcatgaatatctgtaaaattgaagatgcacatttcaaaaggaatagatccttttaattaatgctcttgcatattatctagaaattgaggttgatgaggatatggaatgcagtaaacagattaacctcagttcaaacactcatgcattgtactcttgatgaattaattcaaagatctactaggtgcatatcaaatgatgacatcagcaacctatatacggccgtcccctagatacattgctccttcccccaggtttttgctgggtcaatcagtttacgccaaaatcattactttgtgctttgaagtaacggatataccaatcatgatgcatgctcttcaagaaaagagagcaaaagtgaaaaatgctaatttggcctaaacaaggcaagagtgcaagacgtatctacatcaagcctttttctgctaacaagtgacaacaacagatgtttcttttacaatttctaggaaaagaaaaggagaacttaattaggcaaattaccttcacatctgcagtgtcctgccacagaagctatggaatcattttcagctatgttgcacactgcagagtctttctatgatataaaagactcactgtgccgctctttggtatgatagacaattaggcatgggcaaaaatctggacaccaaactccatgacatcatttgaacagacagatctatttgcaaagatttggtccggaagaccggaatagtcgaatatatattgtgaatatctgaataaattagaatgtgattgtgatcattttcaggttcatctctgatcacatggagaacaagagcttaaaggaatgtctgcacgttgtgatgcagattacaaactaaatctttgcaaacgaaataaattctaaaaaaaaatcgaagcatcaggtggaaatcctgccattccctgtaggaaaaatattgcagcctggttatgtcagacagagtggttcagaatgcataattcatacagctctctgcagaagccatcttatttttgttcatgattcatgaagcacctagtcgctcccctgctgctttgtttttgactgtaaataacttttatttctcttaatacaaaatgcgctccttgcgtattccaaaaaagcacctagtcgcccttacaatcttcgtcggtgtcaattcctgcatcaatggcaccgggctttggttgataatgatcatttagtccctttcaagctttcatgacatgtgagttaagagtaaaacataattaacaaataatctagcacagtagcactagtgcactcgcattgtattattctagtacaggtccatgtgacttcgggatccaattcagcttcaagctggccaatcaagcaagagaagagaaatacaaaactaactccatttactccaaagttccctcacaatgaccaactgatcccaagatctaacatattaaaaaaatagcaatcagtctgaaggaaggaaaatctagttagcccagtgtatacaaaaatacaagtaacatcacattaaacaattgaacgttggtgtacagtcttctcttccattctttatgatcgaactaactcaaacaagaaactaataggaaatattagtaaattaaaatctagctcaggggatttagttttcatccaaggaaaaatgaaagagatcacgaagaattacggacatgtagatacagtttagtaaattccagtgagatcacagattcatcagtggtctccatttcttacatgtgtattgaagacactcacgagtcaccaatataagcatatgtatcttccatgtaatcataaaataaaagagatcaacaagaaactagcagccaagaactaaaacaaaacttttttttttgtaagtcgggaacactattttgctatatatattgacaaattttcttccaaatatttatcaaatgtaaatactgttttaatccaattcaggtggggtcttcccccccgatgttccatgaagaaaatgtaaatactgtataattacagtacaattacattcgaacttgtataactataacttatatgttacctttacataatcttgaaccattagtttgattacttcaatttctatgcaagttgggaagaaaaaaaataatagttgcaagttgggaagaaaaaaaatcatagtgcacacacgagtgaggatatttagtcccacggcgtccgctttgcaaattacgaattgtactgcatttacatgcaagttacgatacagttataatatgattgtactgtatttacatctgataaaatttcataagtatatactaggaattaataggcaaggagtagacctgagcaactaggcccattaaaaggcccataggcaggcatgagaaggccgcatccatcagcatttcagcacgcacctgagacctgatgatttgagtcctcgtcgcgtcgcgtcgcgtcgtgtccacctgcgaatcctctagtcctcgcgagtcgcgacacgcggagctttggcacctgcagcgatggcgaccgaccaccgccgcttccccgtcttcctcgccgcggcgctgctcaccctcctcctcctcccggcctccgccgcggccaccgacgtcgagtactgcagtgagtgcttcgaggcccttcccgtccgcagcttcgctcgcctcccgtctcgtgtcaagcttacgtttccgcttttggtggggtggggtttgttgctgcagggcaggggcgggattatcctgtgaaggtgagcggagtggagatcgtccctgaccccgtcgtcagcgggcagccggccaccttcaagatctccgcatccacgggtaagcaccaagcaccgatctgttactgcggcgggttgcagtttagtgcggtcatgcggttgggggatttactgggcatatgcagtagtcggatcgggagtcaaattagtgtgggttttgtagcgctgtccattcactggcattattgaattggtccaatttgcagaacagtacaaccatgcgatggaatttttgttgtaaggaagtaaagaacaaactgctggctgttagaaacttagaacatggaaatattgcgctgcagcctgcaggtgtttctgttaagactgcccttcacaaggcatttttcattgcgatgctacttgcagatggagcacctaatgtttgttggttgcaacttgcaaattgtgacaatgcgtgcatctgtatatgcatgctggatttagtgtagtttgccatagtttcatgcccattccttgtttgttgatgcccgtgtttgagcttactatgactgggtgccctggagttcatcatctgtgcactggtatgacacgtgttcattgtgatcccgcttaaattgttctgatagcaaaggggagagaatttctacaaataaagataagctaactgtttcgattttattcaagaaagcatcctttctgtagagtacatttgagctacaagtctaaattccagcaacagaacaagggaatttccgtccacctagtttaattagcttagtttaattagctttatattgtttgtccaacatcctgctcaatacaaatatgatgcggcctctcacttcatactaagtaaaacaaaagtattaacacgtgttttctgtaaacatcataatacttattcatctcattagacatagtgtagcattaaccgttaatattctgggactatttgacacattagaagtttctagttgttattctgtctacttaatttagataacttgtgaggaaagctagaatacctccgtttatagttgaaaaagatcaaccaacaataagtcgataaagttgtgtgcattctttccacttgacatgtcggttacttttgtgtattttactaactttgtttgttgcatgacaagtatcatggcactgctcacttaacactcagtgaagtactgattcatcaaaagttcttggtatggttgtcaagtgtgtgtatggcttaagcatgactacagtacataggcttggatatttgaatgtatgaagctctggcagcacagctgctgtcactgtcttttcccatgtgttgtttctatatttcggtagatgcgtggattctttctttatagggaatatttgagttttgctcatatttcatgacattatgtgccaaacaaaattgaggagttgttgaggctgtattcattcagtaatttgtttgaggaaagcaaacatagcatataatttgaagttaatgatgagtattcaattaatacaaagatacattacaaatatatgcttcctagctcacttttcttatgatgatatttgatttttaaaagctactactataaagttttacgccagtagattcttgcctttgagtactgactggggactttttcatgactgctgccagataaaagcatcactaaggggaagctcgtgatagatgtcaagtacttctttttccatgtccattcagaaagtcacaacctttgtgaggagacctcttgcccagtaactggtgaattcgtgcttgcgcacgaacagactttaccatcaatcaccccaccagtaagcatagctgcagcatgcttttagttctgttggtgaagaagatattcttttgttaatgaatttcctaactacccaagaagaggggatagagaacatgtccttatatgacttctaactttctgtatgacattctaacataatattgtgttgcagggttcttacactctcaccatgaggctactagatgacggcaacaaggaactgacctgcatctcgtttgggttcagcatcgggttcatttcacctcttgctctcatctaaattcagctggagtcacagcaatgtacttgcagaactcccatagtcctaccacaacatgttccactaaagccggtttaatctccctgagttgaacatcttactacttctggtgttatgcaataactatagtcaattgccgcttatgttcagtatacttgattggacattgccctgtcgttgatctgtctctctgctctggctgtggagtccggtcgctttcatggaagaattgaaatgggaccattgcttcatttccttgatggcttgtcagcgtcgatcacctgtcatggttgggactaaacccaatcagctagacaaggttattgcttgctgactagccattatcaccctaatgcacaagcacaaaaccggcagccgtttgatcatggtggatgcggacatgcggttgttgtggagcatgcacttgcccatgcttattagctctaccaagcaaattttaggtagaccgctccgcgtgcgtcgaatggtttttgtttcatgcaactcggcatttacaggtcacctctggatatttgacctgttttttatacatgtaaggacgtcggatataacacagacactatttgtgaatgcgagtgcatacatgcttggaatcttatgagacttatgtgttcttatcagggtttttgcgttatcgcgatacccggtgttatcaatgggcacctataacaaatttcttcaaaaattgtcgataacggttctcaacgcgtaacaataactcctactagctaatagctaataattgtaatcgataaggtaaaaccggttctatttttaaaaatttatcctaaagtacaacaactagccatcttaatctctaaaatttatcttaaaatataacttctccaccagtcttattatcttaaccaattataaccatcttacacgcactttttttaacttgaccaatcaagaccatcttaatcaccataaaaaatacaaaattgtttatattttaggacggatggagtgttacacatgctacaaatatagtgtttttctcgaacatatgaattttacaggattttcgtacataaaatttcttcaaatttctccgtcttaaatgagacgacttaatagtaacacataatttcccgctaaaatcctggtggggcgtaacggctctagcctagccggccccgactcgaactcgaacgttaaccgggggcggcggttagttaagcttgaggaaaccgaaggcgggcgtacgaaatacgtattcgttgtcagcacgcgccccgcgcctacggctagcaccaaaagggaagggctgcgaggtacacgggcctcctcgcgagtcgcgagagccctagccttccacccctcctctctctttcccctctccaacccgcctccctctccgcgccgcgcgcctcctctctctctctcgcttcctcgcctccgcgccgcgccgcgccgcgacaccgcctctgcctccgcggggggatggagccgagcccgtacggaggc

SEQ ID NO: 51315 - DNA, 5210 bp, Oryza sativa
cggcggaggcggaggacgcgtacccgccgcagggtggtggtggtggtggtgggtgggtgtcgaggctggtggacccggcgtcccgcctcatcgccggtggcgcggcgcggctgttctcgacggtgttccgcaagcgcctcgaccctgcgccggctccggccccgccgaagtccacgcctcccggtgagcctgtggttcctgtacgctcccatctgggaagactcgtgcttgctcccgcggttcgtgctcgttagctttgcgctagggtttcaatcatccagggcgttctagggtttagctcagattagctggttcctacttctagtctgattgattttagctataaaattgctatcctccttgatatggagcagtagactcgtgatgaaaatgacgctgttctacaatggaagtttagtgtggagtttcatcacctcctatttgtgtgttttaactttaaatcataccagagtgtcccattctcttatttaaaaccatagcagtgtactatttgcttgtctgtcccaaagactagaaggatttgatgctccaaggtaaaaacatcaagtgtagtatgatgaatgtatttatgccacttaaaacaatcttaattcagtgtaatatccggtctttttatttttatttaaaaccatatggaaagaatacagtatgatatggtcttattttgtctgcctgtagtattacctattgataattttgtgcttggtgctgcagtacgttactaattttatagtcgcttcatgcatgcaggaagcaataatgagccaaaccaaggcttacctgagtcaacacaaactgtaagttataaccaagtgcttgcaaaaaaaaaaaatcggttgtattgtttggcaaattgtgctttatacttttggttaacctattatattccgcttggtgtttttttaccctttattcctttatatttatataacaaaatctgatgcagggttcaaaaccaatcctcgagaaagggaagaaccccactggtgcatcggacaataaggcattgtctgaagtagagcacttgttaatgaggaaaacattcacaaggaaagtatttttcatattaatcttcttgaagtggtacttccatgataactgattttttagttaaccagtgaggtatcaaacaatgttgatttacccccagtgtaatggctatattggttttgtgatgttcaactcttctgttgacaatcgttggaggatcaaacattgttgttctctttccttttttgctggtgtcaactttttgggggtcctcttaaaattctaaacgacagcatctcttctgtcccgtgctttttaagctgccaatgacaatgtgattttgtatcagcagggttgagtttgaccgccttacagacttactgcgtgcaagaactgtggagtctgatttgtctgcaccggcagataaccttgataataagaatgaagcaaggaatacaatggatggtataggaggctccacatcacatgggatggctgcagatcattctattgctgctgatgtaagtagttcttttggtcatgaatattttttattctaaatgctagtccatgaattctggatattggataaatctcctcgagccaacaaagaaaatttaatcatacctggcaaacactgaaagtttatgttgttggtactgaggcatctgtagtctgctggtttggtttgtttctaatgccaactgatatactgtattaccctttttgccatcttcccattatggaagctccttttattgtctgattcttttaatccttttattgtctgattcttttaatgcaaggtaggctgtagttcctaaagtagccttcttgttacttgaactcgtgagtgcaaaaatatttttcgggtgcacacatgttagatgctgcattaattgctgagaaatgctgatttggatttgttggatctgtcattttttttaggcttgattgtgcatcaaagctctttactgaccttttaatatgtttaagtgctagctatataggatatgtgcagctaaacggccctttttgcagtgttggtatgccatatgattgttggattcaattcctacaaattcccatgttacatgcataaaaggcagtggattttacctttcgtttccatgctccatccaactaccatattgcagctttgctacttaggtttttcagtgtttttatttaggaaaaaagcaagcaagtgtgtccttttattcaacttcctttggaactttagtctgtgtttaattttatttctgtttattttgtaggatccggtttgtggtgctagttcacccgcagagctcgcaaagcaatatatgaattcccgttattcgaaagaaaaccgaccaaacagtttgcggagccaagtactcctgaagaacaaggcagaagcaagcaacattgcctatgatagaaggagacctggaggaccatttgtgcaagaactgagtcaatttagcaatgaaaactctgagcttcctgtgaatggctatgtaactccaggattacatgggcggtcagcaatatatagaatgtcctgttccccattctttaaggtattgtgtttactgcacataatgtcaaatcattctcagccatgttttcatgtgttctcaacatgccatactgattactggcgctcgaatttttttcttgttcagtataatgatgctctaacaatgatctcacagggaccaagctcttccaatgatataaatatgtcaccattttcatcatctcagacacgggctaatagtttggtttctggctgcaggcaggtaatttattagcactttatggaaacatatactgcattatatacagtatatattttaaatttgctatacacttagttgaacaagttcatgttactgagaaggtgttacggttgaataaactgtctagctattgaggttcttttctttttcttatatatgtctgtatcgttgcaaatgcaaagcatatatgtggtataaagtgctggtcatcatggacttgatagtgtgttgtgtcgtggcaacatctttagacttgcagggtttgcaccactgagaacattctccatgatatatgatctaaactagacataccagagcttctcttattcctatgtctccctaacaggtcttgaaacgaagaggtgccgaattggagaatgagcttggatctattggtcccatacgcaggattcgccaaaagtcaaatatgatgtctacttttagagatgctcgctcgagcccgcgaggaaactttcttcccaaccgtacaattggttcagatttgaccgatggcggttcacccattcgggattcacctagttcgaaaagactattgctggggacgggtcaatctgtggaacctgcagaagcacgtaggaatgatgaagatggtaaaatttcaagtgataatgttcttgctgcgtcacctcaatcaaacaagatggctgaaaagatatttgagcagcttaatataatagtcccatcaccaaaagagaagctgtctcttccacaatttgctgctgggaatgcaagttgctccatgtcaaaacaacctgttaggcaaggcaatgagccaaacgggacgagtgaccctagtagttcccagaaatttcaacctatggatagtgttaagcattcccttgatccagaactgaatggttcaccatcgagtaaagacaagctgagaaaagatggatcatcaaaacttctgtcacattcatttaaggatttaggcaacaaagacattaggtctgataatgttgctctatcttcagttgccgctactacatcaagcaaaccgggctttaaaatggctgtttttgaggtatggggaaagtttactcttggttcctcgaattatattaaacgctcactcatgtcctgagattattctttatcacctttttttgttgcaggatctaccagagtttgatgatgaccaggaggctcctatcccatcgaaaaattcaatgggcaagactgaggtgaagacaactgataaaaaaattgatctgaagaaggagcagaaagttgaaccaattttattcaaacaaaaagttgagtcaaattcagtgcagaaggctgtcagttctccagttagtgaaaagcctatagcatccgcattgaaagatgcccgtccattaggcttattttcacctaatgaccctgaaaacagggctactcatgatgttccttcagacaacaacaatggtttcaaatttccacatgtaccttctggcacccttctggagagttctgtgtcacaattgccacttgcttcaaataaagacgataagctgatcagtgcatcatcttctatatttggtctcaagcagtccagtacaccagattcagaacaaacaaacactgctgatgtaaaaacagaagcaagacttggggagaggtgattttcttggcactccctatttccctttttctccttattaattgtttgcactggtcatcttctggaaggaggaagagtaaaaactataaaacaaagacaacccagtatttgcaaattcgtttttcttcaagtgcttgcaaattcatttgttactaacacataacctactaaaaagaatgttcattctagctattgacttgagaagtcccttatggttttttttctcacaatgacatgacatgtatgtaaaggctgaagatcctgtacagtactcttgtttaactcggtcataatttgtatatacatgttaagagatggtacattttattccaagggttattttagtaggatggatcgtaaatatgtaattgaaatgcatgtacagcctatcaggatattccttttttttttcaatctttgattacttatttgctgtttggaggaattttttggaaaataacataacagggctttaaaataggatatcccttttgtagtgtagaattgctttctatctatggagtaaccgcttatgttttctgctatttatgtttctagtgtcaccaagcccacaacattggacatcactaatttggagggaggtaatgaaagagaaagaacagaagatgtccataaatcatcagataaggtattaccctcggctgctcctttccactttgcatctgctgcatcaactacagcaagcctgagcaatggtttctcactgccatcatcatcaaagttatcaaatgtaacaccaattgataagcctgaagtagcttggc

SEQ ID NO: 51316 - DNA, 2019 bp, Oryza sativa
tgcctcaactacttctgcctcaacagcaccttttacattttcgagctcaggaaacaacacttttgggttcaattccccagctcaacctgctggtttcagtacatctgttgatggcagtaccacccaaccatctgccaccagcacgatctttggtagcaaactgccacagtcagagggcacaatgtcgcagccatcgaagagttcacctgttcagtttagttcaccgtttcaaactgtgaccactaccacaggagcttcctcgtctgggtctggatctgtagctttcggagtaggaacagcctcaactggttctgggatcacatcttttggaaccggagcatcctcatcttggcctagcacagtgtctttcggattaggagcttcctcatctggaactggtgctctgttatttggagcgggggcttcctcatctggaactggggctctgcctttcggagcgggagcttcctcatctggaactggggctttatcttttggagcaggagcaggaacctcctcatctgggcctggaactgtgtcttttggagctggaacctcgtctgggcctggaactgtgtcttttggagtgacaacttcctcatccgggtctttgtttggtaattcaccatttggatcaggaactactttctctggccctggaagtggattcgcattttcatctcctagctcttctgctgggtcatctttaactatggccagcacaagtatgttcagcaccagttctacggcttcatcatcccctgctttcagtaacccattcggttcaagttcatcacctcccagcatgtttacatttggccaatcggcttcttcaggaggaggtttttcatttggagcacagtcatctccagctttctcctcacaagctccagttttttcatttacctcagcaagcatgaattcatctactccgcagcctgcttttgggatgacaaatgccaacacatccttcggcatgggatctcctggaaatgatcagatgaatgtcgaagacagcatggcagatgacactaaccaagcagcaccagcaccagcaccgatatttggttcctcaccatttgggcagcctgctagttcacccgctgctccagtatttggtgctccagcagtcccgtccgccggagttttccagttcgggggccaacaaggttccatgcagcagaatgcggcattcccgcctgccggtggtagcctagagtttcagggtgggaacttctctttgggaagtggtggcggaggcggcgacaaatctagcagaagggtgatcaaggtcaaaaggaacccaaagaaaagataagacgctctgttcaaatgtgcatttcatggtgccattttggatctgcctggcaacatgtcgtgatcatcagagcgggactacgaccatggttcgtatggtcatacaaattttccagcgtcagcacagttttcgcagcatcacccggctggcttgtaaaccccaaggtcagtagtgtattaccactcaattattcctttcattggcaaagccggattgcatgttgttgtatgcctgtgctattggagtgtaaaatagaacaaaaaagaagtgtatcccgaggtgtaattttgttctcttttccctgcgcatctgctgtcttatttgcctccgatatatttggctcggagtgtaatgtacactgttgtatttgttctttttgtttacatccgacatgcccagaactccctagtatagaatctccctagtttatcaatcttcgaatcccactgagttttacatcctgcgtgctttacatttcaatgtagtttagttttcttctattgtttagtgtggtattatatgagctgttccgtgatatctaactccacgctgtcttgtctccattagaaacgacttctttttatccaatgtgcctgaccagttctttcagaaaacctatcaacacaaacgttgaatttacaaaccataatcaactagtagaatcagcgttgcatgtcgcaggccgttgtgtgactgggacg

SEQ ID NO: 51317 - DNA, 7903 bp, Oryza sativa
tttctttctcctctcctctcttcgtaccccctgtcacgtagttcttgtttactctttccattaggtgtcacaggtttcttctcctcttatccttcctttccatcggttcttgtacttggtggtatacccctagctgctcgcctttgtgttaatttggttggattgggagtttcttgttctctctttagccttgagcgatcttggtttcttgcaattagcctttgactgcttcttcttcttccacttgccgccggcagctagaagtggtccatcgtaccaaccctttcgtcctcattgaaccattccgcctcgctcccagctccattactagaagcactagagctagcgtgaatgcgtgatccttgatgcgtagttagcagctagctcctgcccccaatctgccatctccgcattgcgattttgagtttttgagattgtaatttgcgaacgatctcggttgtgctgagagcttagcgttgacttcgatgggtgcatcgcgttcgatcgccgattctgatttggtcgcgtgatccgggggtgatcggtgattactccgagcgggaggggagatcgtctcttggcgcggttgcgcttcgccgcgcggagggagagacattcgcggcgtaatccgaaggtgtttgttggatcgaggcgtggtgtccgagaaagattcggagcggcggcaatggggaacacgtgcgtcggccccagcatcagcaagaacggcttcttccagtccgtctccacggtgctctggaaggcgcgccaggacggcgacgacgcgctgcccggcgccaatggcgcccctgacggcggcggccagggccggttgccggcgccgccgccgccgacttccgacgcgccgctcgccgtccaaaacaagccccccgagcacgtcaagatcgtctcgaccacggacaccgcctccgccgagcaggacgcctccaagtcgagcgccggctcggactccggcgaggccgccaggccgcggccgagggtgccgccggtgaagcgcgtctccagcgccgggctgctcgtcggctcggtgctgaagcgcaagacggagagtctcaaggacaagtacagcctggggcggaagctcgggcaggggcagttcgggacgacgtacctgtgcgtggagcgcgccaccggcaaggagttcgcctgcaagtccatcctgaagcggaagctggtcaccgacgacgacgtcgaggacgtccgccgcgagatccagataatgtaccacctcgccggccaccccaacgtgatctccatcaggggcgcctacgaggacgccgtcgccgtgcacctcgtcatggagctctgcgccggcggcgagctgttcgaccggatcgtccagaaggggcactacaccgagcggaaggcggcggagctcgccagggtcatcgtcggcgtcgtcgaggtgtgccactccatgggcgtgatgcaccgtgatctcaagcccgagaacttcctcttcgccgaccagacggaggaggccgctctcaagaccattgactttggtctctccattttctttcgcccaggtgagcgaatcacattttcttttccttttttcttttccagaatggcgcattgaatttagtatctatgactgttataacaaacaagatttccaatccattcaagaaatcacactgcatctatggataagtagagaatgaatatggcctaatctttcatgtactgatttgatctttagtgaatctgaagttcttgagtttcagcatttgtttttgggacaactgcattattgtgcttatgatagtactaatactgctgtgagattttatgcttcagaacttaatttcctttacctacatttcaaagttttcaacaccatttgtttctgcataagttctgcaaaaagtttggctgcatatctttaccattctgcagtctgctaccatatcattcagatgaattcattctccattgggtttctactcatatgccattcttattccaggtcaagtattcactgatgttgttggtagcccttactatgtcgcgccagaagttctgaaaaagaaatatggtcaagaggcagatgtctggagcgctggtgtgataatttacatcttgttgtgtggtgtgccgccattttgggcaggtaagaattttgctgatttttcagtcaatcacaaaacaattatactaactttcgtgacaaaatgtgatgtattttgatccgaactcttgtactaattaagctctccattgttgtgaatcagagaacgagcagggtatatttgaagaggttttgcatggtagacttgactttcagtcagaaccatggcctagcatctctgaaggtgccaaagatctcgtaaggagaatgcttgttagggacccgaagaagagattgacagctcatgaagttttaagtaagttacttgattaattttcatgatatattcctaaatgtatttttctagctattttagtagtgcagggctgcaggccatgaacagtgcagtctgatttacttggcattatcatcttttcagggcatccatgggtccaggttggtggtttggctcctgacaagcccctggattctgctgttctatctcgtatgaagcaattctcagctatgaataagctgaaaaagatggctcttagggtaagtatgacttggacacaaattgttactatatttctgatttctctatgaaatattttcccaatattaggatagcaccatcttgtcgttggccttttgtcctcatgcaccaaaggaaaatctgtttggagtttagctcatgcaagatacagtacataatcattttaaaaaataagtatccaatgttgtattagttggagaatgttgttcatcttgaatggttcaatcatacttacctgcatgtcctgatacctttgttgattccaggtcattgcagagaacctatctgaagacgaaatcgccggcctgaaagaaatgttcaagatgatcgacacagacaacagtggacagatcaccttcgaagaactcaaggttggtctgaaaaaagtcggtgctaacctccaagaatccgagatctacgcactcatgcaagccgtaagttcttaagcaatctaccaattccgtcgagtacttttacggtggtctctactggtcgaaaacatcaaaattgcatttgtatctgaattctgaaatggtattattacaggcagatgtagataacagcggcacgatagattacggtgagttcatcgctgcaactctgcatatgaacaagatcgagcgggaggatcacctgttcgcggcgttccaatacttcgacaaggacggcagcggctacatcacggccgatgagctgcagctcgcctgcgaggagttcggcttgggagacgttcagctcgaggagatgatcagagaagtcgacgaagacaacgtcagtaaaaaaaaaaaagaacctacttttccattccattctgatcgaagctagctaatcacattgcctgaaatgcttgatctgacggaactttcgctgttctttttcgtgccttgtgtttgcaggatggtcgcatagattacaacgagttcgtggcgatgatgcagaagccgacgatggggctcccggcgaagaagtccggcgggctgcagaacagtttcagcatcggcttcagggaggccttgaggatgtcttgagaaacagccactagagtcagtcacacacttgtagaggcgacgacaacgagatcgatatgttgtcttccatagggctggtaatttcgaaacggggaaaaaaatggctggaggagatgtgcgtgtacgtacaggcgtagaggggggtgggtcactcttgggtcattggttcgattgttttcttctgacgttaaaaatacaagagaggtttttcgttcctcgccgccaccgtcgttcatgtgataatccttggccccctcgatcccctgcgcgcgatgccattctggtgcgtgatttcgccgtgtgctaccgtgttttcggcgggcggagcggacgaacgcgctgtaccgtccaaccgcgcggcgtgtgctgcaaagcgcgcaatcgctcgtaataaaacggagctccgatcgcgagggcaaacgccgtgtgggggacaagggcagacacgtgaaatgaagccgttttttgtccttcctgggttattacttccacttctttctcccagcggagcggcacgttggtttcggaggccgtggcactgtcgctttgcccatcaatccgcccgcccacgggcgcagatgcagagatactactggactgctacgactagtacccgttgcgctgcacgtcctgccgggaccaccaccagactctgaccttctgcacgttgtagtagtgtttagcgtttactgtaactctctgaagatgaatctaccactacaaggcgatcacctgatgcagtggtgggcaagttatgcttccttgctagtacagtattatagcaacctgcaacctcatataagttgtagtaggccactactccctccgtccaaaaaaaacaaaacctgagtttccgtgtccaacgtttgtccgtccgttttatttaaaaaattatgaaaaaaattaaaaagacaacacgtataaagtattaaataatgaaaatactaattataaaaaaattccatataagacggacattcaaacattggatacagaaacacagggtttgtctttttcttttgtcaaacattggatacggaaacccagggtttgtctttttcttttggacggagggtagtagagatgctgtggtaataggacacccgcaatggttatctataggctctgtataagatatatatgtcagcatattttcctacttgaaaaagattaaatgaagagagagagcaaagctatctactaaactggagatagtctatagagaaaaacgaagcaatagattagagagctatagatacccatgtagacatactattgaggtggtttactattaatctagtctattgctgagatgtacatgttttatattttatagagagcaccttactttatcattgcgggtgctcttaggcgaagacgattcacattagctgtcactttatttcattaataacgacgtcgttgcttcttagttggagcatctatagtttatagttcagcaggtacatcgtgtattcatgttctcacgctgattagtccgctgtcccgaacgaataatgcaggcctgtacgtccaaatgacaaatcatagcctaataatcttcagagaataagattcgcataaatgattagatctatagaagatgcagaattgattactactagctttaacaccaaggatgctgtgatgtttaattgtttactcggcattctgtcaaaacagaaaaagaagaaaaaatgacggaaaaaaatataaaaaaaaacgctcctatacacagaagatctcggtcttcaagtatgaacattttcctgcctttttttttttcagacaccaacagccaccagattacattccccacctgatttattattcgtaataataaacaaaaataaaaataaaaaaaaaccaatggtaatgtggacggctccagcacagtccatcacctcattctagttcgtgtttcggtatcatgagatcaatctttcgccgtctactggcagcttgcgaatcgcaatcgctgaccaaggatgccagccatttggcacgttgcttctaacaacttgcctgcagtattttaaaatgaacaaagcataagattattattatcaatgtgtgattaacacataacgacactggtgttatactgaagggaaaaaaagctagaagaatatgaggctggggagtcagacgattaatgttagattatgtatcattagataccctgtcaattcaacattgggtgcctataaaatttttggcatttttgttgttctcaagatgtggcaatggcttcatgtagcttggactcaaaggatacaagtagtaagcaataagctcaaataatctagaccaggcaatagcaatatctaatgtcgaaatcacaagacaactgaaaatttaggtcatgaatacccaagaaatatactgccatatagttctataatcagcatcacaccacgttgcacacctaaatgaactaatcaacaaaaggaatatcaccaagtgatcaaggttcacaggcaccagggtagtttatcttactcacgaatccacaatccgtggccacccaaccatttctatggagcagtatatatattgctgctcactatcatctaattcttgagattaaaatcaacataagttttcttcagatcatgacaacttatagatgcttggcatactttttgagcacaggtctaggaaaatcgaggggatttagattgatcttaactatctatatatgacctagatcatagaaaaatacatctaagacaaaattttatctttaacatacatatgtaggttttctacttctgtctttgttttcaccaatcatagtccaaaaatagctcgctctaacatcagcagcattcgcatacaaaggcacacagtttagcaattgccatccctcaacccataaccaatccaatcaggctactaccattccaccaaactctagtaacaagatgtggcaaaggcttaagcatgagccttttgatgctttgggggaaagaaaagctgttgctcatgtgtcacgggcagagcacaattcttgcttgcagtcccaggtacagtatcaagagatggtaaagacagtaacccaccagcacacgcacaattctaatgtttcagtacacaatccagtgctaatatcacagaccagccagctatgtgtaatggcctgaataaaatgtataagtgcatagacaccaaagagaatgactgcaactttggtagtattactgaccacatagtagcaagtgcccaaacgggcaccgacaggccatatgccattcagaacggcaataaccctaattgcttctattttatgcctaagccttcgtctttattccgcccagtacacaccacccaccaatcgattaattaattaatccccgccgctacgatcagaacacttaccggtagcacttacctgttcctaccggtgaagagtaaaccctcacactggcaacattactagcatcaacccgcattgacttaagcaattgcataaacaaaatcatctcctaacctccccaatctaggttgtgaactgtaaatttctatggcggatttgcacgattaataattgagtagaaaatgcaagttcagatctgaagagaatggctgacctctccggagtttgttcttcttgcgagtgccggtgacggcgggcgccctcctgaccggcgccgtgtccggcgccgtcttggtgtcatccggcgggaacagcacggcgtcaatgccctgcactgcgatcctgccatccgtgtagatgtccgggtcgaagagatacgccgagccctcgccatggccgaacttgactgagccgtcggcctcgcgcgccaccaccttgtgcggcagccgcagcgtgtcgtagcgcaccttgccgaaccgccgcaccgcgttgtacatgctctcctcggtctggtactccgggatcatgtggtagtacaggatgttctccggcgagccgggctcgctgagctggtcggtggtgaggcgcgccatggcctcgtcgttgggcgcgagcacggtgagcacgtacccctcggagacgagccggcccatctcggtggcgagcgaggtgaggttgacgaggatgtcggcgagctcgttgtagccgccgtacaggaggagggtctggatgaagtccttcacctggctgtggccgtcgaagtggtgcttcccggagcccggtccaggggcaggcgccggcgcgatggatgggccgggggccatggcgtcccatatcggaagcaccgg

SEQ ID NO: 51318 - DNA, 49778 bp, Oryza sativa
ccccccctcccccatcatttttcctctcttctcctctatagtgtagagggaagagatgtccaacaatttttttttcacatttagaaacatataagaaccaaccatagaaagaaaaaacttaaatgacgaaatatgtgtgacggagcgtggggctcctcaccgggagaccgcgcaggcccccctttgtcggttcagccgggggccctgggtgagattctaagctcctagtctgtggaaagttcgcgagaatggaaaaagcacaagacacgggcgatgtatacaggttcgggccgctgagaagcgtaataccctgctcctgtgttctggtggatctgtgtatgaagaagctaccaagagctggagagccagagagctcttattctaaaaaccctcttctccttttttttttttctcgtgggatctcctctccagatcatccccccttccagcctctcctcttaagtgggcaaggtcctccttttatatctcaaggggataccacatgcaccacttctccctctctctttttgggtgggggcccatcctatctatagtaaaacttggcttgccttctcttggaagctgaaacactacctgtttttgagtgtggccacgcgtcctcgttcgtctgacctcggggatcaccctgtcatcccttcataaatgggcggagatttgcaacggctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctagcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaatgagcgtgtcatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcatttttcctggagatatggtgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctgttcttccggcgtcatggcacggggctccgctccgcttgacggtagcgtgctgccgccttcccgcatcgtgagcgagagacaggccgggctgccgcgccgcttcatgccggaatttgccaccggccgggagatagtctcgctgggcgagggatgcccggcaccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccatcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggtgactatcttcgtcgccggatcgcgccactccagcggcgcgcccggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcatgatggcggtcggggcctcagaggaacgagctcctaagggccatgacagtgcgagcgggagccgcaagggagatcaatctaccccaggagggggttgtgcttccggtccccgtgatgggggctcggggggcagccgccctgccgacgcccgagggaagagaaagcaagagggtacttcctccccatctcctccccgagggggcggggcggcacgtgtcagcagcaggcgcccggagggggccgcgccgacgccgcagcccgagggggagcggaagaagaaacggctccgcaagatggggggacagaaccatcccggggaaacctcatttcccctccaaggtggtcgtttaaccgaccccctcgcaggttcgtcccacgcccattgtggctatattcattcttccaacacaagttttcattcacccatcttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccatccgagctcgccaagctgaagaagccgctcgggaggaggccaaacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctctcccccacgccttctgctgccccactgagcgcagagcctcttctgcaggccttggccgttgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaagatgctgggggagatcgccagggaggtggaggaggagaggggggctgccctcatcgctactaccgtgatgaacgaggcgcaagacgacctccgccttcaatacgggagctgggaggcggagctagggaagaagctcaatgccgcccggggggtccttgatgctgccgctgcccgagaacggcgggcggcggagaccgaggtggcatcccggcggcgcgaagaaacccttgaggcccgtgccatggcgctggaagagcgtgcctgcgtcgtggagagggacctggcggaccgcgaggccgccgttgctattcgggaggtcacactggcggtgcacgaagctgcctgtgccgaagaagagtccgcactccgcctccgcgaggatacgctcaccgagcgggagcgagccctcgaggaggccgaggccgcagcacagaggctagcggagagcgcgtccctccgcgaagctgcgcaagaggaacaagcgcgtcgcaatctggaaagtgcccgcgccgagagggccgcattgaaccagcgggccgctgaactccaggcgcaggcaagggagctggatgcaagggcgcgtatcggcggggcggccacgggcgcaatcgacttaatcgcccgcctatcagtttccggacacaccatcgcggatctgcagggcgcgttggattcgtccaccggggaggtcgaggcccttcacctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgatttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatcctcagttttttcttcttttctttctttcaaggccttcgggcctcctttttgtatagattaacttaatctgcaatcaaaataaagaaatttctgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgatttccccccggagttcaccacgccccggggcacggctcggttctggccccttttggcgattttagccgacccgagcccccgagggcaggattgagcacaagtgacatatttcaagtcaagattcttcaaaaggaaacaacagcacaaatacagcctttaggaaatcgaaaatgcttttattgaaatacagatagaagaaaaaatatgcatatgtggtagcccccggccaaccctgcacgcctgaagggggtgcgtggttggcccgagcccgaaacctgacacccgaactccattaggggtagaagcgacgaaggtgttcgatgttccacgggttaggcagctctgtgccgtcgcccgtggccagccgaacggagcccggtcgggggacgccgatcactcgatacggaccctcccacattggtgagagcttgctcaatccagcacgtgtttggacgcggcgtaggacgaggtcgtcgacgcagagtgatcgtgcccggacgtggcgctgatggtagcgccgcaggctctgctggtagcgtgcggctcggagggccgcgcgccgcctcttccaagtagtcgaggtcatctctgcgaagctgatcttgatcagcctcgcagtacatggtggcccgaggggacttcagggtgagctcggatgggagaaccgcctccgcgccgtagacgaggaaaaaaggcgtttccccggttgctcggcttggtgtggttcggtttgcccagagcactactggcaactcctcgatccacgaatcgccgtgcttcttgaggatgttgaaggtcttggttttaaggcctttgaggatttccgcattggcgcgctccacttggccattgcttctggggtgggcgggtgaggcgaagcagagtttaatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaacggccatgaaagtggtatgatctgcagtgcctgggccagctgatggatttgcttggcgtggaactgacacgctctgcatcgccggaccaggtcaaccgcatcattgagagctgttggccaatagaaaccttgacgaaaggctttgccaaccaaggcgcgcgaggcggagtgggctccgcattcgccttcatggatatcagcaagaagctcgacgccttgttcccgaggaatgcacttcaggaggattccgttagccgcgcgccgatagagggtcccttctatcagcacgtagcgtttggagatgcgctggacgcgttcacttccttcgcggtcctcgggtagagtcttatctgtgaggtatgcttggatctcaatgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgtgggtcagagcaccggtattccttacagatctggttaaccactagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggcgaggtcaatatgacccccgcaccggcgccctgaagagtcagggagccgtcgaactgcatcacccagtgggcggtgtgaggcagctgcgaggggcccgagctggcctcggggactgagacgggctcgggagccggggtccattctgccacaaaatcggcgagggcctggctcttgatagcgtgacgtggttcaaagtgcaaatcgaactcagaaagttcaattgtccatttcaccacccgtcctgtaccctctcgattatgcaagatttgggcgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggtcgatcctcttcgccaggggccgcatccctggggcgctcttcgtccaagcggcctcgcggggcgcacttgtcttctgtgctgacgacctcggggtcggaggacgacaggtgcggccttcccacagtggcctcagggccgtcctgggggtcgggggctcctggcgtcgtcggacaagcgggcaaagggtcaaccccggtcatcgggagccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggagcctctcctccctgctctctcccgggccaagccaacacagggtggggatgcgcggaatgagggttgtcctcatcgcgctccacaactaacgccgcactaactacctgcggggtcgccgctaagtagagtagcaagggttcacctggctccggggcgaccagaactgggggagagctaagatacgccttcaactgagtgagggcacgttcagcttcctccgtccaggtaaacggcccggagcgtttgaggagcttaaataagggtagcgccttctctcccagcctcgatatgaacagacttagggcggccatgcaaccggtgacgcattgcacatccctaagcttgctggggggggcgcatccgttctatagctcgtatcttctcggggttggcctcaatgcctcgggcagagaccaagaacccgagaagcttgcccgcaggtacaccgaacacgcacttatcggggttcagctttatgcgggtggagcggagactctcgaaagtttccgccagatctgaaagtaaagtttctcggtcgcgggtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgcagttttttcctcatcctccctagccatgcgaatctgatggtaaccagagtatgcatctagaaaacacaaaaggtcacaccccgctgtggagtcgacaatctgatctatgcgaggaagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaagcttgacgttccggggcctgccggcgcactttctgccggaccggctttgcgcccggccgcacggcgagacggtgctcaatcacctccctggggaccccgggcatatccgccggtctccatgtgaagacgtcagcgtttgcccgcaggaaggagacgagcgcgtcttcctatttgccatccagaagaccaccgattcgtgtggtcttggacgggccgtcgcccagggcaacctccttgaccgggacctcatcgcacgtgactatccgctgcctcagggcggcggggacggaggtgccaagcctctcgtcgccatcctcgggcttggacgcagcggcgaggtggtccgcgcgctgctccatacaagcgagcgcgactttgaggtcgccatggacagagatggggccaccggggcccggcatcttcatctggaggtaggcgtaatggactgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgccccggcgtcacaccgataatcggctgggacggccggagcaccatccccggggccttgatggcatcaaaggctgcgggggaaaggatgttgagggctgctcccccatcaatgaggacacgccccagcttcacgttgcaaacagtgggggaaaccaccattgcgacctgtcctccccgggcaacgcacgatgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacccaggtcatcatcgccgtcatcgatgtcctcggcgggggccttctgtttggcctctcttcgccgattgccggaaggaaccgccgaggacttgccctctcggcgctcctgcctcctctcctcctcccacttcctcgtccgctcagccaaacttttgactacacggcagtccgcgaggtcgtgaagggaggtgttgtggacggtgcaccacttgccggttgggcgctccctgctgggagcgctggcctcctttttgtcgctcgcaggcctcccctttcgggtggcccgcgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctctgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatatatgagcgaagtgactcatcatcccttcgctgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtgggcagcacgtcggccattatgccggcgctcgatactgatgcgggcatccggccccccacgaagatcttcccgggtcggaggcgctgacgaaggagtgacggccgaatagcgaacagcggccgctgctcgccgcgccctccgtcttgacgacgcggagccggtggtagcagtaccagaggtcttggtggcggaggaccgcccaccagcatctaggcgctgctgcgccgtcatgaccaagttggccatgtcgtccagccaacgttgggctggagactccgggtcagggacaatgggcgggtgacgtaggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctaccaagagctggagagtcagagagctcttattctaaaaaccctcttctccttttcttttttttttctcgtgggatctcctctccagatcatccccccttccagcctctcctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatcccttcataaatgggcggagatttgcaacggctgctgcccgagtgacccttctgatgggacggcccatacctacgtccactccgccggaagcaggtgcaacgtgggaacacggttgtcttccggcgacataaccagtgtcagaccggtcacctttgtccaccacgtgtcagtttagcaatctgcatgttcgcccttcttcatacaacgtcttgcttataatggttgggataaagcctggcatacatctgaccaggaccaacgtgccatctccaggagctagcacgctggctccggctagggacgagtgcctagagactctcatcctgatgggacggggcgaggcgtgtgtcagatcgcctgttgcctcctaacccgcaatctgaccgatctgtgaccggtcacagaccggataaatgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgagcccgacccccccccccccgagggggttaggccacgtgggtgatcgtgtctgcctcaagtctctaagtcatgatactcccggtcccatgtcaccgacaatgtgatttgtagaattttctaaatctctaccgaaaataggtgtcatttgtgtgtcatttcttaaaatagacgtaactttctcatacgaactcggaatcaggcaaataatataaccacaaaaatctacagaaaaagttacatccgattctcccccgttttgctgggttcggcgaaattaaaatatccaaatttttcttgcaagattgtgttttcgaggcgataagcttttcgacggagctttggaaaattctacatgccacatatttcgtccgtttgagtttatttttttagggttcgttcttgtgggttcctaactgtgaaaaaaatatcaaaaaaataaaagaaaaataaaaaaaaagttgcacatctctctcctctacactagagaggatagaagagaaaaattctgcaggtcacatattttatctatttgagtttggtttgtatatcgttggttcttgtatgctcctaatcgtggaaaaaaaatcaaaaaataaaagaaaaataaaaaaagttgcatctctagactgtttaagtaacttatggctatcattttcatgtggttatattttgagttagattaagcaatttcatctagtggtagagtgcattatgtttaacatgctgaccgaagggttttgctaaaagagttatggtataatttggtgaaggtccaaaatttggtatgttgtttccagacttttagctaagttgaaggatttattacatattccattcgagtttaatttttttttgtggtttgcatgtatgtatcgtgattctaagtgtaaaaaaatatcaaaaaaataaataaataaaaagggtcaagattggaaacgaggtgttgggggggagccatggtggcgcctccccctgccacctcagcaccaccccgccacgttggcaggaggacggtgccagagtgcctggcgccgttcagttagaggacggtgccagccactctggtgccctaaaagaaaccatttgtaggataaatttttttagaggtctattttgcgaaataatttttttaaaaggacttaaatgtgaaaaatccaggccggcgtgccggtctggggaccggacagtgatgagttaaagccggtgagatccgcgtgatggattcgtacaatcgtactcgggtgaaatggagtaaatcctgtggtggatacaggagttgagtacagggtacaggcctacagggtgagtccgaaaggagaggttaaggagctcactaatgaaagtggccaagtgcgtcggttaggtccatatgccaccggaaccggatcgtatacggatgcacctaactctaaacggggtgttatcgtgttggagaatggagtttttttttttttaagaacttggagaacggagttaatcttttatttctgaggtcaaacaggagccgccatgtgcgttcgcgatgtaattaagacgcactaacagctccctcgagtgcactcgtgcttaatacttgcaggcttgcatgctgccagtcaatgcagagcatagtgcgttcacagatccaaatgttatactccctcccctttcattttaattaacgctgtgacaataacacgctctacaagatatacctttgaccttattttttattataatatatataataaataaatgcatgtttacttttattatagtgttttgaaagacaaatctatatatgtttttctagtttctttaaactatatatttttaaagttattgatggtcaaaattataaaagtttaacatcaaccttatccaaacgtcaattaatatagaaccatagggattatttatcctgtcaggtgtatcaacaggttaggttatgcataatcaaatggcctcccccggaaaatccattcggagacagctatactagcatctcgtgatcttgcattgtgtttacaaaggactaatgatatacagtatcgatcttcctttttcttttctcctttccaaacatatcttcttcttggcatttttatcgtacaacccaattcatgaaaaagaacactatcatggtgagttggatggtgtattgtcccacggtggtatgaccatgactttcggtgttatgctaacatgtagcttcgcagcattgatcgtgatttaatgatagatcgttggatggtcaccgtcgccaaatcgtgcttcaattcgtcaatgagccaacgccctgaaaaaagtaagacgtacagatatcaccgtacggccgcttcattagctttcacacaatcagatatcattgttgctttaatccacttcttgaaatcatcgtttaattaatacgatcagcctccatttttctcatgtggtagtgtcactttgtatcacaaggtattaggagtacatccagcaatcgattatcggtagtcactcacttttggtcgtttcaatcgtcggattttattgtgttaatgtccgggcaataacacgtaaagtgagccgtccaacttctggtggatttggcctgacgcgtcgcctttttttgtatgacgtgggttagtctccacgctaagctaccggacgatctacagttcaaccctgcagtttttttttttaagataatggaataaaccctccagatttatgacaatgttttttccgatttctgattcctccaatagttcgacgctggtgggctcgtttatcacttgggcggctattctccttcccgtcgttaattaagctgcatccggaagcacagcaccggatgtacgcgccagattgacgtgcatgttccctctacctggcactttcaccggtagcctgtaaccctttttacccctttcgtctacaacggtagctcgtgagccatacacgtatacacatacgaatgccgtggtgtcaatcacctttgaagccaagttttctgtgacatctcgtctcccccggccggtcgctgcaccaccggagatccagtcgtagggttcaccaaaccgttttaagtgtgttactatcactttatagtttggtggttatagtaagattgatatactgtgattttaaaaacttaaaaaaaattactatacatgataaaccagccggtccaaagtactgaccccgccacgagcacggcacgggaaggaattcggaataacggaagaaagaaaggcgccgagtcgtttcgttgcgcggatgcgccagctgccgcgttgatttcgcggggggcgtccgcgtgtggtgcggggtcgcgtcgtcctcgcgcgcgcgcgcgagcgagagacgagagagggtggattcgtcggtgactcggtgtcggtcggtggtttcgtccgctgcggttgccgagacgggagcgagcgaacaccgtgcgtgcgtgcgtgcgcacctggttctcgtgagcaataagctggctacggcctacgggcagcgcacacatgacgcattcttggttttgttggtttttgctagcgagaccaccacctgcgctgcgctgcggacgcacatggagtggagttcactgggttgaggttttgatctggggagatcattgtcatgtgaggggctaatctccgcgaaatgcttgatgccaaagttaaagaatcacgaatcacgcatgggacaattctgaggaactctgatcatcatgaaagcgagggcatttggatggcagatttttcttttcagaatgttcacgtgctagtactgttttttgtattgtggactaccccagcttgtagagaccttaaatatttccagggtgttcaacagtaaaaaaaggagaggggaagaaaatgaaacaagcatgtccagcgcagggaaaaggtaggtagatgcagtacaagggatgcacttctgtgtgattactcacaaacttatgtgtgatcactgcgaacttccgtgaaaatttatgtgtctcatacagaaacgtatcacttctatgcttgtgattactgcgaactcctgtgtacatggcaaatttcctcataggccaaatttgcatataagcttgattactcacaagcataggcaaagcacaacaggggtgataagtgacgaactgatgaatgaccgtacccttgatttatagggataccaacaagaatttcacaatcgacattcgttctgttgtgaatgataacgattacaattcgtaacgtcccgtgatctgaacgcaagagcttccaacgacttttgaagcacacaaagatgatgaaggcatgaagcatcgctggatatctcaggtgctccgaacaagcggcttttctctctggacctgacgaaagtgaaattggcggcggttagagaaacttatgaaggctgagtttagttccaaactttttttttcaaactttcaacttttccatcacatcaaaactttcctacacacaaacttctaacttttccgtcacatcatttcaatttcaaccaaacttccaattttagcgtgaactaaacacacccaaaggaaaaatgtttgtttcatcctctacaggatcgaacactcctctaaaaagaattgactggacgccattacatacatcatctacccgtgtagcattttgccccaattcctgtcttcagtcttcacggccaagaactactgtaggataacgcaacaatcccggacctcccctccttacttcaaagctaagaactactgtgggaaaatacctttcattccatcttgtgcgtactcgttgttttagacctggcattctaatgaatgcccataaaatgcatatattcaatgtgaaggtgctttcaggagttggagattacttcgttgaagctgatagctaacaagatctcaacacgtcagagaaaagctacaaatcagatggtcctactgtatctttattacaggtgtagattggttttcagaggtcctgattaaaatcgacatacaacgacagtaaatctcttgaaaggaaaatcatgtaaacatagtaccataggtagtaggaaatagtacctgttcatgttcattgctctatcaccaattcaccacgtagagatggatcggtagctgtgagcctacaatggccatctcttctaccatgatgggaaattgagggtgcgaagttcagcatggtagaagagataatgcgcaagcggccaactgctgtataatgcgctcgccaagttcagcatcatcagctcctacaggtacctgaaatcagaagggaatgcgtcaatagaactgcatggtacaagggctacctccagggtgcaaacaggccactgcacaaagtcgcaaagattatgaaaatatcaaatggtagcaatataatcgccaaatcaccaactgctggatgatgaaaaattatcaggaggtttgaagcggttagcttgcatattcctctctcttgttcagtctcagtagttcttggctgcatacattaaaaaaaaacaaaacaaaacgagaaccacctaaagggtgtgtttggataatgggaaatggagtgtgagattgagattgggaaatgaatgaagggttaggattaaatgaaagaggaagaatgaatggttaggatttaaagatgtcttttggtgagcgggaaatcatttccatttccaattagccaaacattgccaaaaggtacatcagctcactaaggagatgcagaaaaggtacatcatgtattcatgttctcacaccgattcatccggtgtctctaccaagtaatgcaggcaaagacaatcactagtctttagataagaaaaggcaagcatttaccagaatcttcagagaaaaacttacaaggatttgcaaaattattaaatccataaaagatgcacacacaaatgatgaagcttttaacccatgggatgctgcgatctttactcaagattaagattctgtcagaaacagtagcaagaacaacgaacaaaacaaaccctcctatacacagaagattttggtgttcaagtatgattttttttcctgccgtaagacacacctatacacacctgcttatattgcccacctgatttactactcatttttaaacaaaataaaacaaccatatgtggatggccccagcagagtctatcacctctagaccgtgtttcagtatcatgagatcaatctttcctgtctactggcagcgtgtgaattgcgatcgctggccaaggatgccaaccatttggcatgctgcttctagcaatttgcctgcagtattttaaaaggaacaaagtataagaatactatggaatggttaacaaaatgatttaagaatatgagtctagggagtcagaagattattgtcatattacatttaacagacaccctgtcaaaaagaacagcaacgggtgtcaggaaaatcttggcatttttgttgtagtatgagatacgacaatggcttgaggtaacttaaactcaaatgtaaaaccgtacaagcagtaaaagggtaaagcccaaataatttatctatgccacaaaggcacatcctatgtcacaaaattgcagtcacaactgaaaacataggccataaatatccaaagaacttatataagtttgtaatcagcattgttgcaatcctaaaattgattaatcaagaaaaggaatcaccaagggagcaagattcacaatccatggtcagctaacaattgcacaaggaatactatatgcttgctgctcactatcatccaatcttgtaacgagcactcttgttcgttccctatagattggacagctttgatttacccactactgcactttacttggctattcctagtatccaaatccagcttcatcgccactattcgtagcatcaacatgcatggacttaaacaatttcagaaagaacaaaaaaacatcgactaacctcccgaatctaggatgtgaactgtaaatttctgaggaaatttttgtacgattaggaaattcaagttcagatctaaagacattggctgacctctccggtgtttaatcttgctgacgccggtgatagcgggcgccgtcctgatccgggcggtggccggcttcgtcttcgtcttcgtctcagccggcgggaacagcacggcgtcaatgccctgcactgagatcctgccgtcggcgaagatgtccgggtcgaagagatacgccgagccctcgccatggccaaacttgactgagccgtcggcctcgcgcgccaccaccttgtgcggcagccgcagcgtgtcgtagcgcaccttgccgaaccgccgcaccgcgttgtacatgctctcctcggtctggtactccgggatcatgtggtagtacaggatgttctccggcgagccgggctcgctgagctggtcggcggtgagccgcgccatggcctcgtcgttgggcgcgagcacggtgagcgcgtacccttcggagacgagctgggctaactcggtggcgagcgaggtgaggttgacgaagatgtcggcgagctcgttgtagccgccgtacttgagcagggtctgaatgaagtccttcacctggctgtcgccgtcgtagtggtcactgggctccgacgccagcgcgacggagggatcgggaacagtcgcgtcggagatcgggagcacaggagaatcgccgggtggcgccggcttcttgaggcgatccgtcctcggatccacctcgggcgcggccgtcggcggcatggcggagatgtcggcgaggctgcggcggcggttgaattcgtcctggacggagcgcggcacgaggaggcggtcgatcccgtggatgacgccatccgtcctgaccaccgcgtccgggcgcgagacggcggcgtgggcgacgcgcatgccgccgccgccgtcggccgcggcgagctcaacatcctcgccggcgagcgtcgggtgggtggccgcggcgggccaggaaccggaggggaggcgggcggggaggacgtggaagaggagcagcgactggagcgagttgagattccgcggctcgagcaggaagcgcttgaactccgggtcgatgtcccgctccagcgcctcgttccgcggcgcgaggatggtgacgttgtgctcggcgacggcgtcctccagcgcctggagcagcagggccttctccaccagctccgccatctccgtgtagcgcgagtccagcaacgccaccagcaccgagtttgacacgatccctcctcccacggcgccggcgccggcagctttgcccgcaccagcacgagcgccgttgccattaccgtcgatggcgacgtcggctgagggcaatgtgggacgttccaccggcgccgtctccgcggccgcacgggcaacgaggagaacgaagaagcacacgagtgcgccacaaaccggcgcgcccatcgctgcggcctgcggccacttctctcctgcgcgaattgcttgtgctgctgctaccgcgccctcgtcggcgagggatccttctgcggcactactactccggcgatggactcggggaaggagaagggagtagcaaagtaaatggagtagtggaggtggggttgtcgtgccagcgtcgtgcgcccgcgccgccgcgcagtgcgcacacaaggtcggcacgccgtaagcgaggaaaggcaaggcctcgccgcagggatcgcgggaacgccgccggtttcgttttggcccccgccatgcctgcgttgccagcactccagcacagcaccgactcgactcacactgggggcgcctagtttcccgcaggaagaagacgacgcgttgtttggtttcctgcagaaaaccgtgggccgactctagcaaggccctgagagaggcatgcatagctggctccagcccaagaatgtgggcctcatatgcagcccaatgtttagcttgcaggacagcttatgtgcttagaatattgagctcactattgttaaggattaatccctccgtcccatgatataaggaattttgagtggatataacacatcctagtacaataaatctgaacagacgacctgttcagattcattatattaggatgtgtcacatccatccaaaatcccttgtattatgggatggagtatctactaaattctgagaataaatttagtattttaaaaacaaacttaacaaatatcttagaacaattagtctaaacaatacagtagaaatggaattttgagaaaatgtattttttgaagagtggagcaaataactgaaagttttctgatatcagaaattaccccagcaaagttgtatcagataaactaagggtgagattatgagtgtgaagattgagtactcacaagtcaagcgacgaactgatgactcatgacgcccttggtgcactacatttatagggatatcaacaagaatttcacaaccgacattctttatgttgcaatttacagcgattatgatttcataacaaccttgcatatatattacacaaggtaaaaaaatgtaaaggttcatccgcaagcacaagtcttatgtcccgcgatctggatgcaaatgcttcagcgaacttcctgaagcacacagacctaccaaagatcatgaagcatcgctggatctcaggtggctccgaacaaacggcgtttctctctggacctgatccaagtgaatttgacagcggtttcagaaactactaaaggaaaatgtttcttgtgacattttgccaccccaaaaccttaaaaattttaaagctttctcgtgcacaagaagagcatatatacctgtcttcacagtgtatccaattcttcaacgaacatggagtgggctcattgagagccagatcctgacgcacaagtcgtggaagaagtttcatttacaacagcagcatggttgggggataccgtcctttgattatttgcgtctgaaggagagcaagcactagctgcaggaacagcagatggtccagtatcgtcctttgtttctagccgttccatcatgcgagataccgcagcaatcccagcgttgacctccctccttacttcagtgccaagacctgatatagtgttactccgagaaaaccatctttccttccatccacgcgtactctttgttatagaatctttatacctggcattgtaaagaatgcccacaagtaagacactgatgcatacgttcaatgtgtaaggcattttcaggagtttgagatattacttcatcgaagctgactgtaggcgagatctcagcgtgtcagagaatgactgcaaatcagatggtcctgctgtatcttgattgacaggtgcagattgattttcagatgtcctgattaacatcaagatacaaagagagtaaacctcttgaatttggataggaatagcatgcaaatatataccgtaagttgtaggaaatacctgctcattgctctctcatcatgcagagatggatttgaagcaccctggtcagaatgacccacgtatagctgcgaaccaccactcatatgtccttggtctacagcagcaagagcagcaaaaggatgagcagaacctaagtcagaagattgttcatggtcttcatcttggcctgaacttgcatgcagggagccaccaggaatagcctcattccttgaaaacaccacgatttgtgggcggctatgagatccagatcggctacgatgtccatctcttctaccatgtctgtgtgacctacgcattgcagcagcagcagccaagtgttgtataatgcgctcctcaagttcagcatcatcagctcctacagggacctgaaatcagaaaacggtacatcaatatagttgtatgaattaagcctacctccagggtgcaaagaggaatcatcgcaaatatccaaatgatagcaataaaacgtgctgcacctcaaaatcacccaatactggatggtgaaaaacagcggcagtgttcaaacggttagctcgaatgttcctctcttgctcaacagcctcaagtagttcttggctgcacagttcaaatataaaatgagaaccactaaattggttcactagggagatacacaggatgcaagttctacctcataggatccttcatgctgataggctgccaacacatgggacactgagagcttctctggcacctagatatcaaacagtgagaagcacacatcaaaaattaatattgtcgaggacagtacagtattttgacaaattttcactacatatcgattggatattgactttatatacagcattatccttgatcacatgagctcaccctcaaaatcgttcgtattcataaaaagaaagcatgagaatatattatatcctccatttcagattgatcgcacataaattatttttttgtacatctctagtatctgcaagctcgtatagaataaatatttagaatatgtccccatcagtccataatagacaccagaagggcaacgatagttttatgagcatactgcagaagaactgcacgctcacaactactacgacaaagctatcgttctagactgcttgcacagatgaaggaaatcttccagctgggcagctcagaagccttacaacccctgccccacctgatggaggctggtattgctgaaataatgaaagtctgtggatcatatgctccttaatggcttattgagtctcatatgctggagaatttctgtatggttattcactgcttaaagtgcaggtgatcatcattaaccttcatatacaagtcgatcatggttgaagagcattgcgatgcctaacacatgatctgtttctggaatgtaagatcccattttcgtcttataaatcatgtggtagttccactttactgacagcatttcagcacgacaacaagcatagattcaaatagtgtaagcagataatcaccatcaccttaaaaacaaatattttttgcaaccctagcaaattagatgtagttcccacagcacagttaaattgaaccatcgatgtgtagtcacaattgccagacaaacactaacttcctttatcaccttgcagctaaaagcacggccgtttattttactttatctaggtggaaaagaagatacagaaacaaaacaaacaatcagggattgcatcatataaaactgaggtacacaagcaaactagtcatggtgatatcggatagtttgctttgtggaaacaagagcaaccttaaatttagaataaattatgcaatatgcatgattcaattaccgtaatttacatctatatcgattgcaatgcatcaccagctccacaaagaagtacagaaaaagaaaaataccacacaacaatatcgttccaataggccagaaaggaaacattaccattcaagaatgcactgcagatggtactcatgcttgcaactcgtcacctgcaagagaaaacgccaacatccacaccaagaaaacaaatgagcgactcgatcacaatcatatcgaatccaaaattttcgcctcggcggatgcagaccgtggaggggtcgttgtcgcagaaggcctcgaggcagatgctgcaggcgtcgtcgcaggcgtcctgcacacctccctccacgaacgccgccgcggaggacagcttgctctccatcttcaccttctcatccatctccgtacagcccaaccgattcgattagcccttcccgcgcaagattcctacgcctgatgaccaaagaaaaaacgaattctatgagcaaaaaattccacggattaagccaaaccaagccaatcaacgatcgaaacaggagtctcttgctcaataatccccccatccacgatacgaaatccaccgaaatgaccataaacacaccacgaaatcgccccgcccccatgtccccaatccaaccaaaacgatacggataaatcaaaagaaaaacaccaaaaaaaactatccagaaaggaaaggcggatggattgcgaggctaccttatcccgattgctcaaggggaatttcaggattcggccggattaatcagcgaactccccgcggaattgttccgcctcggcggcgaaggcgagacgacgacgacgacgacgacgaggggaggaggagacggagtcgggaaggctttctcttaataaaaaaaaatacagataaaagaaaatcctaaataaaaatcccccctcccgctctctcccttcccctcacgccaatgacgggtggggccggagagcggtgggtcccccttatctagtgaggctattgcgggggtgtgggggcattggcgcgttgctaaaatcgaccggcgcgcgtagggggagggggagtgggtgcgcacgaaacgtcccactgcggcgtgggccccactcgcgatttcgggggcccacctgcgagtgagacgtgcatttcggggcccctcccctcgcctcgggttccgagatattatttttagacccgcatttcggtcaagggtgcgataaatgcgtgtgtaagagcaagttcaataatatagtcaattactagctccaatttatctatagtcaatctaatagcttattcatacaatatttacatactacactattaatatttggtcccacatgtcataaacatattgtgtcttagagtctatgctacagctggctacaaatctgtagcccgctgctcttctctctccttatttatctccttaaaatatgtttacagctggcttatagcctactattgtacctgctctatgggcctccaatggctgatcgtctcgtctcaaagaaagtacggtgtcgtccaaacgtctgaccaagaattggcgttcaagatcaaacaggggttgatgagcagagtggttggaaaactttgcgataagttttacttttccggttcgatccgttcatgtacacaaagtggcccacgtctataattgtattttaaattaataaaaaatagtgagaattgtgagatcattaatatatcattgttgtttttctttcatttaagcgtgtgttaagaaaagtattcaagtgatacatgtgtgatattgtgtacttcttccgtccaaaaaaaatgaatgatatgacattgtaatgcaacgtatctgaacaaaggtacgtccaaattcgtagtattagaatatgtcaaatccagtattatattgattttttatgggactgagagagaaaatatgcccatcttcagtttgataaaagaaaacgatgatggctagagctcttaaaaaatactactaccaaaacatgattgggtacgagtaaatgtggtgagcatgattaatctatgacatactactaattgttgattaaaatatactctctctttttttagttagtgttacatgtcacatgttatactggatttatttattcgagaatagagagagtgagtgttatttatgacgagaacaatatttgtgttttatttttacggagtagcgtatctactacttcaaagacttagtacagttagtacaattatgtgatacatctactttgcatcaacacttatataaagttacagacaatagtcataaattgtggttagtgcctctaatcacaaaaggttaaatgtagtgcgtatttgtcgacggaagctgaaatcactataaagtgcgaactcatttttacgatgttatgcctaccagacacaaatgccttcgtacaacaaacacatgcttcatccaattgatttggaaagcttgagcgccgggagaatgtaagtcctatacatgactaatcatctagaatagggtcttgaacctcggactgcctgacgacgagagggtggcaaaacaatatacattgtcctctctgacgtaaagaaaacgaaacaaccctctatctcctggtgggaagctatagaaaatgtacaagcttggtggaaaaaccttacaaacatgacatgtgtgccaaagtagggattgcgctccctaatccttctcgtcgtctgggagatacagaagaagtggaaccaacgaatttttgagcacaacgagagcatgacaatcaccctcctagcaaaaattaaggaagaagccaaaatttaaccctaggaggagctaaaccacagttaattcctaagagcgtataatctgtaaagacgggcttttcccttctttttttttttcgttaccaggggtgtatttttttcctctctatctaacgaaagataaagcacaatctcacgctgtctccttttaaaaaacactttctttacgctgttcattggctgtagcgggtagaattcgcaaggaatatgaattaaatttggttataaatgaacgtacttttgtaatcacaacaaagggtccatagctcagtggtagagcaattgactgcagatcaataggtcaccggttcgaacccggttgggcccttatttatttatttttttaaaaaactgaattgggttgctatttaagaccgaatataatttatttgaattggataactgtttttgaagaccgaattattcatttcattttaaaaaaactgaattggattactgtttttgaagactgaattatttatttcatttttaaaactgaaatggattattgtttttgaagaccgaattggattaatactgctacataatttcacatttttaaaatttgttggaaaaacaactgaattggattattgtttttgaagaccgaaatggattagtactcctacattatttcacattttttaaaaacatttgaaaattgaattggatcaatactcctgctttaattttaccaatgcttttgagttgactcctacaatcatttatcggtgacccttttgagtggtcaggaaacatcttttgagttttgatacatgatcctgaaaaggatgcctcttgattttatttttttttgacgtaaaggtaaaaagcctttgagttttcacttttcatacataaaatatgatcctaaaaaataattttgttttttcttccttttgcacaattgcctttatttatctttaaaatagcgagatatgtaacgaaaggaatcacataaccttccaacagaaggagctttcagctacctcccttttatccaagatcaaggaagaggccaaaacttgggccttagcaggaggcgagaagtgttaatagctggctttttttagttagctcggaccaaaggtcctagctattttttttcctttcgctttataaagttctcattctctattcaatgaaattggcgctcgtcgattcattaaaaaaaaatagcgagacaaaactgtaagaaggtatcagcgctacgcaccatccaccaaatccaccactcggtttcaccacacaaatagtctttttggatgcttggttgcttttaacttccctgtcaatgtcgtgaaaaattcagcaccagccggcggcggcggtggcagcaacagtaaacggccggcacgccgccggcacaagacgcagccggcaacatgaaacttcaaacaatcgtcatcatcaagatcaattaatttggtctcttccattcttcttacatacaccaatagaccggacaaaattaacggagaagattcgtttcattggtcagacctatagtacaaagcctattcttacacgcatgacaacagctaaaactgctaaccaattaaacaagaagaataaaatgtaacaaattaactggaattctactcaggaacgctgatgccttcctgtcgctgtggtcttcagacttcaggttgggaaaggagcagcaagaaacgaaccttgcctgctctcatgtgctttccctacttacaaatgcatatacaaagaagatgagctacagcgtattttgccaatgaagatgggctacaaagatggactccatacttaatggaggcaagtcaaaaattgctgcattgttcggtctattgacagttaactgtgagattgaagcctaggaaatgttgatgctcaggcatgtggtagctttgcttgagagatccaaaacttagcttgcggtgcgatggtagtttgacatcgtgatattctgatgttgggttatagccattgtctgaaatggcaacttcacttagcagcacctataaagaaaccagaacaaccagtgagtttacactatcttaatgagcgtgttcaatcagttaccctgatgagaatgaccaaagttctaacagaagatcgtggtgatttttctcattcagagcatgcatgatccaaatcaggagttactttaaactgcattacataagtactgcaaatgtttttttttttactagctactacaaatgttttagtttagaagaagcgcaaaagtttgttttcaggcctatttcacaaaatttgaagttttgggctactgcagatggtactctatagaggaaattcttattttaaattcacaattaccgtcataagtagttcgttgcccaatttttatcataagataaatgattatagactgaaacaaataatcctggttccaagtaaggcaaccgaaatcatacacttttgaaagaatatctaatattgtcaaaggataggaaagaaaaggtagagaaaacaacaattaccttttaccgaagttttagcgcttccccgaggccaaagtttccggtactatgctgacccattttacccattgcattatttcccttctgcatcatttcgacaaactcattgtagtcgatccgtccatcctgcacaaatgatagtcaaatgagacaaaattgttgtttgtcaatttatcatgaaatacttagcattttctactcacattgtcctgatcaatgtctccaataatatcctcaatacgggtatcacctataccgaattcctcacatgccttttgaagctcatcttgagtaatgtaaccgctgccatctttatcaaagtatgagaaagctgcaaacagcttatcctccttctctactttgtttatatgcaaagttgcagcaatgaattctccataatcaattgttccgctgttgtcaatatctgcctgacatattcaagaaaaggagcttcatttgagaaacaatccaaaagtccagtggatattcatcataaatgtaaagcgacactgatatccaaacttcccagaatgttccgcatttaggaaacagttaatcctcctcactacaagctattttcactcaacaaaattaccatatattacaaatgctgataaaaattcaacatgaagcaagctcacgtttcaaaaaagaagtgtatgccagtactttcgtggtcaacactttacaaccaagaaaaggagccggtgggtacttgtaaaaattgattaaaaaaacttaataaaatggaaatttgtttgcaagatacaattacagatcagaacaaaatcttgtttactaatttcagtataaatgatgaatagatgcgcagaaaccttcttagaatacttactgcctccattagagcatcaatttccgagtccatcaaattagcaccaactctctgcaagcctgtttttagttcttccagtgtaatatgaccgctgttgtcagtgtctagcattttgaacatctcttttaatcctgcaatttcttcttctgataaactctcagcaataacctgcagtcacataccagttcatattaaaacatcaacatgaaagcagcctatatattactaattagaaaaatatgctgctcaccctaagcgccattttctttagtttgttcattgcagaaaattgttttaaccgactcaagacagcggaatcaagaggcttgtcaggagcaactccatcaacacagacccaaggatgacctagaaaataattggataaatttggttggaagtaaaactagatgactagcaacaaattatttacaaatcattgcatacttccaaactactcacatagggcttcatgggcagtcaatctcttttttggatcacgaataagcatttttctgaccaaatcctttgcgctctctgagatattaggccaaggctcagatgagaagtccagatcacctttcaaaacttgttcaaatatcccttgctcactttctgctccagaagccaatttatcaattgcattagtattgcaaatattacaaggaaaatatatttcactaaaatacatatgatctcaccatcccaaaatggaggaaccccactcaacaaaatgtagattatcacaccagcactccagacgtcaacctcacgaccataatgtttcataagaacctcaggtgcaacatagtacgggcttccaacaacatccgtaaatgtctcacctgtcaaagcatttttttttccaattaatatgacacatgaagaatggtatttataattacatgtgcggcatatacaggattatgtcaaacacatagtacctcccatgcttggttgtctatagctactttaagactgtcattttgggccaacatatagacggttctgtttcatattttatatagctaggagtttgtgtaagcggagctagaaatataaacctgtggggtcaattactaatagcttgtatttaagagatgtcaattttctaacttttttggatttatacatgaaaatcaggggtattttttaaaaagctgtgaggtcagctgtccccacagcttgtacatacatccgccagttcacatatagctgtggagaaaatttgacttaaatatccaggtgtaagctctcaacttcacgtatatatgctcatgagtattagttggcacctaaaaaattaagttctggagcaatttttatgagcaaaccacaatgacatggtctacctacaatcaacgtcaacaatcagtaagatatactctaattggcaccagattgtttaggacttagcatcgagactataacaaatgtgtgcaatgaggtgcacaacaagattaacccatggaaatggaactaatccccacagccatctcaaagtataaatacattttttaaaaaatcttctgattagattaatcatagcaccaatgctaatgctatcatcacatatacagtctcccattttgcagtcaccacaaatgctcacattattattaaagtctgaaactaaagtatatatttttgcagaaaattgcattgttaagagtcccagaagggggagggcgccatacctggcttgaagaagatggagaggccgaaatcgatggccttgagaggcgaatcctccttctggtggatgaagaggaaattctccggcttgagatccctgtgcatcacgccgagggagtggcacgcctcgatgacgccgacgatcacccgcgcgagctgcgccgcggccttctcggagtaatgccccctctggatgatcctgtcgaacagctccccgccggcgcagagctccatgacgagctgcaccgcgacggcgtcctcgtaggccccgacgatggagacgacgttggcgtggcccgcgaggtggtgcatgatctggatctcgcggcgcacgtcctcgacgtcctcctgcgtgagcagcttcctcttggcgatggacttgcaggcgaactcccgacctgtggccttctcgacgcagaggtaggtggtgccgaactgcccctgccctagcttcttcccgatcgtgtatagatccttgaggcgggcggtgttgacgtcgcgcttgaggacggaatcggcgagcagcccggcgctctggacgcgcttgaccttgggcgccgccttgttcgccggctgctccgcggcggaggtgggggtcgacgggtcggtggagcgggaggagtggtgggaggagtgctccgatggggggattgtgacgggctcgggcgcctggtcggacggcgcggaggagggcggcgggagggcggggggagccgcgtcggcgggcctgggtcgccagagggcgacgttggcgaagaacccgttctggccggcggcgctggggccgacgcagttgttgcccatcgccggcgggatgcccctaccctacgcggacgacggcggcggcggctgcggctgcggcggcggtggcattggagacgggcggtggaggggcggcgcgcgacgaggccggcgggcgcttggttggttgggtggatcggaggaagacagagaggagagcgaggaaggaccttcctgggaccaaatgaggtgggccccctggaacggaccctctatcactgacgtgtgggccatcctcccgtgtggggcaacttgtcagtgggtgatgagggatagcggtgaggcgacggcgcgggatgcggatcgggtttctgcgcgccaaatcggacggtctggatcgcccggtttacttgtgcaggcccgaatttggaatgcctttgtgtattactttgggctttggcccatttacataggacttccatagttcccttccattggagcatgagattgtttggtttcaatgcaaaactttatcgattttgctatatctcactcgaaagatttcttcttatctctcacttgattttctcactcaaatttacagtgtgttttcttgtaaattatagtgtaatttatgaaatttacagtgtaacttttgtaagttacagtgtaatttttgaatctttgcatgtaagttttgaaatatatattagatttggtttttttcttgaagatatggtaatttagtgtccattatggtgttttttagttgcttttttgcattttactgtgcccattagattttaatctaaagattaaaaatctgtgtgatatgatcataaaaatctttcgaaagatgcataggtactcccaaactttattactagatttttttattacgcagaaaatatatgcgcacacatatgtttgtgtccaccactccacccccctaacacaaccgaagagtgaagtaccttgatgtcactagattcctatgaagtatcgtgtgtgcacaatatttatgggcttttctgttagaggaacttttgggttgcgttttctcctttgaatccaaagctccataaacttttttttttcagattatgagaagttgtgattgtagaataaaaaataaactaggaaagaaaaattggtttttacaacttctccatattctcaccagttgaattcctacccatgtttctcgtaatctaaagctcctccaaacaaaaatcatgcactcacaactccactctctacattaacattctggatgagattattgggcctgtttggcaattggcacaggagctccagctccacctcttctgtaactgaagctcagccaaacagtttcatctctacctaaaataagagcggagttaggtagagtgctcttacaaaataaactaaagagttgaagctgaatttagactttagacagttccgcaactccactctagactcaactcctgaaactaaatttagaagttggagctctaccacaaacatgctaggagtagtgttgctctaccatgcatgtttcttcacagccgacgagtgtagcaatcctacgcggtacacaaagcctttcacgagaaaccgtagtgacacgcaaaattcttgtgttcaaaacggtggttgcattgcagggtcaaaggctcatgcgtcatggcgaccacgatgcctgcttaaacaaatccgtgaatcgtcaacttagttttaaccccgagtagaattcaactgctttgattttgattttgacggtgcaatcagatcccgagtactgtactactgtatgcatccctcgtttataggggcgccgtatttcatttggccgcgtaatcaatgcgtttcctactctgaaagtctgaatttctcaaggactgaaaacgaacagaggcatttctactcgtcagttgacctgctccttcaacttcaaacaggcctggtaaaatggtactagtagtacatggtgttctcgatcttccagttaattaattaagaaacatcaaaattcatgttacatgatgtcactaattaagaaacttaaacggtcttactggtacatatatatggatatcggatgtcatgatcttctcgacctcccgattaattaagagacgatacgtcgacggtggactcaactgtgccgtggaaatatatgcagtcccatagtcgaattctgctcggattgaagtcgtacgtaattaagcccttgaattttgtcaaattgagtggttagttaggacaagcagctagccaaatcgatcaacaggacgcctttttcagcttcatatcccaagtgggattgcaattggggttctaggttaaatttccaagtaaacgatcaatcaaaggacgtgcagagaattcagagtcttagctagggattcttgtggtcggcttgggttctttctgaagaactgtcagagattgaagataaaattaaaccagagctatatctgaacactcgattaaaagttcattcttgtcccgttcaaacaatggagaaaagttcattcttgtcgctgcaaacttgcaaccccacagcttgagattaccacattacgcatcagacaaaagtgtttgacatcgtagtaaagtatagctaggtaggtttggcgtttgaacgccttgactgatcaactgtggacgcgagctgataatccataccgatttggtcaacgttgggctgcagccgaaagtaatactagttatcatcaagccaataagtgaaaactatcgctaaccacttctaacctaccttggcttgccttccaaatggaagtgtgtaacgcgtctgactttttcgctagctaactaataatcgtaatcgatcgaaaaaaaaagtcagcagtcatgaatctgccgtacttgaccgacgacttttgacattgtattgctactatatccatgtctttgctactagtagcatgtgaaagtgtttgctactctctatctataaaagcattgtgcaaagtgcaatccattatagttgtcaaagcattgcaactttacaagaagctactctttactcgtagcgagttgagcaaggagagctaggtagctgccatgaccatgacagtggccatgccgtcgtcgtcgtcgtcgaggagaggtgggctgcgagggccgaggccgctgccgctgaaggtgtcgtcgtcgtcgtcgagggggtcgtcgccgtcgtcgtcggcgtcaaagggggcatccaagaagtcggcggcggcgccggtgatcgtgtacgagcacacgcccaaggtggtgcacgcgcggccgcaggagttcatgaccgtcgtgcagcggctgacgggcaagccaccggcggcgccgccggtgatgatgccggcgtacgacgcgccggcgatggtcgagcagggcgcggcggcagcatgcggcgccggcggcgacccgctgctcctcaccctcggccagcgccaggccgcggcgtcggcgccggcgcagcctccggcggtgccgtcgccgatgatggccgccggcatgctgctgtcgccgggcttcgtcttctccccgaacaccatgcagtccatccaggagctcagccccttgttctaaatcaaaccgtgagttcacgtagaattcatctagaatgtacgatggtataattgtatagtgcacagctcacagcagattaaactgaagggagagtgtaagccagttaattatccgtgctgttcgtgcaaaattttgcaagcgaaattgaaattttgcacgcacagcggtttgcatggtggtacaaagctttgtaaattttcatcattctgtataagcagtagagcacttgtaaatttctgttaccatgcatgggagcttcctgatacaagttcatatatagggctgtttagatccctgacaaaattttttaccctgtcatataaaatgtttgtacacatgcatggagtattaaatataaacgaaaaaaataactagttacacatattgcgtgtaaattgcgagacggatattttgagcctaattgctccatgatttgacaatgtggtgctacaataaatatttgttaatgacatattaattaggcttaataaattcgtctcacaatttacaggcgaaatctctaatttgttttatttttagtctacgtttaatacttcaaatgtgtatccgtatatccgatgtgacacgccaaaaaatctaaacacaaccatagtatgtagacagtgtataataaatttcatatatgcccctaacatttaccaatttatcattcaccgcctgctgtctaactgacatgtggggccctgcgaaattttcagtggcaaacaagtaaaatacagtgttcttttttttttccgctttatgaaacagactcattttgtttgacctgctcccaaatgctcatggctatttgagatcacaccagtgaatggcgttgccggccctacgaggaaatcttgaaaaaatattgattacaagctttggcaccggctgtaagcatcgttgtcttcctccctggcatttatatatgttttgacttcttgaagcagatttcggaagtattcaatccagttgcacattgctgatagtaatgcgttcatcatgaccaaacaaaactgaaactgaattttttttttgtagaaatgttatcatttgagaaataggcctggctgtgaatttcggtgcaaatttgacaggctatttcaggataacaatggagcagctacgagggaaaacaatgacaaacgaaacataagaagtgcagtctgcagttcagcaacattcctattctgagtgcattgatcatatcacacaatcacaaagcatagagaaaatcccctatgtacccatgaaagttcatctaattccttctatacccctgaattttgctcaatcccttacatacccctgaattttagtttggatcccttccataccctttccgctagttgaccgttagttgaccgttaaattcttttgaaaaagtccattttgccctttgctatgaagaaacataataaattaatgaagtatattgttggaatgtaaaaatttattggatgagactattatatttatgagtatgtgatgcaccatattatttgtgacaaatttacttttacatatgatataaaaagttgatacttatttattagttattaaaagttcttttatgtagcatatgtgttttcatagtaatacaacatatttgtttattacttcagaacacataagctaaaattttttttaataactaataaataagtattaattttttatgtcatatctaaaagtatatttatcgcaaataatatggtgcataactatctcataaacataatagtctcatataacaaatttctatgctccaacaatatactctattaatttatatgcttctttataccaaagggcaaaatggacttttttataagaatttaacggtcaactaacggtcaactagcggaaagggcatagaagggatccaaactaaaattcaggggtatgtaagggattgagcaaaattcaggggtatagaagggattaggtgaactttcaagggtacacaggggattttctccaaagcatatgccactgtattcagactcacaggtagaagttgccattcaaaatacacaccatttagacagagcagacgtgcaaaccagatgcaacactccagcatttcggcaaccgcgcaaacaagatcagattccatagcttactatgatgtacactctacacagagcatgtcagttagctcctgattacaagctattcacgcctaggtttgaataaacacactataagacaagctcaaagcttccaaataaaaacatacagctcaaaaactgtgcttgggcaaaaaagaaaaaaaaaagaagaggaagaacatgtcaaagaatgcaatacacacacttacaatgaagctgtaaacaatgattccaggttctgatttatagacaatatgcccgggaaggtcgtttcattgccgtgggctaggcagacgacgccagggactcaacatggtggatctgtcgagcagcagtaggaagccaaggaacgtagttgacagaccgaaggtatacctgcgaaatatccatgggaacagatttggtctcgattcagaacaaaaaggataatgatatattcataaccaagccatcatatcaaatctacctggctgtggaacttctgtttctccaaaagattatcgagagcacccactgcggcaaagagatacaagactgttagtttctgatagataaacatagccaatgctattggtatggaacacagagagagagaactttagacaaatcgaaaaggatcaattattaactgcacgttacgttggaaagaaacaatctgaaatattttatagatttccttccaattacaacttcacatgttggcaagcacacattatagaattccagatatggaattgaggtagcatgcaacacatgttactgtggtcataactcccatacaaaactggggctcaagtttttagcagttgaccacatatagcacataagcaagtctacaaatgagtccagcgacagtaaatctagatatgccaaaggactaaaatgactgacaattagatctactcaactcaagtgtacaacataaggaaaaactttgataaccacaacttaaatttccattgttgtaccaaaagtaccaactacaaattgttgtgttactgctttaatctataacaatgcagttattctacccaccatataggttgatttcatctacagctaccacaagcaattgtcttacaaatgtaagaatgcaattttatatcccaaccgtcattgatttggtgacatttcatttggttttaggcagtagtagaaatgctccaactaaattcatcaatctaaactaatgaaactacaagttctctggatgtgctactctctaaatttagcataaatgtgtcaaatgtgaacaacttactaacagtgaccaatgtgagcaaacttaattataccttgcaaacccctagcaccgagaagcttcgtggtgaggcagccactttcttggctttctgttcagcaaccacctcccggcacagccgccgcgccatcgccctcgccatcaccagctgagctctctctgctcgcaatgctgcgatttccctccgcattgccgccctgtccgcctccagagcctccaccctggcgtacaatccccctgcagctgcattgccctcccccatgaactccccaacaaccaccgccccggataccttcgtcgtcgagctcgcgcacctcacatccaccgtgtactcgaactccttctccacaggggtgaattgctcttcctcatcatcgtcgaccatggctttcacctgcatgccaccgattgagtcgccgccgctgcttccatctgtctgtagcgcggccgtgtcgatctgttctacctcttcgccatcttcctcgtcgtgctgctcctcctcgccgtcgtcggagaaggaatcagggtcgatcccgtgggactggaggcgggagtggtaggaggcggcgaggtcggagagcgaggcgagctcttcctgtacctcacgctcgcgatcctcgcggccctcggcgtaccgccggaactggcgggcctccatctgcgcggccgccttctcccgctgcagccgctcgatcatgagcatggcctcgctggtcgccgtctccgccgacgcccgctccgcatccaactcggcctgcagctcccgcgccgcctcctccgcggcctccttctcgccccgcagccgcgccgccgcctcctccagctcctccagccgccggatcagctccggcgcctcccctccccacgccttcggcgacagctccggcgatcgcgcgggaggccgccgcttcaccgaccgccgggacgacggcgatgggtcgccgattggatccatggaggcatctatatatccagcgaggttcgatcccccaatccccaaccccaccctcaccgccgccgccgccaccgccgctgccgccggcgaacgaagcaaacgaagcgaagcgaagcggccgctgctgctcggaaggggaaaggcagtggcgtctggttggaagcgagtcgagccaggttggaatttgacgcgaaccggatcaaactaaattttaataaactaatcaaataacaattgaatttgtgtcgtactcgattaatttggcattagattggtgagctttccacgtcgtggttggataaacaaactgtttatgtatgtgtgtgtccttggaagcgaaaggctcggtgagattgaaacagcggctgttacgatccgttttgattaagcttggtgggcccgggattagggggggcgcaaaaggtgtagtaatactagttgggttgtgtgcgtgggtgggggttatgattctacgtgcgcggccactacccgtggaaatcgtggaagggaattttttgcggcgaaaaggtgggggaattagagcgaatttacctatgccgtgacagataacgataaaaagacacacgatttttcagtggaactgtggaagggagtttttctctcttttttttttttttttgaaaaccggaagggagtttttctgaccctacagagaccaaacagatcgctcgtgctcggtgctcccttcgcgttgacacggaaggaaacgacgcgacggctcgtttgtaccgagaaagctaatgaaagcccacggttgctgtttctttttttggcccacggttgcttctattttgggttaagcccatctttttttagcagcccaaatacaagaaagaggagaagccatgcacatgggcctcgcgggtcacatatacgttttcggttgtttttgaaattgtatttaaaatttattctcgaatttatatgtgcaaagtttatgcatacagggtttatacatgtacagttcatacgcacatgctatctatgactctatgtatttcaaagtttagggtctcgtttggtttgcaatatttttaaaacatagtaatagggaaaacatagaaatagaatgggaatacatgtgtaaacttaaggattaataaccatatgaaacttttctacagttgcgtactaaacgatcaaaggattaaaaacattagattggagtggagggatatgaaattttcctttgatttctttgaaacgaatgacaattaaaaaaacgtagatattagggaagtacctaatatcaaatatagaagtgaggctttgaatttagaccggctagtccaccatcttgtgaagctagccggaagacaacgggacgtttctctgaaaagaatgacaatttagtgtccattcctaaaagctgtatatgcctatacttttcctttacaattcctctaaaacgaacgaaccctatacgtataaagttttcaaatacaaatctcctgagctaaaaaacgagttgacccaaactcaaacaagcctaatgcaggcctataaatacggtactgatgcacctatgggctgagtgatgagaggaatatcacatgggtcaatataaacttgttttggatcgaggaacgtagactgcaactctgggtaggctaagagcaagtttaatagtagagcccactactatctccaattcatctatacccgatataatagctaatttatacaatagttgcttactatattattaatatatgatctcacctgttatacacacattgcgtctttaagtccgtgctgcagctggctataaatttgtagtccactgtttttctctctcatcttttatctcattaaaatatgtttatagctggctaatagtctgctattgtacccgctctaaatccacacgttatagccacacgtgggctttggctaatagtctgctattgtacctgctctgaatccacacgttataggcacacgtgggctttctcattgttttccacccgctaggctcacccggcatgaatcgtgtgtttccttatcggaattgtctatccatttgtcaggtgatttttaacaacacaaatcactaagatttttttctattattatatttgcattcaacggactaaaaaaaataacaaatacatatttacttacatattattttttatcaaaattacagtgcacttacatgccatatcaattaaatttacaaatgtaatattagttatattgaactgtaattttatattttaaagaaaataacaaatacatatttacttgcacattatttttatcaaaattacagtgcacttacatgttatataactgaatttataaatgtaattttaattatatatgactgcaattttatattttaaataaaataacaaatatatattacttacagatttttttatcaaaattatagtgcatttacatgtcatatcaactgaatttacaaatacaattttagttatatatgactgtaattttatataaaatgcaattttatattacaacgttaatagtgtcttatatatacagtcaaattctcctcatgctcaattagccaagagctgcacatggtaagcatctgatcgtgagattgaatcctaccgcccgaggtttggtggtaagctgcgttagtttttttggatgttgttagcacgaatctcactatgaattggagggttgaaacaacgagtgatttccaacgaaaaatctgtcaggcgaagatttagcaaaatcgtttccttcatgccatctgacgtgaaaatgcatagcgtttcgtacattattccatgcaaattctcattcttcttggacgttaaacagagttaaatcgaccgccgacgctgtatccgacaagatgcccttttactcctagaaatacatgcatgccagatgcttgaggaaatctatcttctatctatctattatataattaaaggaatagaaaaatgagcctccacgttcgctctcatagcctagaaattctcaaattaatcggagaaaaagaaaaaacagagtccatatagaaatacaatttagaaataaaaagaaaaagcagagtccatatagaaatacaatttagaaatagctgaaattcggaattaaaaaataaggaatattagaagaggggactagagtccatatagaaatacaatttagaaatagctgaaattcgaaattaaaaaataaggaatattagaaggggggaccagagtccatatagaaatacaattaggaaataactgaaattcggaattaaaaataaggaatattagaagtagagtatagagtctatatagaaatacaattaggaaataactgaaaattggaattaaaaataaggaatattagaggtagagtatagagtccatatagaaatacaattagaaaataactgaaattcggaattaaaaataaagaatattagaagtagagtatagagtccatatagaaatacaattaggaaaaaatagaaatttggaattaaaaataaggaatattagaagtagagtatagagtccatatagaaatacaattagaaaaaaaatagaaattcgaaattaaaaaataaggaatattagaagtagagtatagagtccatataggaatttaaaactaactaaaatttggaataaacataataaaattaaaagtagagtttagagtccgtataaaaatacaatttacaaataactaaaattcgaaattaagaaaaacatgggaagaagagtttaaagtcaatataggaatacaatttagaagtagctgaaattcgaaattaaaaattaaagaatattgaaagatgagtttagaatccacatagaaatacaattagaaataataaaaatttagaaataaaaataaataatattggaagaagaacatagagtctatatagcaatacaatttacagaaaattcggaatttaaaaaataaatattaaaagacgagtttagagtccatataggaatatatataatttacaaataaataaaatttgatattaaaaataattaataactaacacgtatataaaatgtaatatgaatattacatattagtagttttgtaaagttaatgcaaaatttaaaattatgttgtcattttaatatatttgaataatataatgagaaaacatatatgctattatatgagacaaaatataatgatgctagccgcgcaatctgcgcgggccaccatgctagttgatattatgccattataaaaaggcaaaattggttctatggcatcgaaagtactcgattttggttacatagcactaaaagtttatggttcattttaatagcactcaaaactggaaccgttactatttttagcattccgtcagcagttcgtctcctcaccccatcctacatctgtcttgttcctcctgcactctccctcctatggttgaccactcttcgattcaaggcagcaggtgagctcgaccacgacagtatagcgctgagcgagttggagccttggatggtggctggttctggcaagctagaggcggcggctcttgacttgggtcagcagacaacggatccagggtaaggaggagcaggtcggtactcaggcgagcccgcgacgagcgcgagggtggtgcttcgggggccgatggatgagctcaagagcagcatgtcggagcgagctcaagggtgccgacaataatctggaggacgttgcttcgcttcgggcattcatggatcggatgacgcatctaggggagagaccgagagcagtgcgcgcggacgaactcggaagcggcacagccgcatttgaacaagctctagcatggcggaatggcagatgagatcgatcgacgatggcgctgtccgggcaaagctagagcctagaaagtggatagatcacacctagcaagcgcggacgaatacagtggcttgcggatgatcagcttgtgaggctgggctcacgtacgtattacatgacgagcttgtggagccagcatcgatcctgtgttcgcaccatgactgaccgctctgagctcctgtacgactgctgtttggaggtgacaagcaagaggaagagggccaccattggggtttgatttagttttttgttgaagaataatactaattagaaaataaaactaacggaagtttggacggaatgctaaaaagaagcaacggatgtaacttctgatgctatcaaaatgagatgtgaactttggatgctataaaatcaaaatggacaactttcaatgctccagaaccaattttgtcttataaaaaatagtaaaagattaaagttgtgttctttccgaggggttgggaatgccctcccctccgcacggaaaatggagcaaggttggaaaccattcctctccacacggaaaatggagcgatagattaccatgtgataattaagtatcagctataaaaaattaaaaaatagattaatatgatttttttaaagtacttttctatataaattttttgtaaaacacatacaatttaacagtttgaaaaacgtgtacgtgaaaaacgaaggatatgagttgggaactcaggggaaagaagtcaaagaaccctggttcggaatcggagagatgcaggtgtagcgcatgggaacaattaaaatcgtgcagcataggtgcatacgtacgccaccctctcatccgatcggccggtcaccttttccttttccttttgggcattcatgcatgacgtctgggctgggtggacccgtttggacgcatgcatggaagcatgttggcaacgcggctgcgcgctgcgcctttcaccggaacggcactgcgagcgatagaccgggcggtcgtgtcgtgtgcctgcttctgtctcgctgcacctcgccgactctttcagctgaaacgatcttggcgaatctatttgcagagaagcgactactagtgtaatccaggaatccaaacctcaaacgcgccatatgatcattagtttaggggtgtttagatgttttagtccagtctcattggatgtttagacgctaatttggagtattaaacatagattaataattaaactaattgcatagatgagagctaatttgcgagacgaatttttaagcctaattaatccatagttagcaaaacttttactataaacttttgataattatgaattaattaggcttaaaaaattcgtctcgcaaattagttcttatttatgcaattagttttattattagtttatgttttaatactttaaattagtggaatttagtccatgtcttctaaacacctcattagctatagcgagtgcataaacattaaacatgcgcatgatgcgtgcatgcatgtattggtcattcttgtgcatcagactcttcttttcgttttggcttgctttgcacagagagagagagaggtgcgggattgtgtgcttttgtgaggtgggccgaggggaagcgagcgacggtgtcaggcggaagtgggtgttctgctcatctgctgcttttgtgcaacgtctctatacggtacggtttggtccttctcgaatgcgatcgaggttggagggagcagatatttgcatgccaaaagcaacatgggaaatggttgccttcgatcgacctccattttgcctcgtgtagactgtagacctcgcctcgtttcattttccccagggttatggttgccttcgatcgacctccattttgcctgtgtctggcacgtggcaccatactggagtacagtacatggtaaaaacaggacagggagagtaaaaaaaaaaaggggacattaatttacattgtcaaaacctagacttgagtagcaagtttgattagcttaatcactcttccgtacagacgagcatacagtcaccgagcggtaagatcaccaccccctcctggccttctcgatccttccaccggtttagggttttctcatcgcctcacctctcacttgcatcaccccccctcccctcccttcccttgcattcccataggatcacatcacccactccaccacccttccctcctccctttcaattctagcctcgtcaccaccctcccctctcgttcttgccttcctccacccctatgccatggcggcctactgcgacggaggcggtggccgcggcgaccccagcggtgggggaggcggcggcggcgttggagccccgccgtaccgtcccgctgctggctccgtgtggtcgctgccggggatgacgccgcggccgccagggcctcctccgaagtaccagcaacccgggcaccagccggccgtcgtctacagggcgccgtcggccaaggaggtcgagcagaagctgttcgtgtcggagaccgcgctagcgccacccgcagcggcggcgtccgcgtccgctggcgaggcgccggtgtcgaagaaggggctcgcccaccctacgcggcggccggggttcggaacggccgggaacgaggtgatgatccgcgcgaaccgcttcctcgtcaacgtcgccgacaacaaccactacagcagaacaagctagcagtgacgggctcaaaccctcaactgtgacggatagaccccctcgtcacagatcaatggtcactgatgacttaactcacctttgacgggtgtaggtccgtcagaggtgacagacacctttgacgggttgtgtcatgtggtcacatatgagaaaaatcacccaaagaaaaaaaaggaaaaaagagccacaaccacagctcaacacccgtcactgatgtagatttcgataaaaaaaaacaaaaaaaaagtgcttctgggtagttgccatcgcattcatcacacacaacatttcatcacacagaaaagtcttcacgaacatttcatcacacataaaacagccatggcaagcaagcaattcatcaatcacctgacgagcaacaaaaacgaagggaataaatggttgtgggttttgccgggcagggcttcttcataccacggtgggcttgaactccttggcgcgctagaccttcttgagctcggcctggaggcgaccttgctcctcctccttgcggatgacctcgtccctattactgctcctcgacgccgccctcttcgccttctgcacccggaagcagccgacgggggaatctgcagttctgcactcgtcagttggggacgcagccggcggacggaggagacgacgcccggtggccggatccgcgtcccctgaccttgtggaggacggatctagagccaggcggtcggaggtggcgcccgtcagttgggggatggaggtggcccccggcggtcggggatggaggccgcggcgccgccgttc

SEQ ID NO: 51319 - DNA, 6025 bp, Oryza sativa
attgagaaataagagaagggagaggaggggagaaagaagggggaggaggatgggggtactgccgccgccgcttgcagccacgcgccgccgcaccacctcgccgcttcacctccgcaccgccgccgctgctgccacgcaccgctgagccgttgccgccacgcgccgccgcaccacctcgccgcttcgcctccgcaccaccgccgccaccacgtattgctgagccgccgtccagcgccgccttgcccgagggcgtcgggtcctccgccgccgtcgcaagagcggcgtcgcccgaggcattttttttcgcggtggagaaaatgtgtggataagggagagagagagagtgtgagggagagaggagatatacatattagtctgacctagtcaagtccccacccacacctgtgacgggcctagtgaccggaccgtttgaggtgagttaacctcacctttgacggtttataatcatgcaacccgtcacaggtaactagtcacgggccagaagtggaagccgtcagaggtgtaactagttatctgtgacgggttgcagaaggatgcctcactgatgacggcatcctgtaagaaccgtcaaagatgaccctcatcactgacgagtgctaaagtccgtcacagatatgccgttaaaggtgtgaggatctggtgtagtgaacctcttccactacgatgtgagctcacattacccggcctcttcctctccttcccacccccagatctacgtgtactccatgcatgccgtttactactgtgctcccgtggattttggatctgtttaatttacctctgtatgggtgtgtgtatgcacggattttggatgctttttgtttccttgtgtcgttgcaagttcgtttctctgattctttcatttgcagttttgtatggagcgtggcttccaatctcatccagttcgtgggtgtttggtcggagcgtcgcgtttcctttcttgcataaagtttctggtccgttttttgatccttccctttttgtttggtcttttccacttcggtgctcgctgctagtttggtgctagagatctggctgatgtcgagagaaatctcgtggccgcagcacacgcagctcaccattcgaacttcgaatcgaagccttccgttgtgttcgtttcggtgacatgcatgcacatgtactacgcataaagcatatcatgtgctcaacgcccggcctacatgcatgtcgtcgttttcttgagaacgttggtgctgtgttttggaaatgctgatttcgtacaagggtcggcctgatctctccctcgtgagagctagttcgggtctttccctctgcaagcaaaggtctgctcggttcagtgcttttgcatctcgttttgtgctgctttacaagttattatgtttcttttgtgtgtgagagatggaagaagacgacgaagcccctctgtgcccgttcactacctctcggtttgacttttttttttgttgttttttggagactgctctttttgtgtaagcggatgtgttcgcgcgagcttctagctgctttcttgtaagaacatgctaatctgttcttcatgtaattaagcgaagcctttgcgtgaacttttacatcaagtcgtcgtcactgaacgcctggtagattccctttttctgatcttcggcaaacactccatccgaaagattgtcgctggaatggttgcagaaatagagtggtgatccacttttaaaatatctgtgaatacatatgtggcttttggttctgtgttttctgcttttttttttggagtagctatatttatggcaccatatttttcaccaaaaaatagtcagcatatatttacattgtaagtccctaaattatatatgtaattatagtgtaagtgctatataagtgccgtgtaagtgaataaattacatatgtaattatagtgtaagtgccgtgtaagtgaatgtaagtgggtggtaattagtgtataagtactttaaaattcaatattaatttgttttggcaataaagtgaatggcaataccgtgctcggttggttaggagctctgtctgcgacttcgaaggtctgggttcgactctccgtcacggcgccttatggcgacatatttttagcaaatctattttttttggcattttttttttgaaaattttaattgttgtctttgtcgggatctcgttcttttttattccatgcgaaaaaaaaccagtcgtgttcaacagtaagacatcgagttatagacttgttccgatgattttttttttgtccaataacgtttttcagtccctttctatgtttttgggctttcgaagatgtcgatttctgatttctgagctgtggcccagtttatgtgggcttttgtgggccttagaagaccctatatcatccatccttcatgttctaacctagctataatcttcaactctcactatccattcttccctccccattattcctcaacgcttcgccggcgattcccctctagactctagcgttcgccatggatgcccgccccatgtaagtgtcgtaccccgtagtatagcagcgtagttctacctctatcgtgatttgaatggagaagatcaacctctatcaccttttttttgttgtttgatttctgttggtccttgatttaggtttcgttacttttgggcattcagttttttttggtggttttcgcctacattgatttccacaatcaataggctctgatctgaacgaaacacactgaattttgagtagtttggtgtgttagtgatggctaactgctctgatctaaaattactttgttattatgtgatgttcatctgtcgagttcttcttattttgccctaagatcttctctgtaaaaaaaaaaaatctgcccctcatgtcctatagaaaggctgtttatcttccttttggattatgttacaggtttcaatcaatcctgagtcaaaatcaagagcaacaaatagggaagtactcaatgagctcatcaagttgcatgggaagacatctcttggtggcaaattgcctgcttatgatggaagaaaaagtctctatactgctggttcactcccttttgaatcggaggagtttgtggttaagctaattgatcccgaaaagaaggataaagaaaggtttgtatgatgctagctagatattttcgttcttatgaattatgtgttttgtagtctcaggttattgtttattgtcttctgcagggcggagagggagtacaagatcacaattcggattgctggcagaacagacttctaccacctccagcagtttttgcttggaagacagagggatatgccccaagaaaccattcaagtcagtcattgatgttgtcctcaggtagtcgccatcttggaagtatgatttttttgttgtgtttgttttgacttttgcttgattatttactgactagggtactaataatgctgtattgacaactacttgttctgcagttatgtcacagtgtccagatccttcttctctacccagtttggtcaccggggtgacattggtgagggacttgagtgttggagaggttactatcagagcctgcgcccaacacagatgggcctttcgctgaatataggtacttacctgtcagttattgtttatcagttttcgctgaatggaagtgatcttttcagatactaactactgttcggtatgcttcattcagatatatctgcaacatcattttttaagcctgtgacagtgatccaatttgtggaggagttcctgaacatacgtgacacctcaagacctttgtcagaccgggatcgtgtgaaggtaatattcctactgatggaattcataaaattatgcaatactgatactaactcatttttcatgatgttcagataaagaaagcattacgtggggttcgcattgaaacaaaccaccaagaggaccaaatcagaagatacaaaataacagggattacccccattcctatgagccagctgatgtacttatctttcctctgcttctgctataattatctttttgtttacatgctgtaagatacagcaaatcaatgtagattgttgatggaatatttgaaatgtctttgtttatggatcttgggcatggtagtacattaattgtttgtggacttgtgatagaaacattttaatccttttcaaaggtttatgccttagatatcaatttatgcgcctttgatatccatactgtcaatgttgttaaatgtccttcaatgtgcctttgatatctataaatgctgttaaatgtccttcaatgttctaaattgatgtgtaaaggatgattgcacactgtcctgagaatagcagtgctttgtcatccttttttaggacctgcattttgttatcatgcttgttcactgttttatagcatgaacataacttgtttttctccaaactgatgcctggtttgatgttgttagatttcctgttgatgataatgggacaaggaagactgttgttcagtacttctgggataggtacaattacagactgaagtatgcttcttggccctgcctacagtctggcagtgattctcgtcctgtatacttgcctatggaggtattgattcatcatccatttacctctacctgaattgtgcatgctgtgtgcagtttgttcatgcaaatgtggttgcaggtgtgcaagattgtagaagggcagaggtactccaagaagcttaacaacaaacaggtgaccaacatccttagagcaacctgtcaacgcccccagcagagggaacagagaattcatgaggtacaataccatgtagatgcagagccaaatttttatgcttttggattttggctcacatttgaatgaccttctatttctgcacattttcttagaataacatatccgtagaacataaggctattttttttcttgatgagataatgaagataatatcatatatttgtattgacttccatttcatcttctatcagatggttctccacaacaagtatacagatgataggtttgctcaggagttcggcatcaaggtctgcaatgacctagtctctgttccagcccgtgtgctgcctccacccatggtactatataggttttattccatttcttttgttcgcattgtttaaacttctgggaatttctaacaaccttaatctttgcgcttttcagttgaagtatcatgattctggaagggagaaaacttgtgcacccagtgttggacagtggaacatgattaacaaggtgatgccttgctttattattacaactcaatttctctctcaagttaattttgtattgcctttgtttgaaagtgaattctaggtacacttgcttaacttctttatgaattgttcattagctttattttttgttggagagtatctgaaattgacaagccggtactgaaacataatttcagaacctgtaaagatacaactacttagccaacataatttactttctgatgtgtttaaaggaagactctaatacttgttaattttttcagaaaatgatcaatggaggaactgtggataactggacatgtctgagtttttcacgaatgcgtccagaggaggtacaaaggttctgtggtgacctgattcagatgtgcaatgccactggaatggtaactcctgcatagttacaatgctattaaagcagtttaataattatatgtgctgcaattaactttgacttgaccttgtagtctttcaatccaagaccagttgtggatgtccggtcatcaaatcctaacaatatagagaatgctctgagggatgttcacagcagaacatcagaactgctagccagagagggaaagggaggcctgcagcttttaattgtaattctgcttgaagttagtggttcttatggtatgtatattgttggttgggtaatctaaatttccattccctgattttttttattaatgtagtatatgcatgatttttacagggaaaattaaaagggtatgtgagaatgaccttggcattgtatctcaatgttgtttgccaaggcatgccagcaggccgaacaagcaatatttggaaaatgttgcact

SEQ ID NO: 51320 - DNA, 720 bp, Oryza sativa
cacacaaggcttttcccagaggttcatgggaggcgagacatgactgacaagagcggaaacatccttcctggtcagtgttcttgttggttgctactgagaacatacgtctgctacttcttcaggcatttgataattggatatattgttgtaatctgtttctttttggtcctgcaggaactgtcaaggaccgccagatttgccatcctacagagttctatttctacctgtgtagccatgctggcatacaggtaaacccatgctggaagctgtttgcagattgcacaaatttttccagcctacaaaattttcagttaatgtgtgctgttgacattccttttctcagggtactagcaggccaactcattaccatgtcctttatgatgagaaccattttacagctgatgaacttcagaccctgaccaacaatctttgctatatgtaagttcatttctctctatctccacttagttgcttagctcccttagtctttcggctgcctcaactctgataattcctactgttggcaaaatgcagctatgcacgatgcacccatgcagtgtctgtgggtgagtcttcttttcttgcatctttgtttctttttatttctgcatcttcgtagatatgctaccttaacagatgtatacactagtttctgtgaatggttttactgtgaattggactaatcttattagcatattattctcaacaatacagattctt

SEQ ID NO: 51321 - DNA, 896 bp, Oryza sativa
  unsure (1)..(896): unsure at all n locations
cagttcacagatagcagctggtctaaaagggatacaatctcttcctcgacaattgtcagtcagagttgctaatggtggtacactctgttgtgatgctatgattcctcagtgtgaatggcaagtgcagggtcacagatttagaaccactttgagaattttgcctcttaacagctatgacatgattttgggaatggatttgctgaaggagcacagtccaatgttagttaattggtctcagaaaactatcagaattaatttgctgggagcaatggtgactctaacaggggttcagtctgaactgtctaggtgtgaattgttatcagctaaggagatgcagcaattgcaacagaaacaggcagtagcccatatggttcagctttgttctctctctcaagatgaggaatctgaagaaataccaaatgaaattcagttattacttcaggagtatgcaactgtttttgctgaaccaaaggggttgcctcccacaagacaattcgatcacacaattcctctaagcnnnncaggggcacaaccggtgaatgtcagaccctatcgttatacacccgcccaaaaagatgagatcgaagctcaagtgactgaaatgttacagaatggcatcatacaacacagttctagtccttttgcatctcctgtactgttggttaagaagaaagatggatcatggcgattctgtgttgattatcgccatctcaacgcgattacagttaagaataagtatcccttgccaattattgacgagttacttgacgaattgtcaggtgctcagtggtttacaaagttggatttgcgagcgggatatcatcagattcgaatgaagactgaagatgaacacaaaacagcatttcgcactcataatgggcattttgagtttaggg

SEQ ID NO: 51322 - DNA, 43483 bp, Oryza sativa
  unsure (1)..(43483): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnncaattcgtgttgcgagcggcttcatcccacggtgttggtgatgcttgaagggcgagggattctttagttgtgaattaggggtaccaggataaccaaattttgatggatacaatgggctattctgaacccggtttggcagaaggtaaagcagtatacacacagtctagcatcaaacacaagacacagcagttgaactagcttgcaatagcaggctctcctgcagctggtatataattcatttgctttggtcaggaactcaggatgcctttcagtacgttatccggaaaaaaaaattaaattggtggcagctcagtacatgattactctgattattttccatcatggtcgtgcactgaaaaaacaccagctgtaaatatgaaaccgaaaagccctaaagttggtcgctgtcgtcttctaactatacagtgttgttcactcagctagaacatataaccacaaaccgtcggaatgtcatgcacaaagtattgatcaggctgcactgtgcacagcagctactcccaaaaggttcatgaatctctcccaaaatccaagtttgtgattattctgatttgtttctccatgaatatgaaatattgatttcctagcccacccatccatattttgaataaacattgtgaatctttaaagcacaaagtgcatatgaggggttactatcctttttgtgttgtttgttggtcctactctagatcacttcttattgaattaaaaaaaaaatagccacgctagtactccaagctagatacaaaatgattttttctactatgttcatgttataaattaaatactacatgttcatctcgatcttaatacacattgatgtgatattctcaagggggttaattttggaagccaataataacaaagagaagcaataaactaaataaaatacatattatgtagggcagaaaaaaaatctagtcatcctctttacctgtatggacttgttcagctaatcccccaaaaaagagattggatgggattgagggggaacaattccacaccacaataggtgcggatatataaaaccccctccgaatccgtaacaatcccctctgggagtgctaatcgaacaaggactaaaagaattcatcgctttgtgcttgttttttctctaggaatacaacttcgtttgcagcatgcatgcctgattgtatgcatcgttcattgattaaagtgagctttcaccacaacaatgtacatggcaccaggaacatggatccctattttcattattgcacttttgaaaactcaaattctacctgtcatgcttcaatttattctatggtagtcctattttttttttcagagcatgaattgaaccactacaacaaggcactgatattgtttaatacccctcggtatggcatgtgtctaccctcttgccataggcttgtgccatggtagctgccgaaggtgttcgtgtgttgggtccgctagtgaatctctcttgcttatataacacatttcttaacttcgcctctagctttccgtagtttgtttctccattgatataccttctctgtatcgcgtaagaaatgagctagcccttctctagtatactgccataaaccagtaacttattatcaggggtatttgtcactttgctggcccttattttatatagcacaatgtattcatctttagtgttgtcatctcgcatatatagagatattttacacctgcagtgcaaaggaccaaagctgagcaccacaaatagcggtctcacacactttcctcctcactagcaagaatacgtgcatagccactctgtttacacttgcttgtatctgtgaattcctttacataagaatgggtggtgtcgtggaaagagcatacaatgcaccatttgtgttgtcaaggggtttcgttccattagagcacggggcataggtactgctcgaacgacatggaatttgagctagcagtgtttgtgggacagcagctataaatttccatagcagcatggtatcatgatgctatgcacagatatccaaatcctgtctcgtacgttatggtgctgatcaattaacgcacgtatgttggattgtgacgatgacatacatgtccatcttatgtcagccaagaaaattcagtagtacctactcaaacagtaacttcaaatctttagtttcggtaaaaaatcactagcagcaggcaatcaaatatggctgtcaccattgaaaaaatatcaggactaaactacttagtaacacagaaacctggatttaacaacactaaattaaaaagcaatctgacagaatgtttaagcactagcaaccatagagtcctcccattgttcaccaacaatacatgaacaaaaagagttgaatatcacaggaactcaagccagagaagcaatcaccagccatgctcatttgtctcaaccaactgacggtaataaaaactttgagggaagatgggatcatgccatcgaccatgatgatgtggcagagaaaaaacctctcatagacaacaagtacaccagcaaaagaaaaaacccaatccaataataaggacatactgtaccaaggaaaaagatctttttaacttaaagagagatgtaccaaataatagggacatattacaaaataggtattcacatggaactctcatttggatgggtttcaaacatgttctctaaacttgtcctttacaccagtctgtcacacacctcatgcatgatactaatgcccatgccactacttgtgcagaagtgtcacacctcgacttggcacaatacaaacaatgtttaagagggtgtgccacgtagaacagcgaaccatcctctacagaaccgcgatgatggtaccaatccgaggaaacactattgaaaatttttatacctatatgtaaccacgggtaatcatgggtagcaaccttcatccagaaacagcaacatgtaaaaccaagtgtgattttggtttatttgtgatggaaaattggcaacgaaatatttaaccatgagttggttttgagtgagaaatttggtttggattattggcgattttaggcgtcagtgcttacgactaacgtgggtcaggttgcgataactgtgcctagaatcggatgtttggtttacgtgtgtgcaggtgatcgaagtcaaccgcggtcaatgacgaggaccgggactatgctcagggaggagcagaggtccagcacggtcaagaggccatgtgacaaggttggactgacgtcatgatccctgatggtcaacctgggtagacggcggatcgggtctagactcagggggagttgaggtccagaacgatcgacgaagccgtgtgacaaggttgagatcaagatgacgcgcgatggacgaacaccgtgtcgggaagacttcgcaacgggcttcacaaggtcaagtgtgcaagtgccgtgttcgcgaagaaaatggagaatagaagaggagctacagtacttcgaagtactgtagcatgcaggcatgcactggcgtgtgcatgagatggcaagtgcagctagctgattggctagctagcttacacatggggtcggttggcatggaggccaagccgacgcctgattggctccaggcccgagtgcttggctggcagggaggccaggccgagcaggcccaagacaagacgacggcccacggcatcggcaccatgcgtgggcaagtgcgggagatcgcgcaaggtgcgcgcgcgcggtggacacgcggcggcaaggaattcggcgcgcacgggcgtgggacccaagcggtttccgcgagcgcgcgcggagcggctcggcgagacgcgtggcggctccggactgggcgcgggcgtgcgtgcgcgctgtggaaaaggagacgggacgcgcacggcacgactgggcaacgtggcaagcttcgattcggaaagacggagacgacgcagatcgatctcccgatcggtgcatgctgattggctcggaggagccttctcacggatcatggggcccacgttgaggagcacgcgggcgcgcacatgggaggaatttggtgcggattctttgtgaaaagaggatcccggtgtggcaagagacgtggcttcaatccaggctacttccttaggatgtaaggaacaacgtaaggcctagattgcatctgagttgggggtttcgccctaagggcatttgtgacaatgtcttaggggtcttaggctataaaaagagaggtggatgcaatggtggagttgctccttttgtaatccttttgagatgctcgatgagagagttatggtgtgagtttggagggtgtttgcctgagaggcttttgtattaggattagtttggagtgtgtttgtccgagagattttaaatttgtgttaatgttcctctgaaggtgtatgtttgctcctagttgagcagttattttgcatcacctatgaatgaaatgatttgaaggatttcgttttttccttgttcatttacactccgcaatttaaattctgcttgcaatttgaactttgcgatgacgagtttttgctatctcctcctcacctctcttctagtttcaggaattccttttctcttcctcttctagtttcgggaattccttctctcttcttttctagatgcggcttctcaaatagccgcggttctagtaaggattttaagaaatccgtcttgatgagtattttcgggggcaagttttgaattgctatattcaccccccactctatagccgttcttggtctttcacaacaacaatataagggtgagtactttcaatggcttaggtgtagggacatggcctatccttcattttcttcaacctagactatgtgaaggggagagtgagtacatgataataagagagagagagtacgtacttccatattcccctagtcactagaaaatgtgaatcatgcaagctttgcaaattctttattttaaaaatatttttcaaaatttaagttgggtttttaatataccactgaaggtatcgagggcactaatattggaggttaataacaaagagaagccataaaacaaaataatgcacatggaaaaatattacaaccatgaacggatccaggaatacatgatcttttctgcatcatgcacgatcagctgcattgttcattcataaagtgagcattcatgacaaaattgtaacgagcaaccggcacatgaatccgtgttgttttattggtgtacagtcaaaagctcaaaactatatatgccataccaccttctatctagcagtggaactattgtctctatttttctaatgcatgacacacttgacttttttatttggattattctccttctctaaaaatatttgtacaaacgacaaacatactatacatgcttaaagtacttttgatgacaaatctagtgatgctcttttcagcttacttaactaagtaaatagaataaccatttcagtcaatgcttgaaaagaattttaattgcgcatcatatattaaaaaacagtgatagtacaaatattccagagacgtgcaaaacccactaatactggccaccaacactacttgataccagcctcctcctcaattttactcaatggtgtcctaggaaaaaaaattcaattgcctcagaggtgtaaagcagggagaccctatctctccccttctgcttgtccttactgccgatcttcttcaatctataatcaacaaagctctcaacctgggagtcctctcccttcctattcctcaaattgacataaaattccctataatccaatacgctgatgacacgcttatcattatgaaggcatgtcaaagagaagttttctgtcttaaaggcatcctgcaatcttatgccatatccactggattaaaaatcaacttccacaaatcttctatgatcccagtcattgttaatcaggataaaattgaactcctggcaaggacttttggatgtacaattggagcacttccgtttacatacttaggtcttccggttggaacaacaataccaaaaatctgtgaatttgcacctctcattgatagagtggaaagaagactcccggctataacgatgtttttgaatcagggacagagactaaccatggtcaactcagtcctgtcatccctgccaacattttacatgtgcactcttaaaatccctaaaaaggttctgctgcacatcgacagagcaagaaggcattgtctttggagaaagtctcatgaaattgatgcaagaactcactcactggcagcatgggacaaggtctgcagaccaaaaaaaagaggggggggtgggtgtcatcaatttagaatttcaaaactgtaccctcttgatgaagcatctcgacaaattctttaacaagaaaaatctccgatgggtaaaacttctctggacttcattctataccaatagatctatgccaccgcatgcattacaagactttggatccttttggtggaaagatatcactcgactaatacctctctttagaggtatcagctctattcaagtcaactctggagacacagttctcttctggaaagatctctggtcagataaattatttcaaaactccttgcccgctgtattctcttttgctattaatgaagatctatctgtcagagcttttcttcaaaataatttggctcaaaacttcctcctgcctctatctcctcaagctattcttcaattcaatgaattatcagacctcctggagaatattcttctcattgatcaaaatgatatttggacttactcatggggaccaatctacaagacaagaaaaatgtatgacctcttctttgctcacattacccctcaccctgttttgacatctatttggaaaagcaaatgcagcatgaaagggaaggcattcttctggctccttcttatggatcgattaaacacacgagacatgctacaaagaagacacctttctattcaggatggaccttcttgccgaatctgcaacttagatattttggaggatatgtctcatcttttcttcacatgcccatttgctcaaaactgttggaattcccttgcaatctattgggatgtgaatcttgatctttttgacatgatccaatctgcgtttggaaattttggtcaaagcttcttcatggaagtggtggggactgcatgctggcaaatttggttgaaaagaaatgccctcatttttgacaatgtccaaccatcacttactatttggaaagctgatttcaaggaggatttcactcttcttttgcatagagtgaaggaggaggacagacctagatatcaatcatggattgacaacattttttaatctttccccctttgtaaatattttttgtaattttgttgtaactcctatttatatttaatataattaccacagtaggagcctctcctactgtttacagtcaaaaaaaaaagtacaacatgtctacccttttagttgacatcgacgtgcgaattcaggtagtggcggagggtggccatatatgtcttgggctgtcggttcctctctgttgtttatatcattccttacctccccaatggctttctgcagcctgtttctctattgacataacttatttgttacaaacatagcaaatatgagttggctttaactgttgtacttagctagtgctggctgtggaagcattgtgttgtttgcctaggatcggaatgggcatcattagagagaagacaagcatactgttctttgtcatgaccatttcgatacatcggctcgatcgtggatagtgcctgtgttgatctcacacacaatgcttcagaacaagtctcgttgaacttttgtcatgatttgagaataacatagatacagatgtcctaattggcgaaaaaaaaaactcgaagtggcatttgatttgtgcacatacctacgtgaagctatattgtgtcgaaaaaaagctacattaagctatacccactaaacaaataacaatatgacaaacaagtgctagcttaacaacgtgaatgcataagccctagtacatatagcctcctccccccttagatcatcagcaatacgtgaacaaaaagagttggatcttacaggatctcagccagagaagcaataaccagccatgatcttttgtctcaaccaatcggcacgtgataggaaaaacttcgataggagatgagagcaccatcggccacggcattgtggaagagaaaaaaaaaaggacatatgtcacacaaatgtctagacaagtaaaaaaagaacccaattaaataataaggacatatattgttccaacgaagaatatcttgataattaaaatatacatatccagaaattggaatggattaaaaaaaaccatatatgcacagcatccctcatttggatgggtctaaaacatagcatatacacatgtgtataggcctatagggcaggcattgaaaaaaattccaataaatatggattgacatgtatggccttgtttggatccttcgggctattaaatagccctatggaattttgctatttagaattattaaacgtagattaccgacaaaaccgattccataacccataggctattttgcgagacgaatctaatgatgtatattaatccataattagcagctgattactgtagcatcactgtagcaaatcatggattatatacctcgttagattcgtctcgcaaaataggctaggggttatggaatgggttttgtcagtaatctacgtttaatactcttaaatagcaaatagccctccggatccaaacagggctatatatatgagccggagaaagcgtatcacattttcattctacaactcatgcaccacatgaacaaggctaactaatggtccttggctccttgccacaacctgtagagaagctagcccacctctaccggcctagcagatcaaaagcctgttaaacagccgaagcccctgttgaaaatatggtcatattcagcatattttaatctaaaatataaagacaatgaacatgacatttttaggaaatgatttgcaagtgttaaacagtagcaacatcatgaacatgcttaatatacagtaagcataggaatagatatggcaatgcaatgctaacattgcaactaacagtaccagtaaacactaaaataagacataaagagaagatgtgaggagattatactccaagaatgaccctccgctggagtttggggcagtattgcctccattggtgttgacgttcccgttcacctccttgtctccaatgttgctgttgtctttggtattgcccgacatgttggagagacgatgcagaggaagccagagcagttgcgtcgagacgctcccaaaaaaccttatcgcctgcctacccgtgcaggcactgaagcggacgggttccggaggctctactcgtcccgtacacctatgcgcacaggtgaacagaaccggggaaggatcttgcagcacaagaggaagaaccgaagcaagagtcaggaagaactgaagaacatctgtacttctgttcattcccattggcggagtatatgtgcacgcgggagtaacgttcgggatcatcaaccgcgcgtgtttaattcagtaaccgacatgctctttaatacagaatcgatttccataaccgacatgctcgttaatacagaatcaatcaccatgtgttattaccgtatgttacaaaaagagagagagagagagccgcccacccgcccctagtccggcacgcgcgcgtgcggctgtctgcccacaatatcaaccggtgagactctccactagctccatgtttaagttgagacctcttcacttagatttctaaggtggtactattacccatagcactaaatgtaggccattggaatatattgggacttaattgggcctagcccattaatctaacagcccctagcaaggcaaagctaaaattaaatcgtcgtcatcatgatttgacagataatgtttaagaacaagtctggtcaaactttaagaaaagagtaattttatggttcttgaggaggtaccatgaggtatcactttttctattgttaatttgatacctttaggtatctaggtaccatgaggtatcaaattttacactaaacttttgtacctcatgctatctactcaagaaccgtagaattgctcgctatatgtaaataacagaggagaatggctatatataaatgaacaaatagtaacttattgtcaggagtacttgtcactttcctagcccttctctgtcatttatatatagcacaatgcattcatcttttgtcattgtaatcacatttatagagttcaaagggatagaactgagtaccaaaaaagccgatcacaaacacttgattttctcatgcctgacaagaatatgtagctactccgccgatctacactgtttttttgcattgcgaatttcataggtggaaatgggtggcgtccgagaaagaacatacaaagtttgaacaattcatgttgcgcgtggcgtcgttcgagcagaagggagaggcctgctagcgatgccgatcagacatgagctggagattttctttacgcatcatgacgctgcgtacagagatcgggtaaatcaccctgtacccccgtctgatcaccatcgcactactactcgtaggtttagtataactccaacttctaaatttaactttaggagcttcaatttctaaatttaactccaagagttagttctagagtggtgttatgaagcagtctaaacccagctctatctttctagtttattttgtgagaacgtttcacatagctccactatcattcattttaggtagaactgaaagttaactgagtctaaataaagtttccattatcttaaaaaaaaggtagaactgaaactatttggccgggctccaactctaaaatagataaagtttaaactgaagccatgccaaacagaccctacatatgtttacattggaatatcaccaagatctgtagcagccaagaacctgtagctaataaacaccaggcgatcagcgagcgtcctaaccatatgtcccattggttcatgacacggcatctgccaagaaattccagcacagctagcgaattactaactccaaatctcttagttcggtcaaaaagctctagcggcaagcaaacaaatatggcggtcctgtcgcactgaaaaaaaattgagaattaaatttattcagcagcacacagaccaggatttaattcaatagcaacaacataaaatgcaggaacagaggaaacgaaccaaccaccagccactctcttgtgtctgaaccgcttgcaggaaccaggttgagcacctcgtgtgcacactgtagcaagtacggcaaaaacaaagcagagtgcaaacagagagatgaggagcagagttcggggcaattttcgttggttttctcttctccgaaagtaaattgcgtgattacaactaatgcatgagctaaactatttatggaccatatgccatcgtcgatcccacgttcaccacgcaaccaactcacgccacatagatcaggtgcacacacacgcagctggtcgacacggtcaccttgcgatcatgaaactttggcttcaataacacattagtttttctccatacttgtctggtttgatggccgtaaaggatgctaatgccttcttacctgagaatcgaaatttgctttcatacggtacgatcttgattcagcaaaatgtcataaaatgccttggctcaattgaccttctgtgtttccatatgttcagaaacttgacaaattcagggtgttattatctttctataataaaatgtaacgtaccacttggttcttcgctatttctcagactcaacaagcacaagcagtttcaggtaaagcttgattcttctcgtaagtgcttcagaacaggtttgccgttcaccatgttgtttgagatgtttgcttgtcaggtatatatagacgtatagtaaaccatgctttggcctgatcctttttcttcgtgaaaatcccactaaggatttcagcctgtgatgcaaaactctgatccaaagtctttgaattgcgtttaatgtatagatgattattatgaatagtagaataggtgctccttgtgcgcttgtgcccccaaatgcttctcggtcatgtttttacctgcatgcacatttttccttcattagcattaaatttctgggttaattaggttcgtgtcattacaaattttctgatatgagaaaataccactactttcgtgaaacctgtcgtgtgccattgaaattttttaaaattcgaaatataccatcaccattccttttttgggaaattttgctacagaacacttgttatatgtgattttagccctaggacactatccaaactcacttttgggggaaaacactccataaatatggtaatttgccagtggacaccgcgctgattaaaataatacttttcggttgggagagggagaaatcgcgtgaaaggtcaaaaatgcccttgggcccacatatcagctctatctcccatctctcttctcatctctcagaggcgcgctcgcacagggcagcgtcggtcgcggcggagatggcgaggacggcgaccggcggagtggagcggggcggcggcggcggtggacgacgagcacgcggccggcagagcggcagcgtcggccgagcggactggcggcggcggcgagcgagcgcgcggtaggagccacagcggagggcggctggcgagagcggtggaccccatggcgacggcgatggcgatgcaagctcccacctcgctcgccagatggtgttcaccgagaagcctcgcggccgtggctccgtcctccccctcctctgtggccacccctccacccacatccgcctcgccgtcggctgccgaccgccaactgccctccgcgcgcagcagccggcggcggcatccgcccacgccgcgcaccccgtctcccttgccgtggcatccgccctcgccgcgcaccccgccatcctcaccaccgccaacccgctcaataccaccaccgagatcgccaagcaggtcgccgacgcccgtcccatcctcgcctgtcgcgcgctcactgtcgctgccactccgctaggccaacgctgccactccgccagccacacgctcgtccgccgccgccggccgccgtcctcgccatctccgcgcgcgaccgacgctgccctgtgcgagcgcgcctctgagagatgaaaaaagagatgggagatagagctgacatgtgggcccaacggtatttttggcatttcacgcgatttctctctccttcccaaccggaaagtattattttaatcagcgtggtgtccactggcaaattaccatgtttatggagtgctttcccccaaaaataagtttggatagtgtcctaaggctaaaaccacacataacaagtgtcatctagcaaaattcccctttttctatcagctccttccatcgtcgggcccacttgtcagggtgtcttgagtctccagctgagctgctgcctcctctctccccagtaaaaacctagctagcctagcgcctcctccagttcacctccctcaaccatccttcccaacgaggccttttacaataccttccactaggagatggtagtagtgtagtaggaataaatccaattgattaaggggaattactcctctcaactccctctgcaatgcccccacaaatcccctttcattagggtcccgaatcgtttgccaatgatagtgccttaacccgtcatcttcatggccaaccattgagttttttttggcgcagccactagttcgggcgcacttcgttgctgttcgtttccaggctcttctcctcactctgctgcatcctggaagacatgggaaactgtggtccggtgttggaattgacctggtatatgatggatttcttttagtccatgttcttggatttcttttcatggattttttttacccatgtgtgtttggatttgatcgatgctatggttgaggctttgagcaatccacgaggagaaatcggaatccatcgagatgacgctttagtgaattcaggagcaaaaactggagtagcaattcatgagtagaaactacatagttggtgctttcgctttgcccaggcacgggagatggctttggcagagacgttgctgctggttcgccgaggcatcgcggagtcagtcccttcacacgagcataccgcggctcgaggtggcggctgaagattgaagacacctgacgagtgcatggatccatcgaagacggaagaggatgctaacagaaaagatgacggagatggcatggttcgaattttaaaaaatatatatatagtgacacataacagatttcacaaataatactggtacttttttaaaacggcaaatttctaatggcattgatccaattaacccttaatttttcgttgtagtttaccgcatgggtcttggacacgattcttattttttgttatattaaatgttcatttttccttcatttcaggaataatagtcaaggtgttccaatttgggaaaaacagagcagcagcataatcaattttgaagataaaaaatggaatatgtacattatcttgacttccacacaaatttatataaaatggaacttcacaacgagggtttcatgtgcatggttacaactttagtaatattatctaatgctgtagtttactgtgcatgtcaatctactgtaaaatgaatcctgattcagtctgtgtggattatgctaagcatatgtcatcctatagtgacgcataggtgaataatagtgaagattattaacctagaaccatgaaggatgttaagcatttggtatcaagtttcgttcagttgctggaaatcaagtttctaagcaataggtgatgaatgtttcattataaatttcacacacctggaattgtatatagaaattttatgaatatatagtcaggttatataagtgtcatgtcatgtaatagagagatgaataatgatttccattgcttgttgatactacactttgcagaagtaagaacaatgttgttaaagttagaatgttgctattagatgatattatagttttctgaagttcaaaatcaactaaaacctgaacggttttcttatacaattgactttctttaatatgatctgttgccaggaagtggtatttaatgtttgtgttgtggtcaagcaaggataaaatatgtagcttcaaacggtaatatttagcttctagcattggaaaggccagctgattaaagggttaggttgaattaaaaaaaaattcctttctcccccctacgttcactatttatcctttactcccaagagctttggttatattacctccatccaaaaaaaaacaacctaggaggagatgtgacctctcctagtacaacgaatctagacaaaatgttgtgggacggaaggagtatatgcttgcagggccatctatattgtcattccacagtaaacagcaatatcgttaatgatttggaaacaattgcaaaccttgtgtcgttaatgtgtttcttttcttcttaaatgggaaatgatatgctaattgtccaagagtttaattaaaccatgtgtaattcttgttatggggaatatattgtcaagatattaattagtagtcaacctatgcattgtactgctatttttattgattatttgatgaaggccaagattagattaaaagaacgttcttttccataaaccttgcaacttttttaatgctatatatgttcccttgtcaaaacatatatttttcagatgtcttttagtcatttcatttacaacatcaattattgtcgtagcattagcacggacatattactagtcaaaatagtatatacttcattaattgaggattgtagtatatattgaccaaacaaaaaagatttagtacaaagtacaaactcttttaacgagaaaacattttggttaaaatgtcaaaatagcactaaatttttgtactagtacgtctgtaaaaagaaggacatttaaaatttccatgcagacatgcaagaatcaattatagaataaatatttttttggccaattttcaattgaatagttgtcatattataactagttgataaatcttagaggggtaaatgtgttttttttaagagtaaatgtgtttttttaactatggatgtataacgtcaacgcacggtataagtcgatggcatataagaaaaagagctaatttcatagcatgaaagagctaatttcaagtggaatataaggccaccgataaattttcagtggcatataagaaattccctcgtatattaatttcatcactctaatggaattatccatgtgcctgactacccacagggagaattctactagcctttagttcagttcatggtaattgccatggaattattcatgtcaagtgcaatttatccgataattaattgtatgtaaattgatcacgtaacacagttagtaataataaaaaccaagcatcatatacagaactaataattagggttttacctcgaattgcacgcaatgatagtccgactgaagaccatgcattcctccatcccatgtccatttatcgtgtcgactacaggaataattccatcaacatatgcagataaacattgagcggaagatgtaacagccaaaatggacaaacgagatagaggcatagagctctgcaccaatccagcaacctagcttaaaactcgagacaattttgagatcgaattggcaattatatatctaactataactctaactttaatccctatcacatcagatgttttggacattaattttgagtattaaacataaactacttacaaaaattaattatataaataaatgctaattcacgtgataaattttaatttttaagcctaattaatccataattagcacatgtttagcatcacataggctaatcatggattaattaggctcaataaattagtctcgcaaataagtccagaattatgaaatggattttgtcaataatttacgtttaatacttctaattaatgttcaaacatccgatataacagggactaaaaaatttagtcccaaccaaacagtcccataatgaattaagtagggaattactacaacatatttagtttttcctagcacccccactactacatgatagttttacctggacgccaccccttttgtttccatgcggcccataactagaaccgcacgaaaaattgggggggggggaccggcgctggactgtcgcccgcacgggaaaatgcattttcccatgcgggcgtcttaacccgaccgcacaggataatctttattatcccgtgtggtcgacttaagagggctgtacggaaaaaatcgattttcatgtgcagactttttaagtggaccgtaaaaaaaatatctctcttttccctctcacccacttcaaattttccacactctctctctctcttcctttttcgtttttattctctctccccctttactctcctcgatctcctcccatcccctctctcggcctctttttctcctccccacccctctctctctactctctctctctgcgcgctaccgtgtcatgacgactacttcacctgatccacccaaaggcacggatgatcaaggcgacgaaccaatctcacacaatgggcagagaaggaagtctgcgcgggagagacagcctaatagattgtataactcgagtgtgtggacccagtgatgttgggctgggccacggggagtgagagaggcccattagcgcagtgctataagaggccggcagggaacagattgaagcgaacattgtagaaacacttttctgaaactacttcaaatctctccctgttcttgctattcttccccaaattcctcttcctctgctgctctcgttctcatctcaatcccaaaattcctcctcgctaaaccctaattcttagaagtcgtgacaatttggtatcagagccgctaccctggagaagccacgctacacatctcgattgcaactccaagtcgaagctatggagaagcagaacgtggatttcggcaaggtgctcttggagatccaggagtcgttggtggcgctgaatcatgcacaagccgagactcaagcggcggtcgtcaagttggaacaaggagccagcagttggaaacctcaagtggaagccgcggttcaagagctgcgtggggaggtcgaagagatcaagcagcaattggatctcattggcaaatcacagcaagcttccgcatcggcgtcttccccttgggttccgtcgacagacggggaaaggaaggcgccactgctgcccacgccaccgccaaattctcttatggcctcggtggagggcggaagcaaatcggctcaaagccatcatcagcttcagaatcaccggggaaagacttcaggaggaaacatgaccctaggtccaaccccggtcaagggtacgtatgactcacactccttccagtttccaaaatttgagagttcgggggttgaaggtggagaaattgacttcgaatttggggagagacaatataatcaccgtgttccaaagttggatttccctaaattcgatgggttagatccccaggactggcgcatgaagtgtgagcattatttcgatgtgaataacacgtttcctggtttgtgggtgagggtagcaaccatctactttgtgggaagggctgcatcttggttaagatcttctagagctcatttgcgttttcctatatggggggatttttgtgctgctgtgtcggaaaaatttgatcgcgaccagcatgaaaatttgattaggcaaatggatagtattaagcagtcgggaacggtttgggagttttatgagagatttgctgagctaatgaatcaactattagtttatgaccctggggtgagtgcaaaatatttgactcatcgattcattgaagggctgcgaagagagattcgtaatcctgtacttttacagagaccaaagaccctcgaaactgctctgtctgttgctttgttacgggaagaggtgttggagaatcctcaagtttccagtgttaaggaagtcaagagaatggaaggcaactctggttttcgatcggcaggcaagggaccgtggccgttgccgcaaccaccagggaagagtggaagtttctctttgatgaatcgtcctaaagagaagagaagcactgatactgttcgcagtccaacaaattcgacagataaagtgactactctcaaggcttatcgccgagcccagggattgtgttatatttgtgcagagaaatggtcccctactcataagtgttcagcctcagttcaactcaatgtggttcaggagctgttcagtctctttatggaggagggagctcaggaaagtcgggaaacctcaattatatcagatgctgaaacgggtgaactaatggcaatttcagtgcaggcagtacaaggttctgagccagatggaactatgcgcattttaggacaagttcaaggaaaacaagtgttaattctagtggattcaggcagctcagtgagttttatcagttcacagatagcagctggtctaaaagggatacaatctcttcctcgacaattgtcagtcagagttgctaatggtggtacactctgttgtgatgctatgattcctcagtgtgaatggcaagtgcagggtcacagatttagaaccactttgagaattttgcctcttaacagctatgacatgattttgggaatggatttgctgaaggagcacagtccaatgttagttaattggtctcagaaaactatcagaattaatttgctgggagcaatggtgactctaacaggggttcagtctgaactgtctaggtgtgaattgttatcagctaaggagatgcagcaattgcaacagaaacaggcagtagcccatatggttcagctttgttctctctctcaagatgaggaatctgaagaaataccaaatgaaattcagttattacttcaggagtatgcaactgtttttgctgaaccaaaggggttgcctcccacaagacaattcgatcacacaattcctctaatacagngggcacaaccggtgaatgtcagaccctatcgttatacacccgcccaaaaagatgagatcgaagctcaagtgactgaaatgttacagaatggcatcatacaacacagttctagtccttttgcatctcctgtactgttggttaagaagaaagatggatcatggcgattctgtgttgattatcgccatctcaacgcgattacagttaagaataagtatcccttgccaattattgacgagttacttgacgaattgtcaggtgctcagtggtttacaaagttggatttgcgagcgggatatcatcagattcgaatgaagactgaagatgaacacaaaacagcatttcgcactcataatggtcattttgagtttagggtacttccatttggcttgactagtgcaccagccacttttcaagggatcatgaacaatattctatcctcattacttcgacgctgtgtgcttgtgttcgttgacgacatcttaatctacagtcgcactcttgctgaccatatcaaccatttaagggctgttttccaaattttggttaaacatggtctgaaagttaaacagagcaaatgctcttttgctcaacagaaactgtcttatttgggtcacagaatcagtccaaatggggttgctactgaagaagataaaataaaggctgttaaagattggcccactcctaagtcactaaaggacttgagaagcttccttgggttagcaggttattaccgaaagtttgtgcaaaattttggtattttcagtaaaccattgacaaatctgttgcgcaagggtcagcctttcatttggaatactgtgacagatgcagcttttcaaaccctcaagcaagcactgatgtcagctcctgttcttgcaatgccggatttctccttaccatttgtggttgaaaccgatgcatcagataaagggattggcgctgtgttgatgcagaatgatcaccctatagccttcctcagtaaagctttgggacctcggcattggggtctttctacctatgacaaggagagtttggctatcatgatggcagtggatcactggagatcatatttacaacatgatgaattctttatcaggacagatcatcgcagtctctcatttttggctgaacaacggctgaccacgccttggcagcataaggctcttacaaaattgttgggacttcagtacaagatcatttataaaaagggtgctgataacaatgctgctgatgctttgtctcgctgtcctgtacctgaatctgttgctctatcagctctttctgtttgtgttcccgaatggacacaagaagtaattgaaggttatcatcaggatcctgattctgccagtaaagttcaaacgctgtgcatcaatagttctgccattcctgacttcacacttaaaaatggtctgctatacttcaagggcagaatgtggataggacataatgtgcctgtgcaacaaaagattttagccaatttgcatacagctgctattggtggacattccggaattacagtgacttatcaccgaatcagacaactttttgcttggacaggtcttcgtgcagatgttgcaaaatttgttcaacagtgtgatatctgtcagaaggctaaggtggaacatgtcaagtatccaggtgcattacaaccgttgccggttccggaacagtcttggcaaattgtttctttggacttcattgagggtctgcctcgctcatccactttcaattgcattttagtggtggtggataagttttccaaatatgcgcattttgtggcattggctcatcctttcacagccttggacattgctgaggcatacatgcagcacattcatcgcttacatggattaccagaggctcttatttcagatcgtgatagaatttttactagcactctttggacgacactattcaaattggctggcactcaattgcgaatgagttcttcttatcaccctcaatccgatgggcaaacagagcgagttaatcagtgtcttgaaacctttttacgttgttttgtgcactcctgtccctctcaatggagcaaatggcttgccttggctgagtattggtataatacttcatttcattcttctttgggagccacaccatttgaggtattgtatgggcacaaacctcgttattttggtctgacagctgcagctgcttgtacagcaccagagttggttgattggctgcatgaaagggataagatgcaaactctcattcgagaacatgtgctgcgagctcaaatgagaatgaaacatcaggctgatttaaagagatcggagcgctccttctctgttggcgattgggtctatatgaagcttcaaccgtttgtgcaacagtcggtcatcactcgcactaatcgcaaactttcttttcgtttttatgggccctttcaggttttggccaaggtgggaactgtggcttaccgtctggcactgccagattccagtttaattcatccggtggttcacgtctcccaactcaagaaggctttggctcccgtagaacgggtacagtctcatttacccgttttgcctgctgatgaagctgcagacatttcgccttgtcaggtgttgaatcacaggcttgttcgcaaaggagctaaactggtgaaacaagttcaggtctgttggtcccgccaagatcccgccgccgtcacctgggagaatcttcaggaactacgtcaacgctttccacaggccgaagcttggggacaagcttcatttcaagggggggagaatgtcatgacgactacttcatctgatccacccaaaggcacggatgatcaaggcgacgaaccaatctcacacaatgggtagagaaggaagtctgcgcgggagagacagcctaatagattgtataactcgagtgtgtggacccagtgatgttgggctgggccacggggagtgagagaggcccattagcgcagtgctataagaggccggcagggaacagattgaagcgaacattgtagaaacacttttctgaaactacttcaaatctctccctgttcttgctattcttccccaaattcctcttcctctgctgctctcgttctcatctcaatcccaaaattcctcctcgctaaaccctaattcttagaagtcgtgacataccggctccgagatcggctccgcgtgcacacgtggcgggcgcagacggcggcggggccagcagctcagcggttggcgcatgtgacaacgatgacgatgaggcggcgccgccggctccgcgtgcacgcgcggcgggcgcggacggcggtggggccccgcacggctctcggcggcgggcgcgacgacgatgacgacgacgaagcggcaccaccgactccgcatgcatgctctggatctcaagcatctcctactctctttcttctctatggctgctacgatagcaaagtggtgtggttgtgatgttgaactacaggcttccagtctcttgacaattgctctcaagcttgagttgaatccccagccaaaccgctagtggtggctgctattgctaatgttctggtagttgagactgctgtgctactaagagcatccacagtagtaaagtaaggtgttctctataaaacatgtatatctcagcaataaacttgattaataataaaccaccttaatagattgtctacattgatatctatagctctctcatgcattgcctcgtttttctctataaactatctctaaattaatagatagctttgctctctctcttcatttaatatcttaaaagtagaaaaatatgctgacatggatctcttgtagagagcctatagataaccattgtgggtcccctaatttctccatgccgatataaacggtgcttgagttcttgctctcttcttgctttgatctcactcggctgtttttcctagagagggtttctctggctgtaactagtactactgcaggctgcttgtttttggtttctactaccaaaatgacttggtcacgcggacggcggcgggcgccacgacgacgacgacgacgacgaggcggcgcggccggctccgcatgcacgtgcgccagcaggccgtggctggtcgcggcggtggcacccgggtgcgtgcggcgcccgcggtgattttcgcttttttttaattatttttggttatttttgttccgtgcgggtggtataatttcaccttacgggataatcgattatcccgtgcggtccacttaatccgaccgcatagaaaaatgattatctcgtgtggttgggtcgcaatatttccagacgttttggtgtagacggacaaatcctccacacgaaaaaatcattttaatcgcacggaaaaatgcttttcgtagtagtgtcgtgttactacacagattagcagaaagtagggtaacgttcccggatgaaattaatctttaggtgacaacatcaaatcgatcactcctaaattgaaccaaattaatatgtagtatgtgtagttcatgatagtgaccttttagtttcccccactgctggaaaaagcatttttataggcggccaaaagcaatttttgcaggcggaggggaggactgcctgcaaacagacaacggtgaaaatcatccattttcgcaagcggacaaatggcccgtctacgaaaatccaataaaaaacaaaaaaaatcgcctcgccaccgctgtagcattaggagccgccgccgctgccctcccccggcctccctccggccagatctgggaggggaggccggggagccgccgccggaggggagcagcccacgtcgccgccgctgccctcccccggcctccctccggccggatctgggaggggaggccagggagccgccgccgtcgcactaggtcgccgccgcgtctgcgcgccgccgcgtccgtgctcgccgccgccgccctcccccggcctccctctggccggatctgggagggaaggctggggaaccacgtcgccgcagccgccgccgccctcccccggcctccctccggccggatctgggagaggaggccggggagccgccgccgctgcaccgggtcgccgacgcgtccgcgtgtgcctccgctgcgcgtccgcgcaccgctgccgcgcactccgccgccggtggtgggagggaggggaggggaggggatggggagctataagaagccggtggtgaagggagagagagagttgagaagatagaaatgagtagtggggaggggggtggagtagtagataaggatcaaagtttttttttttggtaggtacaatttttgcaggaggaccatataaggtgcgcctgtgaaaatctattttcgcaggtgcctcttaggtggtccgcctgcgaaaatagattttcacaggtagacagcgaacttcaccccgatttatatttttgtaagcggtcatttgactcctaggcttatgtccgcatgtggaaaaagactcctacgtttgaaaaaaagctttttctagtagtaccctttgccagggtatctttagctacaagtcattctttcaggtgatcaggtctacatgtatatatatagtacatgaaagaatcagagttctcaaaaatacaaacaaccgcaaatcctaattggtgtgtacgccctcggcgtgcacgcgccggcccacatgtaccggcccacacgtcccatcctcagccattctcagcgtatgcgctggcgagacgcgcgtttatttttttcggaattttttctctataaaactgattcaaaactgattcggttaagataagatttgtcttttttccgaagattattttaagtaatagattgaaaagaaatctatacgtgaagtcaaattctgaaaactttcaatccagatttgaaaacattcaacctaaatttaaaaactttcaacctagatttgaaaactttttgaagttaaattttaaaaacttttaacttttcatcccaaatttaaaacttttcatcctagatttgaaaactttcaagccagatttgaaaacttttaactcaaatataaaaactttcaactcaaatttaaaaactttcaactcaaatttaaaaactttcaatacaaaatttaaaaactttcaagtcaattttgaaaacttttaactcaaaatttaaaactttcaactcatatttaaaactttcaatacaaaatttaaaaactttcaagtcaaaataaaaaacttttcaattatacatttgtaaagaggtgtgcaaaagattaaaaaaaatcggaaagaaacggaagaaaaaaacacgctcagagacaaaaaaaaaaaagaaggtgcgaacatgaaaaaaaaacgcacgccgttttttcacacggtactaaacgctagggttagtaggggaggccaaaacgcgcgcggcttcccgttctggctcatgggcccgcagtaggaacgcaaaaacgagcctgtacgtgttatgcaaccgtgattaggcttcataattcagcttttctaaatacaaaatttttaactcttatatctatgctactaaaattaagaagacggtccgacaccaccatatcacctatatgtccatgcatactttgcttacttgtttctttgtagtttttactctctagctaggtttcagatctttaattttgtaaatatgcctttttttctttctgttttttaatgaaagattttatttaaatcaattaaaaatacatttttcaacaagtacttaatttgtacactttcaataaccttcttgaaacgcccgagcatttagctagtgttcaatagtacagcaaagagcgagcatatatagtctaaaaccatgcattcctgttgaaatttattggatatatactagcatattgcccgtgcggtgcaacagaattgcaatttaagaaaattatctttaacatgttattaacatctctcatttgtcgtatatattttttaatctctttttagttctacactaatttttttcttcccacaaaaaataaagagttggtgagagtagttgatatgtgggccatctagcctcacatgccattttttcgttgggagttgcagtggaggcagtggcggaaccaccaccgatactaatcttttctgtacggagtatagatttctaaatatgcataccattattaaaaaaaagatttctaaatatgcattccagtatatatgaggtcttacatgtttcttttgcagctttaatttttacagtaagtgggtatataattacatagaattattatttcgatgggattatcaatgtacgtgctagatctatcttactataaagttataatgcacaaaacatcatcatacactatggcacatcatcatccactatcaattattacatttaaacatcatgcaagcatgctatattatctataattttataatttattaaattttagagttttaaaatgcaaccatattaaatcatcatcccacgtaattccattaaattctaaagttaacatgttaagatgtcacatcatcatgctgtaacaagatgccacatcatcatccactaacatttattacaattaaatatcgtgtaagtatgctatattatctataattttataatttattaaattttagagtttcaaaatgcaaacatattaaatcatcatccatattattcacatattttttaatatatctcttcattatttcttataatatcatatgtacgtatatagttcatccttacttagttagtgttatttctctctttttctcgttaagtcatatcatatcaatttttttaattttagataattaatctatggtccaaactatctccctcactttcttttttcataaagcgacatcaccttatttttacatacgaatcgtagttcaaatttaaattattataaaccacatcaacttatgtaagttgttgtctagctatgttacatattatttttacttgagtattgctatatgtatgacacagttgtccaactcaggtacaactagagacatgtaaccatagatcaatcaaaggagagcatattcatatgcactacagtagtttataatcgttgatcaaattcagtcgtacgtgagtcagacagttgggttgggttgtatgcatagcaatttccttttttacttatggttactatactaaacttccatagcaacgcgtggggtttcacctagttatatatatataattccattagtctacttcaattacatttgaattgtagttcaatcgacacaattgtttgtagaatgattaccgtaattagaattaaaaataaaagatcatgcgtcatagacataataattaaagttaggagggtaatatgggttttgtcgttaaagcgtaagcaataatattctgaccggacatgcataatttaaatttcatcctttgatgtaaggtccatttcaatccatctaagagcaggaacaaatctattaatccctccgtattttaatatatgacgccgttgacttttcgaccaatccgtattttaatgtatgacgctgttgacttttcgaccaatatttgaccatttatcttatcaaaatttttgttcaaatataaaattttttatgtcatgcttaaaaaacattttatgataaatcaagtcacaataaaataaataataattacataaactttttaataagacgaatgatcaaacgttggttgaaaagtcaatgacgttatacattaaaatacagagggagtaacatttagggaaaacttataaaacgtgatgtaagaaacaaaacaaataaaaatagaggtaagtgtgaccggctgcaccaataatccagacttctctaaaaattcaagttaattaactagctgttaggtttggcccattgttaagtgtcaaactatcaaactacttgacaagtgatcaatgcactgttttaactttagaaaatacagccaaatatctacagtggcatgtatatatcaaacaattaactgttagggttggcccattgttatgtatcgaactatccttaagcaactcatatcttgttttgttggatgcaagggagtaagtattgtcctcctatctaatacttgttcccttcttccaacaaaacaagtagataggagttaccaacaacaagcttctacggctagctagcaatgaaaagttcagaaagtttaaaaggaagatttgaaacttcaaattattatttttaatttcagccataatagatatacatatttgcaaaactacaaatatacatggtaccatgcatgattgtgctttcaatattttaatttttatcagggataaacgaaataatatttctcgaactaatatatgtaaaatatgtcttaactaggaacatgaaaacaattaacatgttgatttttcattcagttaacgtaaatgggaaacgaaatttcaaactgataatcgtaaatctgttagaagtggagtactattctgcaatgcaagcatatgtacggttatgcaaaaaaaaatttggtgatgcataatttggtggaaacacaggtttatttttgtgaattcgttttgtcttgagatagggcatcacgccattgacaccgctctcgatcagcatcactattactcctgtttctcaatgcatggggatccactcaacaaactccaacaccagaagcaaactaatcgtcatcaaatttttattatagtgtttctgggtacaattctatttcagtatttaatcgttcttccacttgcaattacaggtgtaatgaaatataaacccaattgatgtcacattagtttactctcttggagagaacatgcatgcatgcatgtatttttcctatggagtgcgtgcgcggtaatgtaaattgagaaacggcccttacttttctaataaaagaaaattagaatgtaaattctatcacggtccacacacatatgcatagaactgtcaaatgatgtacgcctaatttcgttcccatcttcttcctcttctctctctctctctctctcactcttttttttttgcgcgaaaccaccttcgttaatttgactgggtcacagcatcactctctaaactcatgttttttaccattcttaactcatggtttcgtacctttagtagttttaaattaaacatctgtaggtgcatacatatgtacatggttttcgtcatgatcgtgtgttttatgcgtaaactacaacgccgcgtaaccaaactttcttgtctgctgtcaaggaaatttaatagcattttcccttatcactaaaatagtactaaatttttatggcaatcaattatttaaaagtttcccccacccaaattcttctgctctgggcacgacaccagcgtcaacccaagccaccactggtttaagcaaaatactccaagtcccatttgaattttcttgcaggtattttattatttgagatattttgtaggctttcaataattttctataattccttgtagaaagtgacttttaatttgggataaatttatcatgggatgacattatccaagggccaaggaaacccgggaacaatattaatgtgtatgcaagggttgatgttgagcttgtgaagcccaaggcccaagcacatgaatgagcaattaactagatatcccaactaaggaatacatattatcatacatattatcacaactctgagacaggccatacatattatcatgtggcatggcgaaagacggaaagagctaatatcgttccaatgatgaggagttatatcttctttgatacatcttgggtacatatcactagaagagaaatcacctaaaccacggaagaagagtccgaccccaccgccccctccgtcgtttccaaccaacaaaaagagggagagtggcagtacttcgaccatgatcgaggaaattaacatcatcacaaaagcgtgatccactctttagggttcctaaggagatgagtaggaacataatgtcgctcctcatgctagaagagaagaaaaaggaagaaccggtggatcctttgggcggcggaaatttcttccatgccatggaaaagagatggcgctccggaacctcctaagtcagattttacatggattgtataggaaaacagcacctgcaaacgatggtccacttgataaaaatccaaaggccaacaacgaacctgtttataaatatcgattcaaatcttctttagtagtcaagccaacacagataagcggtctatagaacgagatgaggattgagcagatttgttttttctttttgacagtaaacaacaggagagactcctaatatgctatatcaggtataagtataacaggaatattacagggttacaaagaaaaagaaaaggaaaatgaatttacaacaagaggattgagcagattacatggtacatatcagacttagaaaaaccactgccgccaagcctccccaccgccggatccggcactgtcaagactccccaccaccggatccaccaccgccaaggctccctaccgctggatccgccgccgccaagcctccccaccgtcgccgccgcaattcccgcccaccatcgccagatccgcctcccctaccaccgccgctgccgaatctgcccctctcgaggccagtctgctgcggatctgcgagggaggcgtagaggcccctccaccgtcgccatggttgacctcatccgtcgccaccatcgcaccactagccaccaccgccgccaagagagagaggagaggagtgggagatcgaaggagatgagtagggcagagaagtggaggagaggagaggagcggggctgtgggggacccgacaggtattttttttaaggtggagggaggccggctggacttttcgtaggcaagcctcttaacaggtccgcatgtgaaaataaccctattttcgcatatagacatgttaagaggcccgcctataaaattattttttatatacaggtctcttaaggagcggtatgtaaaaatgttggtcaattttgctgacgcgacaagttactgtccatctgcaaacaaaaggcggtctcatccagaaaaatcgtttttaagtagtgaaagatgctaatattgttcaaacatattatgaattctgttcgaattacattgcactcaagatactaattaattaaggcactattactcaattataataccttatccttgattttcaccttgtacacacataggtgaacaaacaaaagctgtttttatatatatatatatatatagccatgccttttctgtcagtctttgctactgatttaattgcagtgatgaaaagtgacattgctgtggagagagggttgaaggtagcattgagcaaaccctaccctaagtaattattgctttgacgagaagaaatttcagctagttgctgtaaccgcgatatttgcataaaacatgaaaaataaaaagaagctaaaaaaatggaaaatcacttaaatatgtgtagaaattggggaagaatatataggacacttgcaaacctagcttgttgatgtaaaatacaaaaatgaagctcaatacattttttctatttcccaaacaattatcggttttgccctcaaatttaatttttttccttactctttttaaaaaaatttcttcaccatctaccattaaaaaacaagaactacatccataattttttttattttttccataaattgaatttgctcaaaatttctcaaaccctaaccgccggtaaccgatccccttccccgcggtaagcacgataaccgtgattaccgcgcgataacgtgaaagcctggttacggtgcgtatacctatattgtatatagatcatgttaaagttacacacaaaaaaacaggtagcgatctcaaaaaaatatacccaaaattaactaccaaagtcattcttatacagtacacattattataatattttcaccaatttgtgtatggtgttgtagacatacttgaactatttaacatgccctatattggcatatacttttgaattttttttcttaagtatagaaaaagagagtagctatataacattgaagacttttttgagtcaaaaagttgcaaatataactatattacaattgtggagtgtaattatattataaccataataacttatatgtaactggaatataacaatcacaaatgtgtgctgacacatagtagttaagtgttcgtgatgcgaagtggaggtgctgagttcaagtcttgcacggtttttattacactgtttctatagagaatacctaacggtctagaaattgaaagttctacccaaaaaaaacttttgacagtaaactagcgattccgtagaaaaattctaatgagttttcgtgcatacacaaaaaacaaacaaatctctacccatactctgataccatacaatgaataattaacgcttattattgcatatattagtacgtattattacaaatagggaaacacacacaaaggaaatctctcacataatttatttagttccgaatgaacatgaattactaatttactgctcaggaagcacataagataatatcaattatgcagccttgtaagtatacaaaatccttggcctgttaggatgctgccttgctcgtgtttcccaactttcctttgtgtatctcgagacctcagagtccagagttacttctttaagttctcgaagatcttcgatttcaataccagccaaacctactaggtgtctgcagagcagctggagtgacaccaggtcccgcagtgctcctgcttcaatcctcgggaagacagagacttgcaccttgaagcacaggcgtcgcagactacggaacgccccttgtggtatcacaaattcgtcaaggcaatcgctgatcagtttgaggtataacagacactttaggttatacagatcagagagaacatcccgtgtcacggtaattgatgaaaggcacagctcaacgagacctgtatgccatttgacaaaacggggcaacgaacgaagctcgccatgtagtttcagcgaagtgagctcacagggagtatcgagagaattgaggaggctgccggagaatgtttgcaggcagattgatagtttacggttatcgccaatatacaagggaggattgatgtactcctggatggcctctgaaagcttacgagccaagatactatcatgatctcctgcagctgatgactagcaccatatcttaacctttttcaaattgctcatatggcccaatatctcaagaaatccttggctcttgaagtcggcgataaatcccgataaggtctccaatttactattttcagataactttttgagcgtactcttgctatagccatgatattgaatcctaaactttccaatcagatggagtaagaagggcaaactaataacttgcacaggtagctcctctacactcgtcttacttagacagagcgtttccaaaagtttcagttttgctatatctttaggaatacttgtaatttctgccccaaggctgagatacctcagattgaaagaccaagaacggctatagagggggggtgaatatagcaattcaaaactttcccccgaaaatactcatcaagctggatttctcaaaatccttactagaaccgcggctattagagaagccggatctagaaaagaagagagaaaaagaagagagaaggaattcccgaaactagaagaggaagagaaaaggaattcccgaaaactagaagagaggttaggaggagagagcaaaactcatcatcgcaaagttcaaatttcaagcggaatttaaattgcggaatttaaatggacaaggcaaaaacgaaatccttcaaatcatttcattcataggtgatgcaaaataaccgctcaactaggagcaaacaaacaccttcagaggaacaataacacaaacttaaaatctctcggacaaacacactccaaactaatcttaatacaaaagcctctcgggcaaacacactccaaactcacacggaaactctctcaccgagcatctcaaaaggattacaaaaggagcaacctccacccttgcatccatccctctatttatagcctaagacccctaagacattgtctcaaatacccgtggggcgaaaccctagccttgataaaatcctggatgtccattgttccttagatccgaaggaaacctcctggatagtcgccacgttgttgatccgagctcttcacgtcgcgtgccctcgtgcgatccgcgtgattccactccaagccaatcagtgtacaccgatccgcgtcgtgctcctccaagccaatgcatccgcgccacgcgtcccagagagcccgcgcccgctcctctcgcacctgcgcgccacaagtcagaagccgccatgtcgccgttcctcccgccgagccgcttctgcgcgcgctcgcgaaaaccacgttcccgcgcgtctccgcttccttgacgaacagaaggccgccacgcctccaggtgccgtacgatctcccgcctccgcgcgcgcatgcacacgcctgtgcatttgccgagccgagctgggccgtcgtcatgtctagggtctgctcggcctggccttcaccatcttgagtcagcaacgtgcttgggccgaccgagctcccgagctggacaggccggattggccttcatgccaaccgagccaatgatctccttgggccacgtggaacggctggattggcttggcctccctgccaaccaatcacagcacacatgcacagcttctgcaagctcctccttgcacaagtacattacgtgtacatgcaagtatgctacctacagtaagtccatttactgtagcagcaatgcacttgcacagtcccttctgatttcttcgcgaatccgatgcttgcacacttgaccttctgaagcccgttgcaaagacctcctcacacggtgttcgtccactgtgtgcaaccttgtgtccaatcttgtcacctggcatccttgatcactttggacctcaactcctccctgagtctagtcccgatccgccgttgaccaagatcgactccgatcacctgcacccacatgaaccaaacaaccgttgtcttggcacagatgtcgcaacctgaccaatgttagtccacgcacacacttcttgcacttccggtacttgtcaatttcccatcacaaaagaactataaccacacatggtttcacaatctctctcttgatgggaacattgacaatctcaagcaaaattttgaaaatttgatttttgattcacaaagcaaaccattttgcaaaagtcgaactttggtcattttgaattcttgaaaaatcaagaccaagtgacaagaagaaaagggatgcaaatgcaaatgcaagaatgctccccctatgtgccaaactccccctttcaccgagatctaaagcaagttttaattttcaataagtgcaaatttctctccccctttgtcaatgatgccatcaagatcaaaagagacaaaaatgcaagataaaaatgagatgaaacttgcaaattttagtgttttgagagctttgagagttatctaaaggcatcaaaaggtagacatggatcacacagatacaagcatgtgctcaagcctagctaagcatgtgcataagaagtatgaaacatgtcatggatatcaagttagtatccccagcaagcaaaaagctttcaagtgaattagtgatttagtgtgcaaagctatttctagaagaagcttaaaaggaagcaaaccagctcataatcatgcaagatttacataatcaaagcaatgaatccatgctaatgtgctaatgcccagttcataaagagtatcaacatgataacaaagcatagaacatgagattttaatcttttctcatgacttttatttttatgattttttttaatttctttaaagacaatagcacaatcacgacggtccacctgatcttatcagtcagcaagtgatggttgtgccaaacactgccgtctgacctcaatcaagttttccagctaaagttcccattacaggctgtctcagtgctatcttcggcactactcatgcgtaaacgcactcagtagcccggacaaaaacagagataaagcttgtaaagcatgattgatacaaagtatggacgcataagcatgagcattcataagcatgtactgacagttattgcaaaaagaatataaacatggcatgagtatgagatggatacttcaatttaaacaaacttctagagcaatcattgcacattgattaagttcaaatgaatagtcaatttaagcaggtttcaacaagcttgaacagcataacatgatcacataagctacttaagcaaatgaaagctagacaagagatcaaactagcataagagtgacacatgcatagcatagtgatgaccaagagataacaagcaaagctcaattgaagaatgtataatacaatgcataaactaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaactctagcacaatggtacctttctcaacattgtctcggagaaagtggtaccgtatctcaatgtgcttggtcctggagtgttgaactggattttttgcaatattgattgcacttatattatcacaaagcaaaggaacaccagagaaagacagaccataatcttttagagttgaaatcatccaaagaacttgactacatgtactagcagcagctacgtactcagcctcagctgttgattgagcaatagaagactgcttacgagaggaccaagagaccaaagaagtgccaagaaaatgacaagtgccagaagtacttttgcgatcaatcttacacccagcaaaattagcatctgaaaaagctcgaactgaaagggcagaagagcaggagtaccaaataccgtacttaagtgtagacttgatgtagcggaagatgcgcttgactgcttggcgatgtgatgttcttggagaagcctgaaaccttgcgcacaggcacacggagaagtggatgtccggccttgacgcagtcaagtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaagagctctttggagtacttggtctgatgtacaaagattccttccttggtttgcttgatttgaagtccaaggaagaaagtcagctctcccatcatgatcatttcgaattccctgctcatcacatcagaaaactgggcaacaagtgcatgagaagagccaccaaatatgatgtcatcaacatatatctggacaagaagaaaatcaatgccactatgaagagtaaagagagttttatcaactgcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataacaccattcagaaaagcatttttcacatccatttgaaaaagcttgaaaccttttgaagcagcaaaagccaaaagaattcgaatagcttctaatctagcaactggtgcaaaggtttcttcaaaatccaagccctcgacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaatgctgaattgacaagatcataagaccgatttctagttaccctttcacccaggcggatgtcggttctagatgtgtcggggagctgtcggtcctgatgtgccaccattaatctcctcagctgctgaagatgatgtagttggtgcatctcctgaaggcgatgtagttgaaggagaacctgtttcttgcactggtggtgtactgtctagaggtggaggaatggaatcatcgtcatcatcatctgaatccttatccacaaagatgctttcatctggaacacctgaaatttctggtctagctcctgggctagcctcatgaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagtagaaatagcttcagtccagaactttcttggagtcgtaaactcatcaagcatagttcgtgccatctccacaagggtgcggttcttcctctcaaccaccccattctgttgtgggacatatggtgaagaaaactgatgttcgactccagaagaatcacagaaagattcaaatgcagaatttttgaattcagagccattatcactgcgaatggctcgaagagcaccaggaaactgcaaagccaaactacgagcaagagactgaaagaagccacatgtttcctcctttgtttcaagaaaatagacccaagagtagcgagagaaatcatccactacaaccaagacataccacttccccccaactgactggacctgagcaggaccaaccgtatccatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactaatgcgagacaagtggtcaaagccaatatgaccaagacgtcgatgccagaaaaacaaatccctattctctgaggcaatgagacaacgagaaggaccaggagcagaagagtcgaagttagcaaagaaaactcgaccaactcgagaaatgtcaaaaacaggagattcagaagcatcaagaactcgagacctgtcctttttgaaacgaacttccagattttcatcacagagttgtaaaacagagagcaaaatgtacttaagcttacttacaagcgcgacatcctttagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtctacaagccaagaattacttctccccactccaaaatcctacaagaaagacacagcagatctcgatgattcagtactggggttagtgagaaatgacttagtaatccagtactgaaccatgcgaggagtacaagcatctttagtgttatgagcataattatatgcaagatgaccatgtctgttttgccccaaccctgctaggtcacatcgagggtgcacatctcggcgaggaaagcgagatacaccacttgaatgacaatgacacgcacactcgaacctctcagggactctagcagctcttctagtcctaagacgttcttgtcgcttttttctagcctttctaaagcagaaacctaccaaatgaccagctttcccacaataggtgcactcatacttggttttctctacaggcttggtttgtttctggttttgcttgtgctcaacttgttttggatttttgggtctaggtaactctacagacttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtacgagttctctctcttagcggactcaagatcaactttcagagaaatgcatgatgaacatgaatcaacagatttgacataatcaatgacaattttagtatcttttagttcagtttccaggataacacaattagcacatgaagaatgaacaggctccttagtagcataagattctagcaaatcattcttggtcctaagcatgtcaacttgttgtcttaattcatcattgtcactagtgagaatgggacaattttcacaactacttatcctatcatgaacaaaattttcttttagttctttcaattccatctcaagcaaactcatatcaactttcatttcatagcaagtagagcaagcagcactagcactagaaggattcccagctcctaaagcacatgatttcaacttatccttgaggagattaatttcagaaagatatgaagcacaagtagaacaggtatcctcctcaggaatcatggatcgaagcctagcaatttctagcgccattccatcattttcatattttagtttctcaattttatacttagaagacctatacttgtcactaatttcaatcatcaagtgtgtcattctttctttgcttagttcatcatcaacagagtcattatctgagcaagaatcatcacaaagagaaccatccaaggaagggatatcatcaagacatacctcatgatgctccgatgagtcatccttatcctcaagtgccatgagacacaggttgatgaagtcctcgttgttggcgagacagtacatcccggagaagtccttgtcccccttttcttgatcatcgtcgtcggagtcgatgtcgctaagctgcacctcctcaagagccgccaagaccttgtggatcgccttctttatcaaatccttcttcccctttcgcccttgtccctcgagcttcttggttgtcttgtcactcttcttcttcaacttgggacaattcactcttatgtggttaggctctccacactcaaaacacacaaatggttcattggtttttcctccttttctatctctcacatttttgtaagctcttgagaattttctagtaaaaagagcaagatcatcttcagggatcttctctaattgctcctcagtgactgagtgtaaagcggcaagagagaagccaccacacacaaaagctaagtcattagaagaagtactaccagagggatcagctaccaaagccatcgagtgtttgaggcctttccgatggaagacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaacaatttcttcaaaacgcttgaaataagaatcaatggactctcctgggtgcatctcaaatctttgatattctttatgaaattgattctgacgaaccaattgaatatcattgtttccctcatggaaattgcacagagcagtccacatgtcatgagcggactggtggtgttgaacacgattaaattcaccagaagaaattccaccaatgattgcatttcttgcacgataattaaaatcaacttgagccacatttgcaggcgtgatgtcagcatcatcgggcatagtgtaaggtgatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgatactaattgaaagaccaagaacggctatagagggggggtgaatatagcaattcaaatctttcccccgaaaatactcatcaagccggatttctcaaaatccttactagaaccgcggctattagagaagccggatctagaaaagaagagagaaaaagaagagagaaggaattcccgaaactagaagaggaagagaaaaggaattcccgaaaactagaagagaggttaggaggagagagcaaaactcatcatcgcaaagttcaaatttcaagcggaatttaaattgcggaatttaaatggacaaggcaaaaacgaaatccttcaaatcatttcattcataggtgatgcaaaataaccgctcaactaggagcaaacaaacaccttcagaggaacaataacacaaacttaaaat

SEQ ID NO: 51323 - DNA, 50181 bp, Oryza sativa
cttagatccgaaggaaacctcctgaatagtcgccacgttgttgatccgagctttcacgtcgcgtgccttcgtgcgatccgcgtgattccactccaagccaatcagtgtacaccgatccgcgtcgtgctcctccaagccaatgcatccgcgccacgcgtcccagagagcccgcgcccgctcctctcgcacctgcgcgccacaagtcagaagccgccatgtcgccgttcctcccgccgagccgcttctgcgcgcgctcgcgaaaaccacgttcccgcgcgcgccatgtgaaaaaccgcgggggacccggtcccacgagtctccgcttccttgacgaacagaaggccgccacgcctccaggtgccgtacgatctcccgcctccgcgcgcgcatgcacacgcctgtgcatttgccgagccgagctgggccgtcgtcatgtctagggtctgctcggcctggccttcaccatcttgagtcagcaacgtgcttgggccgaccgagctcccgagctggacaggccggattggacttgatgccaaccgacccaatgatctccttgggccacgtggaacggctggattggcttggcctccctgccaaccaatcacagcacacatgcacagcttctgcaagctcctccttgcacaagtacattacgtgtacatgcaagtatgctacctacagtaagtccatttactgtagcagcaatgcacttgcacagtcccttctgatttcttcgcgaatccgatgcttgcacacttgaccttctgaagcccgttgcaaagacctcctcacacggtattcgtccaccgtgtgcaaccttgtgtccaatcttgtcacctggcatccttgatcgctttggacctcaactcctccctgagtctagtcccgatccgccgttgaccaagatcgactccgatcacctgcacccacatgaaccaaacaaccgttgtcttggcacagatgtcgcaacctgaccaatgttagtccacgcacacacttcttgcacttccggtacttgtcaatttcccatcacaaaagaactataaccacacatggtttcacacagattccataacttgtgtatatttttcaggtgcttgttcttgacatcattgcattcttcgagatccaggactctcaaaaccttgtacctgtgaaactcgcaaatggtgtcacctgccgtcccgaagatcgtcaaagaccggacgcatgacaaatccatatctgttgtagttctgcgcttgtgaggtgtcctatgatcgatacagagatgacgaactttccttcgccagtcaggaaaggacatgatgaacctctcaagtctcgacgccttgtacaacatatactcgtgcacgatactgcgagtcttgcacatcttgacatcgccattattgcttgtgtcaatgataggatgaaagatgtcccagtctacaaacgtctcaaaattccaacgtgcaatagtctggtcatcaatgtccacatcttcgctccttgcgaatccttcagctatccaacgcctgattatcactttcttctcgagcggaacatcgtttggaaatatgctcaaatatagcaagcaggccctgacaacgtggtttgaaagacttgtgtaattatccatgatcacgcctttgagtctttcaaagttaccattgtcatgtatttttgaacctaggtagcgacacaattcgcgacagcgctgcccagtaggctcatttaaacctcccaaataattggccacacaaacaagggaaagtggatggccatcacatttcttaagtagttcttccgagcccatctgcaactcaggtgaaggtgcctccccaagagctattgtcttgcagtattgatcttcaagattttgcatttggtatatgaaacctttgccattgccacagcaggtattcgcttccgacttaatggttgtggtaactattatcctgcttccgttgtttctactattttcttcgaaagctgattttatagaattccattgcccattcccaatgtcatcaataacaatcaagtatctgacaaatttctgacaaatttcgggtaagagcaggtacaatagcaggctataagccaactgcaaatatattttaaggagataaacgaggagagagaagagcagtgggctacaaatttgtagccagctgtattacggactccaagacgcaatgtgtttatgataggtgggaccagttattgatagtgtagtatgtaactattatatgaatgagctattagattggctatagatgaattagagctagtagttgactatattattaaacttgctctaaccaacggccgggcgcaaggttcagcgaatgagtggttttacgatcctcaataaagtactcaatgtagtacgtaaagttccaatacattctgaatgaccgtaaaggtgtggatgggtaatgcgtgcaactgggaaacagctacagaaattctctcaccttctacccctgaggtagtccatgagctgggcttggagatattgctcgtcatcgaccaataatccctgaccccgatagccaaattgctggagtaatgatctgaaaatctcccccgcatttttctccttggctcgatcaacccatgcacggcaggaacgaaacacccggattctatcatcatcagttgagcggaacactgccttagcgagggtcgtcttgccggagccgccaaaacccacgatggcgataaccctcagctcctccggactttcctccagcatcgcgaggatgtcccccttggctccctcgacgcccacggggttgagttgaacatgttcgcgttgttgtgccgccgccggcgccagtggcggcggcggcgggggcttgtcgtagacgaactggcacaggcgttcattggtcagctcctcgaggcgcctgttaagcgccttgatcttgtccccgaaccggtagcgtgtgcagatggtgagcaggaagcgccccagccggcgcgcccgcgacgctccctcggcgcaggacacgcggtggaggaagcgctcaatgcagtcctccatgtcgtgcgtcagctcgcgcagctggtcgccgaacaccttggcggcggccgtggggttcttcgtccgccggaggtcgtcgtccatggaagctgcgagcagaactagtttacgtctcattgagtcgctatcatcgatcacgttcatgaccatcttacaactgcctgacagcaccttaaacagcggcggcatgacagtgttcacgaaggcagttatcaccgctttctccatggtctctgctgcctcaatcatcgatcgatacaacactaaattttggtactaacttgatctagatcttttttgctcggtatctgagattctgaagtggtgaagtgggggttgaaagtgttttttagtgaatgaatggtgctagaaagacgatcgaccagaagggtataaatagtggagaaccttagaccgggtcagtacatagttggttgcttggcaaaccgaatctctgatacataatccatgtcccacagaatcacacatatctaacccatgtcacgcagaatctcttgtatttaataccatgtcaaaccgaatctcttatgtatgattatagctgagatatttttagatgccgtacctttcggatccacggagaccatgagggacagtaggatttttttaaaaaaattacacagtacaacgcagacactcacaatggaggcacgtaaactctacccctatgagcatcttcgaagactgcgcaggcaaatccttgagattgacgaagtcaccacaggcgcctcgctgtcgacgggtacgtcgcctaccactgaaagcacaagccgttaaatcatggaaaatttgctcccatggagagtcaaacccagaaccttatgtgctactgagactcttgtaaccactaggttattgaccctttcacggggatagtaggattgtgataattgaagagaaggtgttgtcgtacctttacaagttgtgagggtgtactattacaggtgtagaccagaaggaaacagtaattgggatagctattgcttttggtagcggtgattctggcataggctcatcaaccatctcacgaggaatctgcaagaagaaaaccccaagtctagtggattggtgaatccacatgataattctactacttgtgggtggcgttacattcagtgaggtggagcatgttaaaataggtgccgaatatacttgtcctaataggttgtagttaaacttaaagttgtaatatatggtagctagagggtggggttagcatcagactccataacccggtaaccctttaaataaaaatgggggcacccactactagagaaacgattttttatcctaaaccccaaaacacaaatatcctgactagatcaagaaccggtactaaatatgctttagtaccggttctaaaagttgaagttcctaaaactatgtttaattccggttggtgttaccaccctataataaaaatatatctttagtactgattggtaacaccaaccgagactaatgctatagtagcattagtctcggttggtgttaccaaccggtaataacgatgcaattttagcaccagttggtaataccaactcatactaaagatatttttagtaccggtcggttggtaataccaaccggtactaacgatgtctctgggatcagttcaaaaagaaagcatctacattcaagtcagatgtgtatagtagtaggtggaatggtaacgtgtgtgaggactgagttgatagatcttgagttcgaatctcacatcccacactttttttttttgacttagtatgcatcttttgtactcgttctttctaccggtactaaagatagtctcgatttactggtctcggttgctacagccggtacgaaagggggttttaactagtattaaagattgtttctcctgcagtgaccaccaatgtaacaatcatgtcaataatgtaacataggcacgcagaaagagaatggcggcgagaccatggactcatagcagcaaggggtgctagctatgttgattacagaggaacacccataattagagtcccgtgcattaaacgtatactaataacaaaacaaattacagattctgtcggtaaactgtgaaacaaatttaattgttaagcctaattaatccatcattagtaaatgtttactgtagcatcacattatcaaatcatggcgtaattagggtcaaaagatttgtctcgcaatttacatgcaaactgtgcaattgattttttttatctacatttaatgctttatgcatgtgtctaaatatttgatgtgacagaatttttagaagtttgaagggatctaaacactgctatagtccttatatatgcttcctaattagcacctgtacgtgtatgaaaaatcaatgttgagactaacaagctagcacaataattactggagtatctacttgctaccttacccggcccacgtgttatcatgggaaaatttggagtaaaagaattaattaacagaattagaggaaaaactcaagttgcaaaatactatcacatatacatagaacctaagctgatgaatatataccatcagtccatcacaaagagaatttgagttgaaaaataccattaccgtgatcatttccacccagggaagaaaatgactaatttgccccctgcttttttttcttctttgtttcctgtgcttgctatacttatggctctcaatttcataatattttatacagactgcttgccttatacgtactcccttcggtaacaaataagtgacattttagaaagcaacaagattaccgaaatgatcaatattgattgctagtataaaacctataaaaatatagcaaggacgttctaatattttgaaactcctttttgttttcaaagacaaatatacctatatcaatttttaaaattaaatcgaaatattttaatagaaattgatagtaaaagtttaaacacaaaacacattgacttgatgtattcaagaacatcaattattgttgatagggatgcagtaaaaaaataatatatttatttaaaaattatgaactgtactatttccttgaaaatgtttttattgcttatttcttaaagactaaattttataaaactacagatattttggctaaactatcacaaaactataaatttaaaatgtgtatcataaaactacagatttaacatgaaatttatcacataactacatatttaaagcattgtatcacaaaactatgcatttagaaatgaaattatcaaataactacaaattttagagtttatatctatagcactgttgatgttacaaaagttgtagctttctgataaaactgatgttatactatatatatatttaaatctgatgttaaactgatgttatatatgctcatttataaaattgtagttttctaatgatactttcaatctatagttttgtaaaaaaatatggttttaaatctgtagtttaatttgtaatacactttcttaaatatatagtattgtgatatattgatcaaagtacattaattttgtaaaatttactctttcttaatttttgcattagctgattttctaaacatttccaccataaattaaatgcgagatttgttaaatgcatccaaacgcgacttggaatgttgagtattacaactgagtggaaaaaaaagggtagtgttggaattttcaaaactctctctcctaaaaaggtattaattgcagttttggatgaaacagtaatggtaccggcattttccaactcaaatttccctgtgatggtattttgtagctgatcttcttgtagtggtattttccaacccaacattctttgcaacggcagtgatcaaatttgcagaagatttaatgtggacaagtagaaaattttcagaaattagttaaagattggaaagtgcatttagtaagatgggtaatgagatcataaccttcaacacaaacagctagatcataacctcctcttgtgtttccaaaaaaaaaaaatgttgtggagaattttatctgactaatattttttttagaagatgtattaaaaactcggtctctacaagtacatagccaaacatacattgtcaagagtatttagtttttggggcaatcgtatatttgaccctattttgaaagcaaactaccaaccaatttgaccttatttttttaactttgcttttttttaacctacttttttgaccctgctttttaactatcgacatcagacatgaccccatttcgtgaaaccaacttgacagtgttaatttgaggtcgaaatacctttatatccttactcatttgaccctaatttttttatacgctttggtgtacatgatgcaatttctaataaatttcacttggaattgatatgtcttgtgcgaatttgaattagatttgaattttagccaaaaaaaaacaattgagaacgcaaattagatcaccacaacaaatggttccggaacaacatgccagcatcgattcaaatccatatcaacatgcaaacaaatccctgctaagaacatcatccaacaataacattcaaacaagatcacaaaaatcaaacaagcgctggcaccggcgcatccagccacagccgccgctccctccacatctcgccgccatcactccctccatgtgtcctcattgtcgtcgctccctccgtgcaccgtcgccgtcgccgtctgatctgcccatcgcctccctccgcacgccggcgccgtcgccgtcaccgcgcctcctccttgcgctgccgtctgatctgcccatcgcctccctccgcacgccggcgccgtcgccgtcaccgcgcctcctccttgcaccgccgctgcctcctgctcgctccccacgtcggcgccagcgccgtcgcctcctccttcctcgtgccgctgccgccgagatgtgaatgagagattggttgaagacttgaagtgaaatgtatgagggtattttggtcactttgaatagtaaaatgattctttttcttttcttttttgaaaccctaatggcatagtgtaaatagggtcaaacggcatgctcgattttaaaaagcggggtcaaattagcaaactaaaaaatgtagtatcagattagtagtttggctttaaaacaaggtcaaatgagcaattgtcccttagttttttctagaccaacatgcttattgcttgtgctttttctctctctttttttgtcggaggagacttagaatcgggcgcccgatccaggcgtccaaaaatcgggggctgacgtcagcatgatgttagcgccacgcatgtgtgaaaaaccattttaaactattttttatcttaaattatttatcgaaattatgatctgattatactattaaatttgttgcaattaaatcttcaaaacaagaccacacatggatatattccgacgaaattttttagcttattattgaattatattttaaatgttgcacgatgttacaccaagtatatcggaattatttcactaagtagatcgaaaatgttcaatcgtttaaatcgggcgttgtttcaccttatataaaaacaatgtttcagcaaatagcgaaagaatatttcagttcactgcaatgttagatctatacatagtaaaacattataagtacactggattatttttggtggaacaaaaaagtgaaacgaattctcataatagagggttttgaaaatatgttggtgatctgttacaaaataatgtttcagttcattgcaacattagatctatacatagtgaaacattgtgagtaaactaggtgaaacttttttttttcgaaaaaaaaataaaacgaattttcttaacagatagtttctaaaatatatgggtgatttgttgcatggagttgtgtgtggacaaatgattgggagcaggggacacgtgagtgaggcctagaggggcgtgcatcttggggcgagggagcgcctgatttcggctaccttcccccaagcgaccgattggaagaaatttcgtttttttccgtaattattgcggggcgtcacacaccaccaatccaccgtgcaccatgctcccctccggcctcgcagtcgctccgcctcccataagcctccacgccgccgcctcccgcacgggccgacagcggtatgcacccgtcgaccggcgtgcttcgatgggccggagcaatccgccgcggcccacccgcgccgcgtggtggcggacccgacgccgcgaaggcgtccctcccctcccctccccgccgactggtacgacaccgccgcagtcatcgtcgccggcggccggagcagctaggttcggtggtagagagaggaggaagggagagaagaggggaaagagcctgaggaggaggaggcctcggtaggcatccctaacgccaaagggggaggaggcgacgaggccttccgccaagtgaagtcatccgaggagccatccgccgcccggaaaagtccggtggcgaagaagccgagccggccgcatggggggagtggggggccccaaccggcgtgttccccgccgacatctccccgcccgcggccgcgaatcatgttgctctctccctgtcacttcacaacacgcggaggcagcagcggccggtggtgcggggctgcgggcttcgtctcggcgggacggacggcagcggctgggtagcgtcgcgagcttggaccccccggcggcggcggcgtggggagggcggtgagatcgagtcctgcgacgtcggggtcgggctgtggctgggaaagtgcgacgagaacgagcacgcccggtggcggttactggaggagcacgtcgaggtcgggcccttggcggcggcaaggtcaagccttggcttcctgtaatcaaaggtaaaattttccgaaattcagcgaagaaacggtagaaatttgcatttctaaaagtggcaaatagttaaatgcccctttgcaattgagcctaatgggatagatgaaaaaaattgagagtttgaagtacaattatttatttctacaccaacggcgtttcttctctatatgttacaatcatatttctactcagggagaacctgtcaatatcttctagttgaattcatataacataaacaccatgcgctacttggcaggtgcctcattgtacttgataatgtgtggactgtatcaacatggaatgttgttagacatgctttacaagaggattgctgtagtagaatagtagtaacaacagaaattaacgatgtggctcaggcatggagtttttacaagtctcaacataatgcatctcacgtgatcaagaagcatattttgaagatggaaccgcttaatgacgatttctcaagagatttacttgttagtagagtttttggtgataaagacaaatgtcctgaagaactcaatgaagtttcatatgagatagcacgaaaatgtggcggtttgccactagcaactatcgctgcagccagtcttttattgagtcggccagacaaaccagatgaatggatctatgtacagaagtcgttgattccagatttgaggatacaacctacttccgaaggaatggcacaactactgaacaatagcttcaacaatcttcctcatcatttgaaagcatgcatgctgtatctgagtatatataaagaggatcacataatcaatccggacgatctggttaagcaatgggtagctgaagattttgtaagtgcgacggaagggaaaagtttggatgaagctgcaaggaatcatttttatgagcttgtccataggggaatacttgaaactgaacatatcagctgtagtgatgaggttgtatcttgcacagtgcatgacatggttcttaactttatcaaacgcaaggcaatggaagagaattttgtcactgcaattgatcattctcagtctggtatagactagcagacaaagttcgacgactctctctccatttcggatattcaaaagatgcaaaggcaccagcatgtattagattgtcacaactacgatcacttgtgttttctggattttggaagtgcgggccttccatttcggagtttcatcttcttcgagttctattccttcatggtaaacatggcgaatttcttgacctcactagaattcgtgaactgtttctactgacttatttgcagattgaaggtaatgtttgcatagacttaccatcagagctccaaggactgaagtatctcaggactctgcatattggtgcaatggtgacctttttgagatcagaagttgttcatcttccgccgttgctgcacttcagacttccacccaatctagggtactttgttgacgcagggagtgtacagagtattgaagaactgaccaatttgcaggatcttcaactcgcatgtcctcagatagccacttctgaccatattaagcacaacatgaaactgttgggttcaattattgggatacttaagagcctcaaatctctaacagttgttcctgtctgcttctctgaagattctaatgataacgaaaattcaagcattgccattttcttggatttcttagataaagttccccccccttgtagccttctgcagaggcttgagttgtttccacgtgtttgcgtcttccatagacttcccagttggatcataactattgagaaactctgtattttgaaagtagcagtcatggaactcctgaggaaagacattgagactctctcaatgctgaatgccctcactgttttctcactgtatgtccggacaacccctgcagaacctatcatatttgacaagtcaggattccatgttttgaagtacttcaaattcaagtgtagtactgtatcaagtctgagatttgatgaaggagctatgcccaacctccaaaggttaaagatggaattcaatggtagcacagtggagcaatacaaccttgaaaatgtgggcttcaagcacttgtcaggtgtcaaggtcagcgcaaaaatttgcattgccggtactagtgaagctaacagaatggctatagcctctgtactgaacaatgccatcaggcaaaatacaagaatatcaagtgtaatcatacggttcatcaacagggttataaaaggtacgaatttacataccctactgtaacaataaacatgccctcttttctgtgtttatttgcgcaagatacactccttgccttaacattggaatttggacgagatgcacatggtcgattttttcgctattcaaaatattttatttgagaatttaactagggtaatcatttgaaccacatatctattttagtatgccatttggacatgcaaatttgacctgcaatcatccatttcatttttgttttaccaatcaaaacatcctactacctgctgtagtataatgtctttagttaggtcgatcaacagcagtggatatcccatatcctactacgtaattcttttgtacacatcatactgattttattatataaaagaggcccaatgatcagatcagtgacattgtagagatggtactgttgcaaagataatggaagcagcaaccagaaggtgtacacagccacattattacaagcgtgtgtgaaagttcattaaaatgataaaagaagtattcgacaggctagttaactaaaaaaaaaaaagatacataggctagctgttattaaaccaccatccaatatggttgaaaagttctgtgactacgctccaaggtgttgcctgcatcaaataccagatcatgcaactcctcacgctgaagagaccaaaccatagccagttggagcccataaagatgtaagattaggataattccttttatagaagaaaaataagtacattttactgtccgaactatttcattggaccatttaaccccctaattttgttttggctcattttacacctggaaatattaaaaatggttcactttactccctaacgatattaggagccatcgtttcgcttattcgcggaataagtgaaacggcatatttacaaacgaaaaattatttgtaaataaaacttttatatacgtgttctaagcgatctaaaagcaaaggctgaaaaataaactttgatgaaaaaacctcaaaattagctccaaatttaagattaaaaattcaaattttggctgataagtataagcataagcgaaaagttgaggcccattgttccttttcgtttctctctatataagtcatattttgcattgaaattttggtagaacgatagatgcattacaacatatgtcttgtgacattccggtccaatcaggattaggcctgtgtggtacatgagagctgtgtgcgcatgtttagtatcaactgcggtagtgtagcaaggttggaaccaacttataaacacggttttgtagggcgggctgttacacgtctcaacattttttagatttttccccactctttacataagtcggaaacagctaagactgatttaaatgtggagattttaaagttcaagccaacagtcaagaaaaaacttaattttttttttgaagtttgataatggtatcagggatggctctaaaaaaattcagcctaaaatacaacttatataaaaaggaaaaaaaaagagaaatgttataaaggagtaaggtgaaccatttttaatagtttaggtggtaaaatgagccgaaaaatagtttaggggtttagtggtccaatgaaatagtttgggggggggggagtaaaatggacttctttttctaaaaacaatatccttatgacgtaatccaatagataataaccggttggccgcaccaacgtacaccggcttattttaacttttagtccaaaccaactaatcaatttccgaataaattggacaatactagtggctggatccaaattaaaagctgcatgtacctcacgccacacagtgtgctgtatggcaatgaaaaaacaaatgttgaatagtctcattgtcattaaaaaacatttctagctgtgtcgttaatttctcttagcaaagctaatcctgtgctatatacaaacccacgttgtaagcaccagaaaataaggcttgatatttgaatgaacagaaaattcctttttctgatgtaagttcatctaaaagtgtcgatttcatgtgtcagtttaatattcatgagcttagaaactaattccttccaagcttatactttatcaccttctggctgtgggatatgatgttctaatatcgtgcttgcccatcatggttatggccttatggatattcagttctagaattatcctatacttacagatttgattgcctagttattcttctacctgattctaaatactaatcattttagacaagctcgaggattaagagtataggtgaaacggtttggttgcccttcattggtagcacattggatgacacataatgttcaatatattctgaatgatggagaaaataatattttattctggtactccctccgttccaggttataagatggtttgactttggtcaaagtcaaactagttcaagtttgactaagtttatacagaaatatagtaatatttataataccaaattagtttcattaaatcaataattgaatatatttttataataaatttgtcttgggttgaaaatgttgttatttttttctacaaacttagtcaaacttgaaacagtttgactttgtccaaagtcaaaatgtcttataacctgaaacaaagggagtagcatttatttagtaaaggcaagaatgggagaaaagcgaacataccatatgcaaatctgagctttaggtcacaagcatcgaaaaacttgaacattaagacaccttcattttcagactaagtgggagcttttgttagatattttgtgacctattaatatgagaaacctttcacctcttagtgttaactgtttatatgggattttaagaaaaaaccttcaattagccattataaagaaaagatactgtattagatctttatatggtcatctggtgtgctaattcttcgggctttggcacagatcttccgattgtccccacccctcacacggatcatatgcatgaaaatctgaggctggataagagtgtcaggtcctggcctacccagtgcgatggctgcaaggagcttggtgccggccacaggttcaagtgcgagcaatgcaactccaaggtgtactatgatatgtgctgcgcaacagcgcctcacaccctgaaacaccctctgttcccaggctccgtttttcggttcctccgaaagcctctggcctctgaatgcggtagggcctgtgatgcatgtggtgacctcatgcacggcttcgtctaccactgctttgagcgtggcctcgacctccacccacgctgtgcgaggctgcctgttcgcactgcaaacgtaaagggctatgtcatggagcttcgcagggtgtcggcttgcagcagatgttgcatttgcatgtgtggcaaggagggttatcgcaacaagttttggtcctaccgctccagtcaggaaggccaggacattaacgtgcatatggcgtgtttaaaagacttggcatcaaaatcacatgaaaccctaactaaactgtatgagatcctaatgggtgaatcacagtggacgccaacagaggttttaggcgaagatacatccgaccaattagttgtcagcaggtatcagttcataactagcgatcacaaaaaaccatccaaatttttgttctacttcgtccagttagtatacgactattattacacctgtttcagtgcggaggatggtgatcgtacgccactgagacaagatgaaattacagaggagtttcagcacaaggatgaagtatgtaatgttctagagcatggacgggaggaactccggaagaaagaaaccgataccaggtaatatatagttgatttcattactaaagaacggccaccatcaaatacaactgctattgcacagttggtcaattccagagctaatggtccacgctcatcgcagccactttccaccgctgcgggttgttcactttatttcttaaccctaatactctagtaattactttgcactcccacaggtttattttcaatttaccatgaaccaacattagttcaactcaagaacaattatcacttaaaatttgacattgaaacaacttaatctaaacaaaaatttcaccctcacaaaaatttgaactcagccaaacatgcgttcatctattgactcataaacatttttcttttttagatgggattgttgtaatttgggtgacaccagctgacaagaaattcagaacacatagatccctggaattgacttaggccctgtttgattcagcttaggattattataatctggattattaggagtaagctgaaacaaacaagtagattattatgctagattgttataatctataagccagattagtataatccaataatctcctctagaggagtagaggagctttttctagattattgagtggctaaagacccactacccttagatgtctctaataattcagagaaacaaacaactcgcagcttattctatgttagcttattataatctaggttagaataatctaatttaataatctagattacaataatcttaagctgaagcaaacagggccttagaaatacttaaaagtcgataatgcaagagagcaggccattgttgatgagattcgatatttgttatgtctatgtccctcggagccaagtaaggtgactccggcctcttaagaatttatttgatgatatattgaggcctgagggttacatcggttggccatatagttatactccaataacaagaatccacatgctaagaattactattctactcaaactacaataccatagttttgcctgtaacagccattttgtaccttgatggggttctagtgtttgtatataactctaaaattggtcgacctacgattacccagctacccaacttatccatcagattacataacaaactgcctcggatcaccactccaatctgacttggaccacccatctgctcaagaatatttattctgacgtctgtttggataactttatctggctttagagtaaagatcgccaagacaaactcaatgtgggtttgcttagttgttctgttatgttgattgtggcctttgcagttctcttatcatacagttgacaatttgacatgtgcattttgaaagcagaataaagaaagatcataatacctagtatgtataaacaagtttgagtctagcatataattagattgaaactattatttcgtgtaggaaaaagcctagttattgtctctcaattatcttgttggtctagttttcgtcgctcaatttataaaccaggtaaaactattccctcaactatgcaaactagacaagttatgtcccttggctggttttgggtgtgacatgtcatcgactttgcgcgcccagccgtcctccacatcatagagctagccccacattagggcccttatcatcttttctcccttccctttcatatttgggtgttggtaaaaaggttcatgagtcatagccactattcgtcagagccggcatgaggtcctggaaaatgatgagttcagttgcaggtctgtagcctctccgctggtgtcagcaaagtggccaaccacagcatacacctacgtgcaatccatcctggtgcctgcaccagagctttttctttttatgaaggagcagccacgattaacatgaaagacaactgagcaggaatcggctgaatatctacttggtggcctcatcatccttattggccatgtatgccagcacgtactgctttcagtgagaattccagtattttgctaacgtgcatagaaaggtgatgcaaacttgtaaagtgaatgtcagacccagaagaagaataagatgaaaatagatatctagtgtagctgcaaagcaaacaaaatattgagtcaaaattgaactgaactgatcatagcagcgggaaaggtgggcagcagtctcaccaatgggacagttgaagacagattccgatggtgtatactagcaaattggcaggcagccatggtgccacttcagcagctgctggaagaagacagggcgcaggagtcgccacaccagtactactctcacatgcatgttggattgtgtgcccatcgctgctggtgagctcacaatggggaattttgggagtgagggaaaggaatagttagagaagagaggtaactgttagctgtttcatccatgtcatcattttttttggtaaaggaagcttttattaatctcagtcgattacatcaagctgatagaaccatactaaaaaaaactcccggcctctgcataactaggatgcacatagccaaaacacacacacacccacaaaagagtttgtaacaagtgaaggaaagtagtaaaatctagggagcaccaatcttcagcctagaccgccatccatgtccttgagtaaaacactccctgaccacctactccaagcgttgacatgccgctgcaaccaaatcttgtgaatcaggcttctgaaggatagcccatgtacgaaggaagtggatagtttaaaaaataacctataaaggagaagagatgtcatatcattcccgcaaaaccataatgaccaacaaatagtggttacccttaacaggataagcgacttaaggtctttcctaattccccgtagccaattaccagacatattggatacaccacgaggcgggaaaagccctgtagccacttgtatagtgcaccacacaaaacgggcaaatctgcattcataaaacaaatgtaatattgtctcatctgtgtgacaaaaggaacaattcttacttccttgccaattgcgcttggccaggttagcccttgtcaaaactatcccacgacgtaaataccttaggaagatcatgactttaagtggtatttttactttccaaattactttatttatgttgggcacatctgaatgtaccaaggcaagataatgtgacttaactgaaaactctccattctggattaaattctagtggaacttatctcggtcctgagtaagcgctagatttgccattcgtggaacatggttattccatgccactaattttggctcaataagatcccttcgccaagatacattcggagggtagttttgtagcacatttgctatagtatcctgtttattgtataggcaagggtattgttctcacagtggtgcttctctcataatgaatttgccaaaacgtagaaaatcacgcttgaccttcataaggctggcctagaagtatgagtccctagctttccactcgacttgtgacataggttttgagcccaagtacttgttacgaatcaattgttgccatacaccatccatcgtgagtagcttaaataaccacttgctaggaagggcaatgtttttcatatataaatcatgaattcctaaatcccctttgttctttgggtcggcacataatactccacttcatcaaatgacactttttcttttgatcatcacactgccaatagaatctagagcgaaaacaataaagtttcttgagtacacctctcgatattgcgaagaaaaacatcatatacaggggaagactactaagcactgagtttatcaatgttaaacgtcttcccgtggaaagtagtttccctttccagctaccaagtctcttctcatagcgttcttctacccatttccaatcattatttcttagtttcctataatgaataggaaagtagcataacgggaattcgccagaagaacaaccaaagagtttggtatattggtcttccatggttcgagcatcaccaaaatagaacaattcactcttatggaagttaatcttgagacctgagagatgctcaaaagcacaaagcaaaagcttcatgttacgagccttctcaaggtcatgcttcataaaacgaatggtatcgtcagcgtattgtagaatggaaatgccatcatccactagatgagggactactccacaaatttgtccatctactttggctcaattgattagagtgaccagcatattagctacaatattaaaaaacattggcgaaagaggatcaccttgtcgaaggcccttttttgtttggaggaaatgtctgatgtcatcattcacttctattgatacatttccacccaaaacaaaagactcgatccaagaaatccacttggttggatattgagatttcatacgaaatccaaatcaaaatttgatcctttcatacgaagtccttgtcatcaattgtatcaccttagttgccatgtggactcaaaataacctcaaaccagctcgagggattaaaggtgttcggttttgatagtttgaggacatagtttacctggtttcaaagatgagggatggcaactagactaaccgaatagtttaagagtttagggatggaaattatacgttgatgtagcacaattatcggaggaacttcttcggtgtgctgatatgtagatatagcacaaaatgttgtaggaacgactttaatgtggtactccctccgtttcatattgtaagacattctagcattgcccacattcatatagatgttaatgaatctagacatatttaatatctatgtgaatgtggtcaatgctagaaagtcttacattttgaaacggaggaagtagtagataatgccctaaggcagcccgaatccacggacaacaagagcttagtccaaagctccaaagaagatctaatccatgttctgtaataggaacatctagttctattgataaggtggtaagcaaaagtaagttccaaactagaggccattgcctctatttaaaggctacaaagccatctacaactcgatacaactatatgacaacctgatgacatcctaattgacaactaggatgctactcaaaacaactcatctattactcaatgacacttagaacacaactcattggacatacaagtattttctagtgatataatgacatatgcaatatcataattattcttgagttttcatgaagtatgtactatagattcaaaactcaaattttgacttcttgttcttagtagagaaaatccaattctacttgtaacacctatactttatgaattggtcaggtgatgttcctcatcacgttctcttgagtataccacttcactaaaaactatatatgtacaagtttgcaattaataagaaaaaaatcattttactccctcgaactatttagccggaggatttaaccccgtaaactatttttcagtcattttacatcataaaactattgaaaacatttcactatagatgataagagaatctactcagtaccactgagttcgatacacttcaacaatatgccactgactttgttgatatcaataatatgccatcgccttttccttaacctctacgatttaccatcgccatctacagcctgttagtttgcgttggagaaaagacaagtatgcccttagtgaagatcagcagcactgagaccataccgtgcaaggtaccgagagttataataactataaagagaacatacaacggtactaaacatatgaaaaatatctttatttaagcagcatgattataaataattatgagcacatattttaagtattttgattatgaacaaatatctccaaggctacaggagggggtagagctttgatttgccgtgactgttgaggagcggttgagggattgcactgacgacagtagtagctctccaacagggccagggccaccatgtccccttgcatgcaatgccggcactgacgacggcggcggcaccagcagtagctccagcaggggcgtcgacgtcgtgtccccttgtttgcgacggcaacgctgatgacgatggcagcaccaccagcagccctccaacaggggcgccgtctcccgtcggatgtgacgatggtggctagaccaccgctgacttgtgctacggatggtggcactgggtcccgaaggtcgggtcggcgctagggatggcgacgttggcgaggcgtggcgctgtggcggcactgggaagggtggtgatgcggcgctgggagatgcgatgctgggaaaaaaggggccctgggccatgctagggttagatgattcaaagggtattttggtcataactaagaaaattaacaatacaaacggcgcgacgatggcaaatcatagaggttaaggataatgcgatggcatattatggatatcaacaaattcggtggcttattgttgaagtgtgttgaactcagtggtactttgtagattctctcgacctatatatataaatggtattttgcattgaatttgataggactgatagatgcattacgtcttacctcagcattttctttagaactttcatcattgtttacaaggttggaagcacctaaaactaacttaaacatcaaaatttaaatgttcaagcaaacaatcatgaaaaaaattgaaaatattatggaacttagataatgatgccatctatggctttaaaaaattttagcttaaaataagacttgtaaaaaataaaaaaaagataaaaaatgtaccccccatctcaaaatatagtgacatagtactgtattagacacaacttagtactatgaatctggaaaaaagagtattaagcagtataatgaaccatagttaatagtttcagttgtaacatgagctaaaaattgtttaggggtttaagtgacccaatcaaattgttagagtgaatgaaatggacattttaaatgaatagtaaaataaaacgaaaattgaacccgcaaaatttatttaaaattctatactagaaaattttaagcataataagaaagggatgcttcacagtaaaaaaaaaaaattgatgtgttggccatatgcggatacacagcttgagaactggtgcactaatctgtcttatttgtacatctaagttgaattgttgctcttaataggtctcaaacggtgacggagcctttgttctcaccaggtcaaggtaatacacctcattgtcatttttatctattccaacccttactttgggcaaactttgtttggggtaaaaggtaatgctagtcatacacgcctaaattttgggaattacgtgtgtacagataattgtaagctttccaattgaaatcatgtgcagcacatctttttgaaatcgataaattaattgaccttttggaaagccaaaagttatatgagaagcctgctgatgagtggccatgtgaaataagctaggcagatatgtagtactccttccatccaaaagtctaaggcagttttttttcaccaagaccaaggggggaataactcatctaccatgtgataaaaccaaggaactatatgtatgcatgcaaccaatgagtattaagatgactgcttgggttctagtcaacaatttaatttagcgcatcaaaactacaaatatgtccatctcatttagaaaaccagaaagtgaaatatgtcttgactttttgatggagggggtagaactgaagtcacccctgtttggagaaaagagaaggtacgcaactttaacaaagagttttggataggcaagctgattgttgaaatgttatatctcaaagggtgtctcatgaggtaatggcattaatatatgaggatcacattacggtagagttagctttaaaagttttcatcccttttgggagagaagagaaggtatccaactttgacaatgggttttggctatgaaaacggatgggtgaaatatcaattattatctctcacgaggtaatggcattaatatattagtgatgaaattaggatagagttagatttaaacgcaaacaacttgctccgcataatccaaatagataaacaagctaggattaacgtaagataaatacttaactggattaattaactacgagatatatatgctttggttacgaatatatacactggcatatagtgctaactgcatcacacatgttttatagcaccggaggaggaacctgtggcagagccagagatgatcacccaccacgaccacccgcagcacaagcttcgcctggtgaccacgacttgtgacatgccgttccgctgtgacggctgcttggagccaggatacgctcccagataccgctgcgacgcctgcaactttgacatgcacacgttctgctccaacctctgccggccattctacagcaccctatgtacaaaggccgcatattcaggttttgtcccaagcctctgcctccctcgggccgcagggtctgtgacgcctgcggcgatcccgtgcgcgggttcatctaccactgcttcggcgccaacctcgacctccacccgtgctgcgccagcctgcacgggccgatcatcctcgacgggcttgccttcgacatcggggcaccaaggaagtgctgcctttgcatgcaggaaaagggcccagaacgcgatctgtggtgctatcactccaacatcaatggcgagggtgtgtatctccacgtagcttgcatcaagcacttcgccggaaggagatggcaggcaggccgtgaaaagaaatatggagggcagatcatgctggcaagcgaggagctcatgatggagggtcccctcaagagcatttcatcggaaaaagaccgcattattgttggtggcgtcatgcgcatcatcatctcagtgatatttggagacccgactgcacaagggagacaacgctagggtcgctttatccctccaggggctggcagatttatttagcattcagagctaaactggtgtgtgatcactctccttgaaaagaacaaaagacctatcggtgtgcattggcttgttttgtttgtacttttgtttatttcctggaattggcaaggacttttatttccttcggtgtaaaataattcgtgtgtgtatatatattggcatgcagtttgctactgagtactgattaaataatttgataaagagtgataaatgtaataggtatatatgtatagggtttatttttcaacctatgtgcttgtaaacatgttgcattataaattgtatgaaatcatgaattttgattggtgatttgaacttaattgtaaaatctttggttcatgattatactttggtatatgcttgttatatattggatgggttcattttctttttattgcaacacatgatatgatgtgctatatatatatatatatatatatatatatataatgctaagctcttgaatattaataaacataattactatgcttgatgaaatcattatcaaaaggggagaagagatacaagtgcatgtttttcaggtaaaggaaaacgaaagaagttttcttctggatttttgagtactccgatgctttttaccacttttgtttttatttttccaaacactaaaacatttttgatgagtttgccaatgtgctcatcaagggggagattaaatcaaagtttgtttgattcttattctgtgatgaacaattgacatatgagattattggttttaatatttgaggattattggagtggttttggagatgattgaatttgcaggtgaacaagagatattgctgacaggtgataaccggtcagaccaggcaggtgctgccggtcagatcggagctatgtgtgcggtcagaccggccagcccgcggtctgatcggcttactctgtgtcagtttcggtttcgggttattttgttggatatcagtggataatttatgtgtcagttttggtttcgggttgttttgttggatatccgtggataatttatgtttatgacttctagatggatactatgcgtatgtaatactgttgtttactaacaatgagtcaagttggagatagcttgtgctcagaatatggtttcttggttgatgcatgtgtaggtgatcttaatgcctcgagagaatgttgccgatgatgaatcaggagtcaacttgggagaagatgacgtccgaatgatcaggatatcatacggcgtgcttaggctaaacatcaatgcatgtggttggtgaagattctatatggcatatgatggagatattgtgtgcgtataggatgcggagtcgaatttagaaggagtctaaatttggtacaattgaagtttgtaaagtttgtctatcactgctccgtgcgcggcttcgtctaccactgctccggcaccaacctgaacctccacccgtgctgcgcgagcctgcaggggcccatcacccttgacggccacgacttcgatgtccgggcacccaggaagtgcagcctgtgcaagaaggagaaagggccggaccgtgagctgtggtgctaccacaccaacatcaacggcgagggcgtgtacctgcacgtggcctgcgtcaagcacctcgccgggaagagatggcaggcgggccgcgagaagaaacacggaggccagatcatgctggcgagcaaggagctcatgatgaaggagggccccctcaagagcatttcgtcggaacaagaccgcattgttgtcgggggtgtcgtgcgcatcatcatatcggtgattttcggagacccgactgccaacaagggagacaacgctagggtggctttatccctccaggggcttgcagatttatttagcattcagagctaaactaaaacaagaacttaatcggtgtgcattggattgttttgttctagtttttttttttctagttaatttgtgcttttgttgatttcctccaattggcatggacttgtatatccttgggtgtaaaataatgcgtgtgcatgtgtatatgtgtgtgtgtatatatttgcatgcggttgctactgagaactggttaaatatatcgttgtttaacttattgtgttctgcccaaatatcttatgactcaagtatgaatcatagttgtgtagttgtgactgattggcacacactaatacatagtaccgaaaaggtgtcgggttgcaaacctgacaaaaaaatcggttttgcaactggcaccatttatctactagtaccaatgaccaatggttatttggtgctggtggtagaaccaacaccttttgtacttcccacaattaaaaaaaacagagacagactagaagcatcggctcaatgaaccgatgcatccaactaccttcttcaagccgcctttaatccccatacacaatatgtacagatcaagaactctatattgatttagcatcaataatctccattcacatcacagatagaaatattcaattattatttcccatcagtaacaaagcaacaccagcaagatgaagaactacacaacatcaaaaactacacaagtaggataaaaaactcatcttaaataaaataaaaaaaagatcaagaactcacaaccttcccgctgccgcatcattcaccaccagcaccgtcacatttgccatcttcccgtttatcacgatcgcctatgcgtcatccccggtgaccccacccccaatcacctcccaccggcgagagcagcgtgatctccatgcatgcgtgcgtcgtcaccatctccacactgaggtcatcgccgccgatccattggatgcggtgagagtggatgggagttgccacagctgcaggaaaggtggaggaagtgggaagagaggatgatgggcggtgctagtggtgaaggttgtgaggattgggacggcggcgacgatgcacgcagaagtgagctggagtggatgggcggcagcaacaggccgagagaggaggggatgggggcgatgggagagtgcgagagacgataaggttggtggggttaaaaggagtctcacccgtgacagctcagctcagtttcataaagttgtcaatcttttaaagaatcggcacctataatataaatactaggtgaaaccctgcgcattgctgcgggaatttagtatgaagatatacattgaaacattatgtgaattatgttggataataatttaacatgtctgtgtttgaaaagctcttaaattataaaaaactataaagatatagcatgtttgcatgatgtttaaatgtgatgattgttagtggatgatgatgtgacatcttgttaattagtggatgatgatgtggcatcttgttagtgaataatgatgtgacatctttgcatgttaagcttaagtagttagtagggggatgcggtgagagtggatgggagttgccacagctgcaggaaaggtggaggaagtgggaagagaggatgatgggcggtgcagtggtgaaggttgtgaggattgggacggcggcgacgatgcacgcagaagtgagctggagtggatgggcggcagcgacaggccgagagaggaggggatgggggcgatgggagagtgcgagagacgataaggttggtggggttaaaaggagtctcacccgtgacagctcagcttagtttcataaagttgtcaatcttttaaagaatcggcacctataatataaatataggtaccggttttctaaaaagtgtcacctatattattaatgccatatcatataaatataggtaccggttttctaaaaagtgtcacctatattattaatgccatatcggcacctatagctgcttaaatgtgctggttttatatattttttatccaatgtggaaacggttaaatgagctagtacctactagtgttttgtagtagtgacacggaggattcacatttccttattgttagattaggcatcaatatgcatcatattcataccatgcacactttgttgtacggtaacacactttttggtggcaggaatacaccaaatatttaggataaatccaaggtaattaaataacatggaaccattctatttataccagattgcttttacataaatatatgtgtttttagtgtatttgggtgctcttttgtgtaacatgtcactgttgaatttttgctttcactgaccatacctattttcactagtggggaacccatctttagttctgattggtaacccctttagttttgggtatgcaacccagacatccaattcaggactaaagctgggtatccttagtctcggttgaaatatctttagtttcggttgataacactaaccgggattaaagatggtagcaccaaccacttggtactattatctttaatttcggttggtgttaacaatacttttttttctttttttattcttatttgctgcttgcatcccacgtcaagttgctcctgacattcctaaatcaaattaaatccccacatcaaattgacatatcacagatcaaatgaacataatcatcaacaaaatcatccacaaatttacaaatcgaacatcgtacatcgaatgatggcagcaacacccatgccatggcagcagtactcggacaagagagacaaggaatagaatgaagaaaaaaagaagaaaaatgataggaaggcttcacaccatcccgggatagtcaacagaagaggaagaaaatgttagagtgcgcagcctgttccaccaaccgtaggcgtctggtccacagacccaaccggaggcacaagtttaggtcctgggcctacacaatccaaaagacagtctgatggatgagaactgtaacaaccttttaattcgtgctcccccatcatcaattaacaatgtgggactaacccaacagaaaaccattaaaaaaagaacaaaaaaaaaggggggagcgtgcagccactgcatggccgtccacccccgccggccgtcggcctcgccgcgccgcgctccaccgcgccattacgtggccacctcaccaccgcacgggcgcgccgccgccgcccggctgagccacgccgccgccaggacgagctcctccgccgtctagcaaagcatagctgccacatgggcgcgagccgcacccccgccgtcgcatggcctcgccggggcgccactgcttcgccgggccgcatcagcacgactgcgtggccgccgtctgccgcctccccctcgtgcgccgctgcgtgccgccttccctcccagcggacgggagggcgccgccgcccgccgtcgttttcatcgcagctgtcatcggcttcgcagagagggaggggaggagggggatcaagaggagagggaggacgacggcgaagaagatatggagaggtagagaaaaagagatcgcgtcagagttaagtacgcaaaaatagcgatttttgtagacacttgggtgcatgcggttggcccacccatacgcaaaaatagcaatttttgtagacacttgggtgcgtgcagttggcccacccgcacgtgaaaaccatttttgatctcacggaaaattcctttttaagtagtgtcctttctatttttgggatcaaattgttgtgtaaatgttatgtcaatatcacgtgggacgaagaccaagtcataggagacacgtaattagctaaaactggagataatactgctaagcgatcttgtttacaccggtttgtaagttggaggacgggttatatctggttttttggttcaagcatgaaatggctggaagacaaattgaggacctaatgtgaacttagtccgacctgtcgaagtatatcgctcacagtcacagcccagtcttcactaggaaaacggaaagaaaacgaatgtgtgaaacaacggcccaaattaactaaggcaagtttccagtagaccggtctttctcttttttcttcctctttttttttttcttaaactcagtagtttgtcatagcagagaggctagttacattttgtgccgcgttaattattccagtgggtataacacatcaatatatttcatctgcttgagttatccatgtgctagaatacccaccggccggaacaattccattagcctataattcaattaatttgcatgcatggtaattatcatgtaattattccgtgtcaactgcaattgaactgacaatactcacaatagtatatgtacattgaacacttaacagttcttttagataattgaccacgtaaaaggttaataataaaaaccatacatcatagaaagaattattaaagctatatatagagggaatctacaagggttttgcctcgaagtgcacgcaatgacgatatcccgatagattcctgcatccaatgtccatttattcatgacgactgcaaaatcaatattattccattaacatttgcggacaaactttgagcataatatgggatatataactaattaaagggccaaaatagataaacgacctagagtcgttattatgtataacaacttacaaggtgtggaattttgaagtggtcagtaaatttgagttgacaaatgaaattacttcaaaaactaaagaaataatatgtgtagacagtgactttttttttctctttgccagggtacgatgatagtgatctactgtaggttgtagatattggttcttttttctggtcttatatacattgtatggttcgacaagtcaagaaagaatcagagttctcaaaaggaaaaagagaaaaatatcgtagaacgaggtttgcacttgtttttttttggtaaaaattaatggagatttattccactacatataatcttgcttacaatcattatcaaggaaaggtaaaataaagcctgcaggaacatataaacacaggttgtaaagcaacacgagaagaaatactctccttcgctacacaccttcgctaatggctagcatgtgtgctgtaccgtgttcgccgttcgacgtacccaacaaaacttcatctcttggaaattaaccaactaatttgaacttcaaatcttgattcaatgtagtatggattgacctatcaaattgtttgctaaccaccacaagggaatctgtttcaaatataattcttgtagcttcctaatcataagcaatcaattatgtgcttgcaaaagggtatgtagccaagtggttttaaagggctaagtttccaatttaaaaggctgcatatattcgattggcgatatagaggctgggtaaaaaaatacccttctctgatacaaaaagttcttatgtaagtttgctagtaggtaactgaagacatattaggcttggtattttagtttatctcaatataattacttttctctgttgttcgataattgtagagctaggaaacattattctacataaaaagtttctatataccagttgatgtttcttgatatttttataaaatttgtgtatagttgtgctgcgttaattattccactcggttacatctggcacatcaatagttacatatttttccagtgaaattatcattatgtgccagaatatgtaattctattactccatcaatgtaaagtgcatttcatcattatgtatgaatataataagagccagtgcaagtccattaacattcacggaatttattttttagtatacgatatttataagagccaaaattacaaataaacaaaaaccaatataattgacgggctgcacagtaatccattcatttctctaaaagttcaagtgaactgcatgagtttgtccatgcattgttatatatatcaaattaacaagagatgaaagttcaagctcagtaaatatgagatgacaataatattcatttacattaaaaaacatgtaaatatctgcaggatgaccacatatttatctaaaagcactggtggagaaaccatctttcgtcggtcggccgaattccacaatagtcccggatacaataaaaaccagggctaaagatgatctttagtcccggttgatcaaatatgccgggtctaaagatcaaatatgcccgttaccctttttaaccgggactaaaacttgatctttagtcccggttcaaatgctgtcagggcctgtcaggccccccgggatctttagtcccggttagtaacaccaaccgagactaaagatcgtaacttaccaaccgggactaaagagctcggggatctttagccccggttggtaacaccaaccgggactaaagtcccacccctatatatatgtcttctttctcctccagctgcccgagcaagtttcaaaatttcttcaaaaaagaggggaggtcacgccaaaatttctagtgaatttattttggtgattacatacaaatcggaggtgcctaaaaggtttgcaacttcatcctccagtgttttttttttgtcatattacatttgcagctatgttttgcacacttttttgtctccaaaatttagttgtaagttgatgagagagaaaatttgtgtggggaagaaagaatatatagaaatttagttgatttgctaaagaaggttttataaaatagttgagaaagaaaatatagtgaaagttaatcttaaataatagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgtggaaagagtttgtaattatcttataattattgtatgactgtcattattgtaagaataattatttgtgtatgattttttttgactcatgtagatggatcggcaatggatgtacactcggcaatggatgtacgctgaccggcggtccaaagagttcattgacggcgtgcactattttttgagagtggccgaagctaacgggcaaaggggttttattcgttgtccatgcaataagtctaagaatcagaagaagtattctgcatccaggactattcatttccacttgtttgagtcggggttcatgccaagctataattgttggacatcccacagagagcaaggtgttgaaatggaagaagatgaagtggaagacgacaatattccggactttgctcagtacgttggatttgaaggaaatcaaacaggcgaggaggaaagggatgctgatggtaacgacgttgcggatgatctcggtcagatgttgcaggacgccaaggaggactgcgaaagtgaaaagggggcccataaattggacaagatgttagaggaccacagaacgtcgttgtacccaggttgcgagtaggggcacaaaaagttggataccactctggagttcttgcaatggaaggcaaaaaatggggttagtgacaagacatttggcgatttattgaaactcgtcaagaacattcttccagagggaaacaaattgctcgagacaatgtacgaggctaagaagatagtctgcccgctaggactggaagttcagaagattcacatatgtccgaatgattgtatcctatatcgcggtgaggagtatgagaacctagaagcatgccctgtttgcaaagcactacgatacaagattagacgagacgatccaggagaagttgacgggcagctaacaaagaagagaattcctactaaggtgatgtggtatttccctataataccacggctaaggcgtttgttcaggaacaaggggaatgctagaatgatgcgatggcatgttgaagagcgtcaataggacaggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatatacaacctcccccctggctatgcatgaataggaagtacataatgatgccgattattattcaaggccccaagcaacctggtaacgacatcgatgtgtacctaagaccactggtcgaagatcttaaactgttgtggaaaaaggaaggtgtccccgtgtgggacgaggacaaacaggaggtgtttaacctacgagcgctgctgttcgtaaccatcaacgattggcctgcacttagcaaactatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaagacaagcacttcgaacataaggctgaccaccgtacgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccctattgggaattcttggacgtccgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtgccgtctggatactccacgaaggaaaagatgttcacaaacctaaagtctcatgactgtcacgtgttgatgatacaactgctaccagttgtaataaggggtatccttccagacaatgtccgggcaacaataacaaagctatgtgcattcatgaacgcaatttcgtagaaggtcattgatccggatagattagaagccctttagaatgatgtggtgcaatgtctcgtcagttttgagttgatatttctaccttcatttttcaatataatgacgcatttgctttgtcaccttgtcaaagagatcagtattctcgggcctgtgtacctacacaacatgtttcctttcgagaggtacatgggcgttctgaagaagtatgttcgtaaccgtgctcgtccagaggcaagcatcgccaagggttatgaaacagaggaggtcatcgaattttgcgtagaatttatcgaagaccttcgcccaatcggggtacctgaatcacgccatgaagggagactacagggaaagggaactctcggaaggaaagcaataatgacggtagacaacaatttattccgtaaagcccatttcacggttctgcaacaatcttcattggtagctccttacatcgaggagcacttggctctagttcgcgccaggaacatcggtaagtccgatgcatggattacacggcatcacattgatactttccccgcgtggctactacaacatctcgtgggtaacgagtcgatcaaccaacaacttaccttcctggcgaggggaccgtcctggtcgatcgcgacattccagggatatgagatcaatgggtacacattctacacgagagcccaagacatgaagagcacgaatcaaagcagcgctgttcgtgtcgatgccatgggacacgatggaacaactggcacgtattacggtgccatcgaggacatatgggaacttgactatggtcctctcaaggtccctctgttccggtgccaatcggttaggttgactggtggaggcgtaatgattgatgacagtgggatgacaacggttgaccttgacaaagttggatactcggacgaaccttttgtccttgccaatgatgtaacgcaagtcttttacgtgaaggatatgtctagcaaaggaaagaagggcagagggcctgacgagcctaagcgtcatgtggttctcctagtcaaaagaaaaatcgtcggagctgaggacaagactgacgaggattacgatcagttggatgggcaaccccctttcacggtgatgattgaccctagcatcctcctatcaaatgaagacaccccttactcacgcagcgatcacaaggagggaacaatagtgaggaaaaagtacgtgcggtcaactgtcaccgccgatgtattgccgtaattattgtgtacacgatgtaaactattttggatgtattgattatccatataaatcaattgatgtatggcatatgttaattatgcacgattattagaggttttaatcatgtatatgctagttatatgcgatacttacaatttttaaaagttttaaatcatgcatgtggcatttacatatgttaattagagtttttaacaattaatttactatcattcatatgctaattatatatgactattcgaatttttaaaagttttaaatcatgcatgtagcatttacatatgttaattagagtttttaacaattaatttactatcattcatatgctaattatatatgactattcgaattttcaaaatttttacatcatgcatgtggcatttacatatgttaattagagtttttaacaattaatttaatatcattcatatgctaagtatatatgattattacaatttttattaattttaaatcatgccgtatgtatatacatatgttaattagagtttttaccaatttaatatcattcatatgctaagtatatatgattattagaatttttattaattttaaatcatatatttgcttattacgttttatccacttaattcattacagacaacaataatttttcgaagtaattgtcattaataattttaaagcattattttctattttaggagcacatatgtaatggaaaataatattcagtgcgcttatcagtagtcccggttcttaatcctaaccgggtttaaaaagaatttggaaatagcgggaaaatatctttagtcccggttgatgagaacaaccgggagtaaagattgttctcatcaaccgggactaaagatctatgggtatatatattcctgatgcgcgccctcgtcttctccaccaacacttagaagtttttgcccgatcgatctctctcgacttctccttcaccgccactgcctagggcatccccatatctcgccgtcgtctcgcgctcgtcgtcgtcgccgccgcctccgcctcctccaccgccgcgccgcatctctggggtgagagccgccgccgcctccctctcatcgctatctctctccgatctcgatctctctctctctccctctcggttgccgacgccgacgccgacgtcgtcacgacacgacgccgcgccacgacgccgcggcggcacgacacgagacgtacgagacgccacgatgccgccgccgcgcaacgccgccaccgggctgcgcgccacgccgccaccgcgccgcgcgccgcacgccgccgccgcgccacgtcgatgccgcgcgcggcgccacgccgccgccgcgccgccccgccgccacgaacgaacgtgaacgagaacgtgaacgtccgaacgaacgtgaacgagaacgcgaacgagcgaacgaacgtgaacgagaattgaacgtgaaagaacaaacgaacgtgaacgagaacgtgaacgaaacatgaacgtgaacgaacgtgaacgtgaaatgcaatataggtaggtgaatgaacgtgaacgaacgaacgtacgtgaacgaacgtaggtgaatgaaacgtgaccttaacgagaacgcgaacgtgaacgatcgtgaacgaaacgtgaacgtcaaatgcaatatatgttacttcgcgtttatcctaatacatctttttgtatcctgcagaaaagacgttgtcgaagtcgtccctcaagccggagtggtagctagccctcgaaggaattcgcgcaggcaagtgacgtaattatatatatgattgttatatttgtaatgcaattaagactattggatttaatatacgtcacctagacttagcatttatcactatttgagttttagtataagattattagatttgtaattagacttagcatataagattgtgtagggttctaatatacgacagttacacttagcacacatgactatttgagttttagtctaagattatttgagttttaatataagattatcatgcatgtaattagacttagtatataattattgactagctagggtcctataatatacgtcacctatacttagcatttatcactatttgagttttagtataagattattagatttgtaattagacttagcatataagattgtgtagggttctaatatacgacagttacacttagcacacatgactatttgagttttagtctaagattatttgagttttaatataagattattatatttgtaattagacttagtatataattattgactggctagggtcctataatatacgtcacctagacttagcatttatcactatttgagttttagtataagattatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacagatggctgatcgcaatgaggaacagatattgtacgatacaatcgcggagggaagcagccagaactggaacgaagaagaggggaacaaggatccaaaccagtatttgaacgaggaagggagcgttgagagggatgcggaggggaaccaggaggggcacgtggaaagggatgtggaggggaaccaggaggaggaggctagtggaagtcaaccctccgttggacagaagaggggacgcgggcaacgaggtgccacgaagaagcttgagggtcggcacatcataacggaagtggacgaagacggccgacctagtgccccggcagaagccgccaagaactatgtacgtcacagcggttgggttgcgcgggataacgtgcctgttagtacggtctactggcgcagaacaagggcacgcggagatcatgagagctttgtcccagattcggagaaagagatgctgtggaccacaatgctcgagacattcacccttcccgcgggtacagaggacaaagtgaaaaggtggactctgaagaaaatggcagaacagtttcggagcttcaagggagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagaggggtatcgaaccggccaccgctaattggccggaacgatcgaagttctggtactatgctcacggtggaatgctcaacccagctgatggctccctggtcttcggcgatcagatacgcgaggctgcgcgtcgactaacagacacagtggaagcctcttcttagggcacgttccgaccgaacagagagaaggacgagctgtcactcaccctgcagactccagagcatccaggacgaacacgagggaaaggggtgattccttggaagattgggttcaaggaggacatccacacgtacaggagtcggatgaggagcaagagagataccgaggcgaagattgcagatctagagttcagggtatcgagctacgagctcagcatgcaagaggaggtggcaaggaaggttgatgaatgcatggccgcacatcggtcccatgatccccagccgaccattcctcctgcaatggtgagcccgtcaggaaaccgtagcagctgcgcctcaaaggggcaggtaggatcatagagcatggacgccatgcaaacgcaggacgaatccacctgccccgttgatgacatcactcagcggacaccatgtgagctgcatattcctttcaagaacttatcaataaaggtaagcccatagtttatagattttagatttggccattccgctagttgttgcttatatatgttgattactaataaataaccactcaccacatgaaggtggcgtcgggcatggccatcccaacggacccttcaggtacttaccactgtaggccgattgcagcaggatactccaaggtcgaagttgagttggtcgaagacgcgtacgaggacctcgagctggattaccctggaggagatggtgagacgcatctacgagacacaagccacaccattattctatggcgcaagcgatacatcatcctccctgggcgacaagcggcgtctcgtgcaccatctcctctggctccgccgtctcctcctcaggctccagcaccgtctcctcctcatgctccagcaccgtctccacctcaggctcctgcaccgactcctccttaggctcctgcactgactcctcttcaggctcctgcaccgactcctccttaggctcctcttccggcaccttccaagtcaagggcaacccaagctccaccgcctgcccccacaagggcaataaagaaggcgaaagttgacaccgccaagaacaaggacccggggtacgattgcacgcaagaggagcttgaagcttacgtggcatcagaagtcaacagacaattcaagcctcgaagtccagaaaagaagattcctatagacccgagtgttaggaacttcttcaggggtatgtctgcacctgccaaggaggccataaagctatcggactatgagcgaacgctcaagaaagcatcttctggaaagtccaaaccagtccctcagcttggagagcaaccaaaccaggagatcgagccgttggtgactggtgaagattttggaatacaagaatttattaatgacaccgggctaactacggatcaattgctaggagacgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgattggagcaaggatcagggacacggacttcttgcaaggagatgacattctctggatcaatttcaagggaatctacgaactataccagctggacgccctcgacgtctctattatgagttgctggattttgtaagtatatcattcagttagatttcttactacgtctcctttaagtaattaggtccttgtatataagtagactatatataatatatactcccttttatcgttgtagaatggagattcaaagggcctaacggcggggggttttcgatactggattcatcgaccctcggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtatgaacttgctaagtgtttcatatgtaatgcatcccacgcacattgcagattccactgggtgcttttactcttcgacctggaagcctgtaacgtcaacgtatatgactcaatggataaaaaagagtctacgtttgacaaggttttcgaacttatagacaggtactgtcataagttcctatgttaattaagaatcttgttatagttaattgctactacgaatcatagctttaaactccatgtagggcttggtatcggttctatcatttggtccgcggcaaatggagagaaagacttaggcggaagttcaaatttcctgtgagtacatatgctctacatttatatttctctgattcaaatacatacaagtgtacattaattagatctctcgtcgtttgtcatttatttatagtgcgcaaagcaaaagcagggaactaacttgtgcggctactacgtgtgcgagtattgccactgccttgcagaccaaatcatcaccacaagagagctcgatgtacgtacaaataaatttaaaatttcattatgtatcgatttgttgtttaattactaataaatttcatacattcatatagtttattcgtatgagggataacctgatcacacacaaggaatttatcgcggcggttcaagaacaactcatgggattcatcaataaacaaatccttgatcccaagggtgaattctactacgacggaaacacaattcataggtccttagcttctgagctagcgactactactacgtcgaaatcgtagctagctaggacatataatggattgtaattaatacatgactatgtttctatatgcatgtgtacacattttctataatgtaaatatatattttggtcatatatatatatatatatatatacatatgcatttgcatatgtacatatgtattgaaacatatataaatataatataatatatatatatgcatatattatatgtgcatatatatgtattgaaacatatatatgcatatatataaaccatgcagcaacagggacatgaaaaaaaaaaggtcagctcgatctttagtcccggttgtttactcccggttggtgttaccaaccgggacgccggtgttaccaatcgggactaaagatcgatttttagtcccagttatttcacccgggactaaagatagcgatctttagtctcggattggtagtcccggtttggaaacagggattaaaggggggttacgaaccggaactacaaacgctttctctaccagtgaaggcaatgctattcataatcaacagttcgtcactactttttttgccggtaaaaaaaaaaagctgtgacaatatagcaaacatatatactctaattttttttctcgaagtaactttgttcactggtttttattgagacttgacagcaaataattaaacggatctgatgtacctgcagttccttggcatcgtaattagttctctgcagtttattaccagcaactaatatttccaaattccctatatatatagaaacaaatggaaacttcaaattggttatttgttaatatatatcaggttagaaagggttagagaaacacgatccacgtccagaagaaggttattatacgtaatgggttgcttggcgaagtgaatatctggtagatatatatagtaatccatgtcccacagaatctctgatatttaacgtacccatgtgaaacagattctattgtatataatccatgtcaaacggaatctgctgtatataatttctgcgattcactaaacctataactagctagctagagtgccaagtcattcaagtatctcactaacagatacgtgttatttttatttatttatttattggggaacatatatattgcattgcaatcataggcacctagggtctcattcacactcaactatataaacgtccacaggtatacgttttttcctatgagtacttctgacttctgagatgagagataaggtcagcatatattgagattggcgaactcactatatatatgtgcctcatggttaactgttatatcgcatgttaccgaaagaatattagtcataaatataagaacctgtacatgttcttagtcgcggactcaacctgagtcgacaaaagtttccaccaccataaacctaatccgctcaactatgctaactttgcgcatgtcgttttaactaaattagtcaaagaaaattatctaggtagtgctggcgtaatatttcgggaaaatatgtggtgggaatcacatatgaaatgaaaacttagaaagtaccattgattgaaaaatagacatacaagattcgtacgtttcatcacaagtaaaaatttactcacggatttgctcatgagtaaaaattttacagtgagtaaattttttactcatagtgacgtggatgaatttccagcgtctatttttcgatccagtggcagttttcaaatttccactacataagtggtttccaccacatattttccctaatatttcagttatgtgactagctcggaattgattctatatataatttagaaggaaaaacactatgtaattattaatttagaattttataactataacaaatacaactttagaattattaatttagacaaagtagatttatttataactgaatataatttccatatgtaaaaacaatcatttaataattagaaaatgcaactgccattttaataaaaaaatatgggaagtaaaaatattaactagttgcatataattggaaaaacttaaatagatatgtattttgttatacaaatgacaacatcagtagcctttgcgaatggatgggctaattaacaattaacttgctaattgtttatctagggcaaatatatggtgaaaactcaaaacaattacacacataggtgatatttaaataataaacaaccgaacaaagttatacgaacaaactcatgttcgttaatgagatataaaattaataaataccattgctcgtgtttatatctttttatcttatatttctcaattttatatctcacaaactcaagtaggttgtatggttgtctaatattaccttagctatttgtgagaggtttttcaattttttggaaaacttccatatatcattgtttgagataaaaaattgagaaacagcgatataatagtttttatataaataattagagaatttttttgttgatttgttttgcaaagaggtgcgcgctattacagatatgggcaggctgaatattctgaaagttaaatttctttctagtgtgtcttttttagataatagaatagaatctcagcttttgctcaaagagttatagccaattcttttctagtgtgcgtgtgagtattgatcgacatgtcgtttaattttatgaaatccaggacactttgttgtaaattttgtttttcaatgaagtgaaagggaagactaattccgttataagtttgaatgaataaaaacgagtaataatttataagcataattagctgtccagaattttttttccggaagaagtagagcaagctgttcaggacgtagatgtgtagataaatataaatatctaccagttattgttaagagagacttctcggactaggacactgcacgtatacgtatatatttgcatatatacaattagtgaaagattctgagtgcgcatatagtttagtttgaaacaggaatcatgccggctggtgaattggtgtataaatagaagatccagtctcagtctatctctctcatattccttcgatctgcagcttgtacgttggccttcttgtggtacgggcaggagtaggatataaaccttcacgccgatcttctccgaggctgactcggtcgatccagaggtatccatcgatccttaatttgaacataactacttttaagaatcctcacttactatatacatcctcctttctaaattgatcatcatataatacaatccaaaattttttgaattggtcatcatataaccgcatggacataaattttattggaatataattaattcaacatgggacaatagtttacattaatttttaggattaaattagttttctagaactttgacaactgataatatataatacttttggagtcaaatatgctcataccatatttatactttttagttttaagtaagagatttgctctggtcaaacaaaaagtatctcgaggtactcatactaaatcgtttgcgatcgttggatctaacaacgcccatcctgcccagctagatccaacgatcgaaaacgatttagtaccgtaaaataccggtaactcgagttactttttattgaaccggagcaaatctcttcaagtaaatatttataaattcattaacggtcgaagttttaaatgtttttatcaaatcttgtcctaaactttcaaatgttcagaattgaagcgagtatatatgtgtatcactaacgagatcgagtgcagggttggaaattccggaacgatattatttcggccgaaatttttaaattttaaatttttccgtgaattttggtattatttgttcaaattcaactatactttattcaaaatttcggaaatttcggtgagcaccgatcaaatcggctataccgataggttttctagtgactcaaatttgcatggcttgctcaataatgaattaatgatcttgaatttgctgatttcaacagaaaacgacaaccacatgttacgcacgccggatttgggtgatcctccggtggcggagatcactcacccgtttcaccctcacaagctgaggctggccgacaacgtcaccgacggtcactggcctttccggtgcggcggctgcaaggagctcgccgccggccgccgcaggtacaggtgcgagccctgcgacctcaccctctacacgtgctgcgccaccgcgccgctcaccctagagcacccgctgctcccgggccggcacttccgcctcctcgagcggcctccgccgccgccgccatggctcgccgccgacgaccgtggcggcggcggctggaggccggcgtgcgacgcgtgcggcgacctcctgcgcggcgacggcttcgcctaccactgcgccgatgggcacggcctcgtcggcctgaacctccacccgcgctgcgcgaggctgaggctgccagtggcggcagctcgcggcgccgccgccgtcaagctctgccgcagggcggctccccgccgacggtgcggcgtctgcatgtccggcgaggatgggtaccgtcacgggttctggacctgccgcttccgccgcagcggcggcgacgagctcgtcgacgtgcacctgtcgtgcttgaaggagttgatgtcacactcacacgagactctgactaatttgtatgagattctaatggaggacgggacgccgacaaatgattgtggtgaaggtgcatctgcacaagataatagcaggtgtgtatatatgaatttattccctcctgataaataagtttcgttttagaatcattgcagtgattttcgaccataatcattgttcagaacatatgtttgaggcacatggaaatcatatagctaaatttgttgctacagcgagaacttccatagtattacatttatgcagttatttcaataaaaaagccacgtgcaaataattcagttatttcttttttaaaaaaatataaaacgatatgtattacgctgaaaaaagtgttaaatgatagaaattattaatttatgattggaaagtacaacgccgtacatgaaaaactaccagcaattattatgtcataaggaaattatcataacgagctaggggattcccctagataattcacgtatagagtgagatttagtatacaattctgaaattttatattctattggtaacattgtatgtagaaatatatttagattttatatatacaatgcttagcttctatttctataaggtttgaatgtcatataccactcttaacttctatttcaataggcttagatttcatatataactcttgaattatatttctgtagatataattgtatttttatacaactatatgtaccgttatctaactgttaagatttttttctttttctagaaatttctagcttctagaatgaatgcggtagaagagcgtcctaataatataacggatagatgtcaaaaacttattattttataaattagttgctccgaaacgataatacttatcgttttggataaaactaaagtcaaaatttaaaatatttgactatgaaatatttctcatacagatatggagaccatatgtatagattaatcttgaaaagtacttcaataaacttatatatttgttcatatttatacgaatattactcccttcgttctattttaaatgtagttgttgatttctgtgtccaacgtttgctcgtccgtcttatttgaaaaattatgaaaaaattgaaaaaaaataagacacgcttaaagtactagtgatgctttattatctaatagcaataaaaatactaatcataaaaaatatcaaataagatggatggttaaacattggaaaaaaaaaaccacaactgcacttaaaaatgggcggagaaagtatagtagaaaagtgttattaaggttatttcttgagtgttgtttcttggagactttgtgtccttgtacaaaactataaatactatcaagtagttctaacaaaaaagaaatggttgtcaggatatttaaagtttgatcgagttttgtcccaaataataaaaaaaatttactgatcgggatcattgaatgcgctagttacagtggggaaagtaacggtgatgcggaggagttcgagaaccagaatggaacaaacaacggtatggtgccggagatgaagacgatcacccaccccagccacccggagcacaagcttagaatggtgaccaccaccggcgaagcgccgttcaagtgcgacgcctgcaaggagcccggagacgggccgaggtaccactgcctcacctgcgaggacctcaacatgcacaagttctgtgcccatgcgccgagcacgctctaccaccatctcttcggccgcacgttcgagcttctcgccaagccaccgcaaggacgaccggagaaaccgcaccccgccgccaccggtggtggcagaggcgaaagcggcggcaggtggtgcgacacctgcggcgaccatgtgttcggtctcgtctaccactgctcaggcgccaacctcgacctccacccatgctgtgcgagcctgcaggaactcccggtccaaaaccgggagacgttggaccaaccgaaagaaagtcttgctacgcctcaaaagctagttaaagaggtgagagattccctcacttttaagttggctcaaccccataaataagtaacgtgggactattctcaacagggactagccaagatcactatcgacggggtcgccttcgacatcgcggcgttcagcaagtgcagcctatgcagcagacaggaggaggagggcccggatcactgctgccgccgcctccgccgccaggagcaatggtgctactacaactccgacgtcgtcgacggcggcggcgaggccgtgtccctgcacgtgtcctgcatcaagcagatcgcacggaggagatggcaggcagctcgggacatgaaatgtggagggcagatcatgctggcgatcagcgaggagatgatcggtgaaggtggtcctctccatggcattccgtcggagcgagatcggaacatcgtcggcgcggtggtgcgcgtcatcatcgcggtgatatttggagataggacagccatggagggagacatcagctcttgggtagctttaggtctcccatggctgacaaatttatttaccgttcaaagataaatcgattggtgtgtgtttctctcgctcatctattcataggatgctacataaataaataactgcaggtaagtaaataaacaaacagataattaatcgatcgaggtgtctgttggcttgttttttttccacctacttttgcttatatattttctgggatttggaataaatggacttgtatttccttcagtgtaaaatattgtgtgtaatatgcatatactccctccgtcccataaaaattgcatttctagctccaaggctttgttccacaaaattatatttctagccagtggggcctaaccaattgattcatctatataagtttcattccatctcacataatt

SEQ ID NO: 51324 - DNA, 9107 bp, Oryza sativa
  unsure (1)..(9107): unsure at all n locations
tgtggtaatgttccaatcctactattttgtcctaaattagctagaaatgcaatttttatgggacggaggtagtatttgcataatgcttgttcgacaatgttgacgatatatatatattgcacgcattaatccatctgaagaatggttgtttattagttttcattttttttcactaattattattgaatcaactttttttatggattagtgactgaaaattaagttttgagttttccaaatgaccttatatagagacatgttctatgtcaaaagtgtataactcaacgcgatctacaagtttacatctgatgacatttccatttgaagttattcaacgtgcaaaatgtatattccaagtttagaatggtgaagtgagaaacaaatagcatatccttccaacaatcatgaaaagctcataggtaaaatcatgtgacttgtgatttatgtttcgctgccatgtatagatgcctaaaatatgtttttggtaccttttgtgcctacgaaagtcaaaatctggtaattcatttttaccggccattcatgaaaattgatttttacgggtggtcatggaatctgcttgagaaaaatcctgatttctacatgcccttacttttagacgacggttcaaaaaatacgtgtgaacacgagttattgaccaccctgaactaatgttttcttttatataccaatgccttataattgcattggtagttgtttcatgtaatatctgcggtccccaaagtgtcgctcttttaaagaagagggtgaatgttataaccaaatcccatgtaaacccttttatctaatgcaaatcccgtatagtaaatatgcacctcctcttcacgatttggtgatgatgttgatataaaatatgttgctacttattgctctcccctacctatgctttgtagttgtacatatatctttgatcgactaaaaaatttatataaccaaacatatatctcttggacatcatggaacactcggtgtacttgtccttttttgtgttctcaaaaacaatttatattgatattcatttgttatgaataggaggcagcaggaaaactgagtgtagatctgataggactggacgtctcatgacggtgagaagtggaaagctacagtggggagtcaagcctcccagatcttcaaaacctgcaagcatcgatggataactcaagaacgaagagactagtacaacgatctgaaattgaagattatgctgaacaaattgatttgataccttcttttcttgagcagcttctgtttttatgcaaataattgcaatacccagaattacatattactagacgtcaacccgtgcgttgcacgggtataattatatattgttacaataatatgaacagttttatgctacagatgtgttgtttatttttaaaatatagtagattagaattaaaataacttgttagttttgaattaaataattaaattaataagtgctaaattgacagttgagcatggtcataaatcgatatatagttattaagtttgaatttattttcacattgtagtgggattagataaaatcaatccctacctgttacaatctgctattttttattttgaatttcataaattattaatagcaatgctaaatagtacgtagtccaaggtttaattggtacagctccatattattaatttcattttttttagaaaatctataaatgtaaagagcatatggcctgttttatttaatataaaaccaacataatcaatgggtacgattttatgatgattaaactaataaatgctacattgatattgatagtcgaagatgtttagaactctgtcataattagaatagggagttatagtggattagataaaaagagtcctagttaaagtttgctaatcaaaattattaaatttaaaattgttctcgtcttggactgtcaagcaaaaatatttttatggctgctgcttgtcaaacttgaagttacaattttaattgtctaattattaatataaaattgtacttgtcttgaactctcaagaaaatatttgtatcatccctgtttgtgagaaagaatatatatttatatcatgtcgagagacaaataagttgtgttatttgtctttggaaattatatatatatatatggcatcaacttaaataacaatgagcggatacaacgaagcagcacgcatggattaattagtttgaatgtgcagaaagctatagaacaacaaagttcgaatatatatacatataagagaccatacaaatcaaccatgcatgaattatcttcatgcatggtttacagatgcaacgcctacgatggatgtttcctaggtgcaagcaaaacttggcatagaatatccaaattgacaaattacgtaccttcataaagagcagatgagacgaccacggatcgatctctttgggtgcaatcgaacttgtttgtttgggtgaattataacatctcaatgcacctgaaatttattaggtcatatgttggcatagccagatgaagagcatgcagatgaacagctagaattggagaaagttcgaacaaaatcttacttgtgtacgtaaatcagcaatcgtagctgtaggatcagtttagatcaattcttaatagatgagctgagaccccgcaaggacaaatgcattcggtcgacatcgatatggagctttgcctgcatgcaattgcggccaaacctcgggtgcacgatgaaggaggtcgaagttgccgccgtcttgtcgggagcgatgtccgccaataccgtggcagccatcgatgtaggtgaataccctaatgtggtggctgagattaatacgtgcacatatatgggttttgggcctttaaagcagttaaagagattggatggtggaccaatttctaacgctagattgcttggactttaaaagtccatgtttacagtttaaatctacggtcctgatattaccgtcaatctaatctaatggttagatctttatagttaacgtgagagttcgtagaaagtgcccaattagtatagggatagatttatgttgcttccttgctagttttttgagttgggaacttgggatggcaacacaaagttctagcaataatttgttacctcacctacctctcaacttcagggaagattaatccacaacttattacacgacgtcaccacccgtctctcacttacttcagattgtctggcttttcactcgctgaatcgctgtttgcatcggatagttgttttcttcagtccaaagtatacccataaggatgaagtagcctttaacttctctctatgctgtttgttggcgataacctctgatcgaacacattgcgtgcaaactgcagatgtccggcacggcaacagactaaaacagtaacgaagaacaaaggaaattcagagcagaggaaaaaactgagaaatttcagaattctccgcgagaacgatcaaatgtggggcaattttctggtggtttttcattcaactaaataaagaacttacaaatgaaaaaactgagctaagactcctacttatactcgatacaaataaacgaatccgaggcaaaatcgtgccatcccacgatccgcaaatctctgaattcagctacacacacctgcgctaaactcacgcacacggacgctactgatgcggtcattcagatcctgatcgccgcatctcccgcatctgctaacaaactccagcagacttattctccaagccattgcaatcgctacacacataaacttctaacttttccgtcacatcgttccaattttaactaaactttcaattttagtgtgaactaaacacaaccattactagttgagaatttagattttccttgacgacaaagtccactacaattctccaaaaaaattattaaaaacaagtcagtctccaccagaaccatctaccaccacatgtccatttgtgtcaagaacagagttattcagaaaattgatcagtactctaccactgaacccccgcagcacatgacctacttagagtttctctagaaaagtcaatgggggcaggaggccagcgtgggggcagacagcgtgcaggtgggtgacgtgtgtgcgggcagccttggagggcacgcgacggccggcgtgtggccaggcagatggcgggagatcggcggccgggcatgcgcatggaccgccgccgaaggccttgagatcgacgggcaagaaaggtatggaaaagtcttacctttcgggggcagtcttgacggaggtgctgggaattcgtcggtgctcgccggagaagatccgtcgtcgcagccgtgcaggaataacaagaaaatgcgcgaagcaaaattattatccgcgccaaaaaaaatgacgatgggggcgtgctccggagcccccaggactggggccttgggggaggattcgagggcctcctcacttttggggctctagtagggtccctgctggatctagttttttgatcttaactctcaaaaattgaataggggctgaatttgaggtccctgctggagatgctctaacaattgaaacactttggggggccacagctgaaattacacattcaacactgcttaatgtgtattggtacgaatatacaaactagagagagcaaacaattctcgatctgttgggttcatatatactccctccgttttcaaaatgtttgacacttgactttttagtacatgtttgatcattcgtcttattcaaaaaatttaagtaattatttattatttttatatcatttgattcattgttaaatatactttcatgtacacatatagttttacatttttcacaaatttttttaaataagacgaatggtcaaatatgtgctaaaaagtcaacggtgtcaacattttgaaacggagggagtatactcctaccccttcagattagaatactctatctctgcttgttaatttgggcaccactgcaagcatttgtttcttccttaggaatgagagaggaaccaggaagagggccgagacaagtaggttatcgcagtggtcactttgtagtgattggtctggtggtacacacacagctatgcattcgtctaggccatgtgagattcacaaactgtgattggagtactagctgctgataatatcgatttgcttatgataaccaaaaagcttaacaaattaatagaggagagtcaagggacgacacagagggggacgcatgcaccaggtggaggaccgtcaattagagatgcaatcgatgatggtgagtcgaagaagatgaaggaatagaagatttaagtctcagtgtactttactatatggagcagattataccatttctcataacatcagttagggagcaagttgaagaataatgtatcacccataatatagcaaccaacctaattcagctggagcaaagcgttaatctgaatgccataacaggaaccaagatggaaaaattatcatgctaaaacagactgagcatggtgacctaaatagggtagagatccccaggagactacggatgaaacatattctgtatttctgtggtcaactggtgctactgctcctggaactccgtaaagtcttctagtgcgagcagcctgcagccctgcctttatctgacggattgggccactgcctcctcgcgcgcatcataaaactccctaagtcccatggggttccgttttccctgcttttttctagaattttttccctctcctcttgatttactgacgtaccgttctaccagtggtagtttctgtttattttatggtcgtccgaacgaaggatgttggcaaatcgatgcctgcttgttgctgcgttctctgttggtgtcgtctaatgccgctgccaataatctcatcgtctgattcctttattaattgttcgtcttttcttgctcgtttttgtgttacttccttctgtttggtgtctttgatagctatctgcttgcgttgctggccggtgtttacagcgacacgcgttgtttgcatggattgactcatccaatttctttgcatatatacgtgccttatttccctacaatttgcttgttccttccaggctccaaaggctcatcattcagcgtctgttattattcctcttctttacacaccaggcaacattttcactgtggcctgcagaggccaccctcctcagcattttcgctttgtcaattgtactacttcaccttcgccatcaccatgatgctgcccaccacgtcaactgggcgcgctcaactcgccgtctcatcccgttcatgctcgtgcagggcccgtcctgcaaagttgaatcctcagttaaaccgacggctgctgaggtcgtcgtgggttggaagtgccggcacgcagatgatccatggtgttgtacacttcaacctgatggtgtggatcttggtgtatgactgggcaagaaggaggcatatgcatctcagcctgctctagcgcaccagggggttgggatggagctgtgtgtgtggtgatgatgctggtatccggtgttggatcggagctagcaccgtcgccggctgccgggcatgaaggtggtgaggatatgttgtagtgcttctggctggtgactggtaaacttattattatttggcagtgttaaaaaactaagcctaattgtggcttcaatggaggccaatcatggttgaatggtgttagagtttgtgtcgaatatgtcggttacagtttaggacatagagttgtactaggtgttaggaatagagtaagcgtcggactctattctagcctatctcttaaataaaggggtagatatgttgcaaccgcatcgtgacttaccataggcgagagggagtgggtgccgacgttcggctgaggctcgttgtaactctaatacattgtaataatgttggatgcctgaatcgatggagcacccataatcagtgccacaaggatataggcttcggttgaactttgttaacaaatatcattcatcggtgtcatcatcaaatttggctcttctatggcgtttctttcatgtttagtttccaattgtgatttgggggccggctttagaacaagttgtatgagagcttatgggaaatccatggtagaggtacgtgggaggtgctccacgctacaacgattacacaggatgtgaagggacgaatgtgcacgcaaggtggagcatggtggtgataaacgaaatttgatcggtggatataacatttcaggcggtggtttgaaccgttcgatggatgttttcaacaaggagatgaccagatgcagtgctcgggttgatggtggcagaagcaaattgcgatccaatagatggattcagacactttgggctggtgactcgaactttctagaaagctactttcaacaaggtgacatgaggccaaacactcgggcttggttgaagctggaggtgattgccattctcggtcggtggaatcaaacacaccggcgggggtgggtcgggccttttggcgagttgcattcaataaagagatggccaaacgtggcgctctggtcattcagcaactatgaaggcaacatggtgattcgtcggctttggctaacgactagattgataggtggtcaatctaagataggttggaacagatttgttgggtgacgaagtccgggcagcaggagcacgtcttggtgtggtcgacatgtaggtgtcagtgaagtttgacacgggtgggctccgacgaggaggcggtgggttccgacgacaaggttgacggtgggggccatcctcgatagagatggtggcagttcctaaaatatataggattcctagtcaaatttgcttattctcttgtatatttggattggatatcttccatatcctttctgttagttgaccgttaaattcttgtgtaaaagtccaatttgccctatggtatgaaaaccaaataaacttatagagtatggaaatttgttgtatgatacttttatatttatcattttataacgcaagatattatttgtgacaaagtttatttttagataggacataaaaataatatttatttttaatttttaaaatacatatatgtagcttattttgtgcatagtactaaaacatgttttctatataatataaatatatttatacgctacataaatattttttattaattaataaacctaaaatttactacctctattttttaatagatgacgccgttgactttttctcacatgtttgaccattcgtcttattcaaaaaatttacgtaattataatttattttgttatgagttgttttatcactcatagtactttaagtgtgatttatatcttatacatttgcataaaatttttgaataagatgaatggtcaaatatgtgagaaaaaatcaacggcgccatctattaaaaaaggaggtagtacaaaattccaagtcaaatttctttaggtttgaccaagtttaaaaatttagcaatatctaaaacaccaaattagtttcattaaatctaacattaatataatttgataatatgattgttttgtattgaaaatgttgctatagtttttataaatttggtcaaatttgaaaaggtttgaccgagaaaaaacttaaagctacttgtaatctgaaacggatggagtatgtaacaactgtgttcctagtcatctatcgcatacttagtgtatttatacactaactgacgcccttttaaataagatggtgaatgttatatccaaatcccatctaaacccttttatctcatgtaaataccatatttaagtaaatgtgcacctcctcttcacaatttggtgtgtgttcatataaaacacgtggaaaacttattcctttcccctacttatgctttgtagtagtatatatctttaaccgacttccaaatttatataaccagacacatgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51325 - DNA, 885 bp, Oryza sativa
accttcaccactgcaccgcccatcatcctctcttcccacttcctccacctttcctgcagctgtggcaactcccatccactctcaccgcatccccctactaactccttaagcttaacatgcaaaaatgtcacatcattattcactaacaagataccacatcatcatccactaacaatcatcacatttaaacatcatgcaaacatgctatatctttatagtttttataatttaagagcttttcaaatacaaacatgttaaattatcatccaacataattcacataatgtttcaatgtgtatcttcatgcaaagatgccacatcatcatccactaattaacaagatgccacatcatcatccactaacaatcatcacatttaaacatcatgcaaacatgctatatctttatagttttttataatttaagagcttttcaaacacagacatgttaaattattatccaacataattcacataatgtttcaatgtatatcttcatactaaattcccacagcaatgcgcagggtttcacctagtatttatattataggtgccgattctttaaaagattgacaactttatgaaactgagctgagctgtcacgggtgatactccttttaaccccaccaaccttatcgtctctcgcactctcccatcgcccccatcccctcctctctcggcctgtcgctacctcccatccactccagctcacttctgcgtgcatcgtcgccgccgtcccaatcctcacaaccttcaccactgcaccgcccatcatcctctcttcccacttcctccacctttcctgcaactgtggcaactcccatccactctcaccgcatccccctactaactacttaagcttaacatgcaaagatgtcacatcatta

SEQ ID NO: 51326 - DNA, 1075 bp, Oryza sativa
  unsure (1)..(1075): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgaagtgtaccaatgagaaagattctggatttaccttttcatcctacgagctgcagtgagagactgacaggcctgttgtcattatagtatttgcggatgttaatatacacaatgtgtgtactgaactcataattttgaatggcgtcccattaaaagagctgagatggcatgtttgtaacagtgattttgagcaagatgtattttattctctttgtaatatgattataagctggtaaaatttctaatttgaacctacctgtgtgttctttttgtgctaatcacggcatggttatgtccagaataaataagacaagaatgtgagggctagttgctcgttcaaagaaatatatatacttctttccagagtaattgtagttctgcagttggaggatttttgttttctttcaatatttctgtactgcctacattgtggaatttgtggtcactgattgtgaatctaatatctgatactgagctttatctgaagagacacttaagattgaaatcttgtacattagttctggtacacagccacaaaaacctccttttggtttcacatgcagccattgtaaggtatgatgtaattctatgaccaaagtatacttgggccgaacactctgtcttcgcctccggtcttcggacattgtaaggtaaacatctctctacttatcttgtttcatagagtcttgatctcatgcttcaagccgtagtcaatt

SEQ ID NO: 51327 - DNA, 3651 bp, Oryza sativa
acatatcgaggacagcctcagtaatgacttctgagagtactttatcaccttctccagtgccagcttcagcatcatgtatctcttgaacgatacgatcttctctaacatttgccttctgtcaatattatatgatgacatcgcgccttggattatagagaccatcctgaggactgcctcacagactatagcatatgcatgactgaatatctcggttgctgtttctgacagttctttgctgtgccaatcattttttacaggttctggcccctgttctaagattggcgcaaatgttacagtcttcggtttggttgtgttgacacggagctgctttgattccctcagcatttcattggcttccttcatttctgactcaaacctgctgctgaccttgaagtatggttgctccttgtgtgcagttgggctcgggagtggggaattctgccttgatgatgcttccaagaaaacctcaggtgcacatgctgattcacacgctacgatttacatggaaaacacaagtattactcttcatcataacaaaattatactataattgatatcttgactgaatttaactggagattgtccaatgcatgcaatattctgaagtctggcagacatacaggaatggggatgtcgagctgtgcttggggatccgtagtctgcatcgttgtgctccttgctgtcgtctgcactgggtcctgctcggggggtccacatcatgtcttcttgcggcttcttcttgtgatgcagcaggtgcatccatttcttagccttgctcttcaccttgccgagaactggcttcttctggctcccatttggggtccgcggcgatcccatcggactcaccggcggtgcccgtggcgaaggccagtatcgttgttgctcctcccattcatcgactggattttggcctgcaatattcagagacgctgagggaaatgtcaatcaggcatgatcatttctttatttctaggcaggtgaggcactaacatccctgtatcattacttccagaagaataatttggaacacattgatcaagctatacattttccaagatcgaaatgtcatgagaaattatgaaacatgcaggaatggtgaaatttgagatgagaagaaaagaaccaagaccgacaaatctattaccattttggacggggtgatcacctcgtttggtgctgatcccgcgcttcaattttctgatttcattcatgatttgtgcaagaatggaaccaaatcctagagctttgggaggagctgatcaggcaaaaaatggactctatcctaaagttggcaaccctgagggaaccaatttctgagttatagtggtgacaagggctaaattctggtggagcggttaagttgccaacctattctagggggtgtttggtggttggagggtggccatgcttttcttggagccatcccagatcataaacgaggttcatatgtttttgccacgagcagctgaaaaatgtaaggacatacatcatgcatgtgcgggatgttttgaactgagcaggtttagggatattttgatcaaatgtaatgttatttttgtagaccgaaaaaaaaaaaagcgatcctaggcttcctagcgctagataaagatacagaaggttcgagtttcatgaggctgaagacccagattatggaaaattcgagtaaaaaaaaacagaaggttcgagtttcatgaaatttgagttgcagagagaaggatgaagaccgaaaattcgagtttttagggaagtttcatgaaatttgagttgcagagagagggatgaagaccgaaaattcaatttttttacccaaaaaacaaaaaaaaatttcttgtcaagaatgggattcgaacccatgccctttcggaccagtacctgaaactggcgccttagaccaactcggccatcttgacagtttcgatatggttttattgacaatttataataatgtgtgtagaattcttcgcgacggtaaattatacaggacaataaaacgctgactatataacgtaaccgaaaccaaaattcttgacgaaactcaagaccctctctgtataatatgcaagctaccattgtcttacattaaaaggttctaaagctaacaggccaatatacataataaaaccataaatgccacagtaaaattacgccgaacaccgagttgcttcaaaaatggttactgctattgcctgtcaataaattgacttgtgttctttgttcataaatatgtaacaacattgggtgtcagcatatccatgttagcccatgctgccaaagatactacaaggagtaaacaatgttgtaccgatgaaacaagttttctccatgctctctgtaatctgctaagctgaaggtgtgcctcccaaacttgctggaagctgcaaaggcagcagcgcccctccatgcatctataagggggtcggctgctctaacaagcttcaggggtgagaggtagggccgaaactgccggattccggattccagccgagggatcatgcctgggatcaaagaacagcctccagtgacaaggatggactggcaaaggcgctccttgacagcctcgtcttccattagtcgcctaagtgagatgctgaccatctcatcgataccagcctggtcaattcctatcataccaggctggaacaatatttcagggcaccggaaccgctcgatccctatggaaatcctgtaatcttctgctgtaagagtccggaccttaggaggctcaggagtctgttggacagcttcagctttgttcacaaatgtagggtccatatcctgcacatggaagcatcaaatagtttatgattgtaaaagaaactattgaggtgtgagatctaagtaagacaaaatggccatcacggctcacaagcaagattgcttgaacgtgagatcttacctggatcttagaagcaattcgagcaagttctgattcatcatcatcgttcccatcgtcgtcgtcgtcattatctttgctcatctttttgtagactaaccaatcttcatctctcgtaccaaaagtgtcctcgcccttcccccgatcaaatgcagcagatgtgagcaaccgcatcctttctttctgggcggcattaagacgttccccacggcctactccaccagatgaattatgattaccattggtcttaccaccattgagtttctgtcgcttcctctgatcaaccctatcagaaagttccgagtatcgagcacggagctcttcaaggtataactctgggttctccctggatattaaagtaaaacatatcataaaagcagcgtatagagcgcatggcaaatatttatgacagattcgagaaaaatttatcccttttcatagagtgtatatttcattgatatgaggataatagaatagtaaattgaacattgtttggaattgcagaatgcatgcttgatttccagggcttatatcagcacgaagcgtatcacaagaacaaaaactaaaaagatggctctgaaataactggttaactaacccagtgtacttaaaatttcaaaaaagaggatcttaagctgaatgcagataaactaattatgacggccgtatgaatgataaatttcagactggggacatcgcaacttacaaacgcctctcttcttcttgcttctccctcaatgcttcctcctcagcacgtc

SEQ ID NO: 51328 - DNA, 16183 bp, Oryza sativa
caaacgcctctcttcttcttgcttctccctcaatgcttcctcctcagcacgtctctgcttggcacgcattccaccttctgttgtggttttaagtagtatctgttcttcttctcttttaactgaaagtatacgaaagtgaaataagaatagtaaatatttgaaacatggaaaatatctaaacttggtataatagatatgtgctcatgtcacacagtcgcaaaaggtctccccaaaacacaagcaaaaacaaacccctttgctacagatgataaatggacagacacacacctgttctggtgtcaatgtttcatcagggacagacacaagtggatacttatcaaccccagaagcatctgctttctcttcgttaccattggactccccctttgccttccttaaggattgtgttgctttcaaaatagcagatttgatttcctgctgggaaagatacccagatctacctaaaatggctgttgcttcttcttcctcagctccatcaagttgctccattagttcctccaaataagaaagctgtttttcaagttctgctatcttctgcgacctttttgcagcagccatatctcgcaaacgttgaccagccttttccttcaaagctgcttttcttgcaagttcttcctcagatggtggttcttctacaggaggcgggacccatggtagctgccaatacctagttttttcttcagcttcttccttattgttctgccaagtggatcaataaattcatagtgttgaaagaaagagctagaaatgtaacacggtagaaaagccctgtgcattctatagatgaactggatttggaatttacattggtaagaaaacaaacggtaaataaaagtttctcaccttaaatatctgcaactctgacatataatcaagagctacgtaacaatgttccttcttcagctcttcagccttttcccatgtaatgcttgcactactcaatgtaaagtggcaacgattagacatggtaggaaaaaaaaatgcatggagcacttcagaaatatgctgcgggcacctacctgtgatagggatactttagagagaggagctgcctcagaaaatctgtgatgtgaaagccaccaacgttggttctgcagcatgcccccaacacaggttctccctttaaaaactgaatgcatatacacagcaaagcattaatcagaatgcatatgtggacaaagaaagaagattttatttcacagaaccactttgatgagtacaacataatatttttgtttattgattgtttcaggatcatgacaacaataaacaaattgtgaaaaatacactacagagaagaatagtctaacttggattggatgagttagtatgcagcctaccatggaaaagtaagcagaaattcaaacacacagggctcaaaatacaaagcaacttttaccaatgtagttgtccggaagcatcatagattagatggaaagaaaacaacatgctgtgtctggagatcaagaaaatacatcccgacttccatgagcaaaatgatttagctaagaataggggcactctttctctctctctctctttccatgagcatgttatatagcattacccactacagattatccaatcagagttttagaatctacaatgcattcaacaatactgtgttcttcaagcatgcaatgcattaattttccgaacatctgacaaggtaatggaaatgcaatggcaaaggatttgtatgttgcacaaagttaagaggaaggcatgtggaaggaccaaacttactggaacaacatggcatgttccatgttcacacgaaatggccagtccatcttctccacaattcccaagtttctgattgtacttgtaactaaacacatcgtcaatgccgaaagctgaaactcacataggaagaaacatctttagcatcgacaattcttacttcaaaactaccatgcacaattgataacaatggcacaaaaagataagtatcattaccaatggatggcacgccatatgtctcaaaaagtagttctgacattctggctcgagaaaaggatggattgcattcacactctgtcataagaatgggatggcccacctgcccagcattactgttacttccagcagcatgaaaccaaacaaatagctcatgtgggaaccagaaaattctaaggtaaaaggatgcatacaaatatattactatataaccaaaggcacataacactttctattagaactatatgatactaatgagaaaaatctgttcagaaatgcctgctatgcctgggttattttttcactgtcacccaccatacacttgagaggagaaagctcactgatgaagataattgtccatgtctgtcatatgtctaggatggatatgctgaatatgacattcacttgtcatttaacttgcctgttttagaggctgagagcctgatactaaagtttcccaaagactttgaagcattacgttcaacttgtgaacgtcaactgtgtcactatgcaatatattcataagaaacttaattctgaacccgaaaccaactgaccattttagaactcacatgctaaattcaagttttaataaacactacatagtcccaatcattgcacacacttcacttatacatagaactggcatacaaaagaacccccaaatttcatcatttttatttgagagggactaccccacatttactagtgcaaggtaaagcaaagctgtcaaaccaaggaaacagtacataagtcaactacattcagaatatattcatagtacagatgatggcagagtgcaatttacctctgaagtggcacctagtcgatcaaaaccaaagtcaagaatctgcaacccagacagtaataataccagatcaaagaaatacttaaaaaatgtttgttacacaagcaataaaggttggagtgcaaatatcaacactctgaagtaagcaatcatgtgctgcactctaaatttgtgaaacataacaatatgtattggtatctaatgtcataaaggatatgtgaactatgaaagatattatcattaatagctatagaatagagcatactcatagaagcaagttagaatatgaatttctaacttcagataaagcttttcttaatatcagttaatatacatctcaaccacagttaagacacgtatcttattcttaaaatgtttcatatgcattattctggtgagcctaaaaattaacacacacattaagattgcattcagaatcaaagatgacagaccagactgatcagttcaagctaaacatatagcaaaccatctatagatcttgctaccaactcaaacaaaaaaaaagttaagatggtttcataggaataactaagcaaactaacatattccatgtactcgaactggtagacaacatcatcatcaaatggtgagcgaattgctgatcgtgtgcaatcgaaatacttcatcaaagctggatcagtgtccccaacaactgtgacagtttcacctgcatcacagaaaacgaattccaatcagttgaattatcatattttgtcaaactctgttattattagcctgactcaagccatacccataagaggttcagttcagtaatggtatattcagacaagcatgaaccatacagtgtaattgaacaaacacaaagagagcactaaaacatctgaacttgatctgttttcagaattactagtatcacttacgaagaaaatgaatcaagttgtatcaaaacatcgcaaacgataaaaataaataaagcccattggaatctgacaagtaacagttcaactcccacttgaattgagtagagtttcaaaatgggcctaataagtggctgctgatagacataattaaaatgcagcacccaatttctgtgcatcaaaacaaaacaaattacacaaacagcacccaattaccaacgaaacgccatacctattcactgaacattctgaaaacgcacgctaaggattaacggaagaagcagaaatcaaacttctcgcagtatatccaaagaaaaaccccaatcaccaaacagatatcacagccaagctttccaaagcgcgcaatgcggcgtaccagagctgcggtggcgcggccgctgcacgatgttgcggaaggcgacgcggggctccgcctcgccggcccacctgcacggcaccaaaccaccacgtcacttcacagaatccacgtacggaacggaagccctgctagggttagggtttggggggggggggagtttccggcgacggcgggtgggaggtcgtacccgatgcggaaggtggaggcgccgttgtcgatgacgatgggggtggtgctcgggaagccggcgaagtcggtctcccggtccgggcggtaccccgacggcatgccggccggcggcgacgggctcgccggaggcggaggcggagggggtgaggggtttgaggggcactttggtaaattttgtcgtctcgtctcgctgcgtcgtcctcgtcgcgagctcgcggtgctttgagagggggaggggagaagaggagagggatattaacgcaaaaccccctgcattctactcgtaattcaacatgaggcacatactctctctatccagaataaatgtttatttttggttcttcttgtttatcaaaaataaatttatttttaaagtgatcgttgcatcgaaatttgtaaaattataaaataaatgtattgagaataaataaataaagagaaaaataattgctttgggatttgagaaagtcttttctaattagtatgggtggatgaataaaaaatgaacttattttgatattaagagcccctttgatttagagggaaaacataggaattttggaggatttaaatcctatgaaaaaattttctatgaagccctttgaaacaaatgattgaatcctatctaatcctttgaaattcctatgaaatggacaatcctatagagaatttggaggaaatttagaaagagcttcaacatcttggtaacttttctttgggtctatctctcttattcaattcctgcgttttttttttcagttcaatcaaactacccttcttatgttttccctgcgtttttgcaatatctgttttatatatacattcctatcaaaattctatgttttttctattattatgttttttcaatcatgcgatttaaagggaccctaagggtgctatcatatcatttcattcaagatttcaatggcatgaaattgcacggatttcaaatttttgctatttgcattgtggatggttttttttttactatgcagagtagtaaggtgtcactctgtctcgtcattaatatatgagatttttaatactaattttagtgtaaaaacattgtgcgtcaatgatcggagggagtactacatatgctaagcaaattttgacaacagagttcttcctagctgttctttttataatctactactacttaaaaaaaagaaacgtttccttcgtccgtttaataaataaaaaaagcgaaaaaaaaacaaaacaaaaagagtccgattcccctgaaaaaaaaagatcggatccgttaaaaggaaaaaaaaaagtccgagaaaaaacaccgtttaaataaaaaaacgaaaaaaaaagaagtccgactcctaaaagtctgactcccccggtggaaaataaaaaggagagaaaaaaacaaaaaaagaagagaaaaaaaatctgtcgcaaaaaaaaaggcgttcgactcttaaaaatccgactccctgtggagaaaataaaggcgacaaaaaaaggaaaaaaacttctacctaaaaaagaaaaaaaacgtccgactccttaaaaaaagtccgactccctcgaaaaagacttctcgaaaaattgaggatatttttgtcggtactttggtacgtcatccgtgtatggatcggtttttaaattcgttcgtttttgaccggtatctatctatctacctctacttcttctactactacttaaaaaataagagacgtttccttcgtccgtcacaaataaaaaatagcgaaaaaaaacaaaaaaaagaagtctgattcccttaaaaaagaaaaacaaaaaaaatcggaggaaaaaatagggaaaaaaactgtaatccgattcccctagaaacgggaaaaaaaaagtcaaattcgaaaaacacaaaaagtggcgaaaaaaatagatccgatcccttaaaaaggggaaaaaaatcctattccggcccacgcacggttgttctgtttttcttccttttttcgtttcttttcagtttttttctttcctttttttgtttttttggtttttttatttcttaatactatgtatatatacaaattttatatacacgtatacaaactttgtatacgtttatatttttatacgttttgtatataaactttgtatacatatgtatctctactcctgtccctacttaaaaaattcacatctacagaggtctgttcgattccgtggcaaaaaaaaaaggttagtaaaaagtaaaaaacgaacaaaaaaaaaataaaaagggcggaaaaaagcgcggcaaaaaattcgatttctattcgttttaatagtccgtaaatatctcttctctatcttaactaattaaaagattcgtatttttcgtccctccatcaaatcctaatctgatttcgattttgtgaatgatcgaaaaaattgaaaaaaaaaatagaaacccaaacttcaacacccaaaaacaccaaatatatcgaccaaaaactccaaatacatcgagtccgtcgccgttgcttgggattgggttgggcgccgccaccgttgccgcctgctggtgatggggaagggcgccgccactgccaccggtggtaggggaggacgccgccgcgctgccggtggtggggaaggacgcagccgcgctgccggtggtgagggaggacgcagccgcgctgccagtggtgggagagccaccgtcgccgctcgcgggggaggacgctgacaccgccaccactcggggggagaggcaccgccaccgccgccactgctcgggcagcggcgctgtcgctagggggagggcaccgccgccgccgtcgctcggggggagaggcgccgccactgccgccgctgctcgggcggcgccgccgtcgctcggggaggggggctgctcggggagaggcgccgtcgccgccgcttacaggaggggcgagaggcgctgccgcagccgccgccgctcgggggagggagagtggtaaaggagggggagggggtgagaatgaatcctagggttaggttttgggtgtagttatttaggttaggattaatctgggccgtccattcgatcggacagctccagctgctcccgcgtcgggccgccggcctattgggccaccgaatggaccgtgtggtcgatatcaagaggatgcaatggacttaacagagaaaggaaacaagccagatacatagaatagacgtaagggagagaatataaactttctatattcggcccaaaactgaaagggaggattttgattcctttttccaattaaataattgttaaatgaggtttgtattattaaaattagcaattaagctctgaaaattccaataaaattctaaagagcttaattaaatatggagaatttaataaaattaaatttaacctgtcattttatttattatacttgctttacttgtaaattaattttttacacaagggagggaatataacctttctacataatgtaaatttttcttaacttttcctttattttctggtctatacacttcccgttgcaacgcacgggcacttttgccagtggaatataaaatcctggagttcctcctaggtgtagtagcaaatactccctcaattttactatacaatttattctagcatttctcatattcatattgatgctataagataagagaaatagtaagtaacaacatagccatggaaagttggacacaatactctgctctaccattagcaaacaaaatctgaaagccacgtcactgagcaggtacctatttcatcacaaacacatgcacatatatttgatcctcgttacgaaaacttacaaggaaaaaaaaaaaagagatcgtatgaatatcagcgaattttttttcgcgaacgcgaatatcagcgaattcgtcaacatcgatgcaaattctctcgttttcaaatatcgatgcaccaagaaatcccattttttgttcttttaaaactgcagagaatacttcttgccggtgaaccgattcccatcgtctttctcgccggacttggcctccttgacgccaccaccggcggcaggagccgacgagccaaaccgaagcccccttttgggcggcgccgccgccgtcgccggcggcggcatcgtcttcttctcctcctccaccggcttgccgtccatccgcatcctgaagccggtgaaccgggccggctccggctcgccggcgccgacgccgtcgacctgcatggcggcggcggcggcgggctccgcttggtcgagggcctggtcgaactcgacctcgcagtcggtctcgatgacgcagacagcgtcggccggcctcgtctccacgacgtcgaggtagtagaacctgtcccccgccgccacggcgatcgtctcgccggtcgtaaggcagaagtagttgcggaagttgtactccagcctacacgcacatcaacacaacatatgtcaaccaatgtcgaataaaataatagataatatagcaatgtttattatgataattaaatgtaataattgttagtggatgataatgtgatatatctgtacgttaagctttagaatttagtaagttaactttatagtaggaaagaataaccaggcttagtaatttcgttgttcatatctacgacggggcatcgaaatttcgatcagaacttttatggaatttgatcaaattttgattaaaaaattgaaaatttcggacgaaatagttcggtgccgagagggcctgaaatttcaaaaaattcgaacggaaatttcaataatttagtcataatgatcgtattcagtcagtattgaaagttattttgtcaatattaccatcagtagaagatgatcctaactgttgttctatgagttttagttccagtaaaaaaaatctgaattagaaaaggtgaacaatttagattaatttctaaagaaaaaaaaaacttctttcgatagaattacttacaggtatcttggttcagaaagcttgtggaagtcagaggtgtgaggctgcagcttgatgaaggtggccttggggatcgacgtgcttcgcagcagcacgagatcgttctctcgcaggcccaagtgctccatcatctgaaaatattcaggaacaaaatataaatcagcatcagtttatgttaatgctctgaagagttgtttaaattaaatttgtatttgggcaaagttaatttgatgttcttctatgaagagtatactaaccatggtcgggatgtggatgaagccctcgtcggcggtgaactcgagcacgccgcagtacgaggtctgcagcgtggtggcgttctgaatctgaaactgcatcgggtactcgatgtgcagatacccttgaaagtaaattaaccacaagcaataacatcagtaatttaaccaactaatttattaccagatgatcaagtatgtacggaaagatcgtttttttactgaagatgttaggaacttaccgagccgatcaagagcagatacaggcatgaagactgcaaacaaattaaacataagcaaaacttcgtaatattcagttagaaaaaaaaatagattgactactgactattaataacaggttaattagcaacttacccctgttgccatcgtcggcgttctccttcttgagaagcgagatcggcaagcagcggtacagctgcgcgaacgtcgccgattgcaagttgagatactcctcgaaatcctgcacaacgcattcaacgaaccagcaattagattagaagttcagaaccggtatcctaaacaactccagtatatgcatgaatcaagaacataattagcatggtaatatatgcaagaacaatgacagattggttgcgctccaaagaatcgaaaagatggaagagaaggggataaaacaacaacttggattaaaaagatttcagagcaattgactgacataccattattaagatgaactgatgaagtcagcgactaaattaattggctgccgatcgagttagtcaaatcccctcttcttcttccgatggaattcgaagaacacacgacaaatcaatagaacaagatcaaaatcaggtattcaggtgaggcttccagatatccagggccaatataaaccgcctatacgaatcgccctcgtatacacgaatcagtaataaaccgcgtaggagtccaccacatcaaataccgggcccacatgtcggtcagaccgcaggtaggaccagccaggcaagcggttctccttccctggctgacatgtgggcccgcacgccactcgcgcaccgggccgtggtgatgggcccgagtccgactcgaacccgatctcctctcctctctctcttctcgtcgtgcgcctcctccccgcggcgacggcttccgcgagccgcgtaaaccctaaccctaaatcggtaagcgaagcagcggcagcggcagaggcggcggcggaggaggaaggtggcgatggcggcgaaacgggagctctcgagcaccctcaggaacctcaaggcgaggaggaaatcccttggaaatgttgcctcttattacatccgcacgcgttgctatctcgtctgatgtttttatttttgtatttgtgtgcgggggggatgcagtttatgcagcgggcggctgttgcgcagaaggttgaggagaagcccaaggttgaggcggcggcggcggcggcggaggaggaggtggtgacggtgcctagcggaggtgttggctcgtcggttaaagtcgctcggaagtggtatggggattgaaaggctcgtttttttaatcgtttatgctgagttggtgtttttagcatggtattagagattttgactctagggtagcatgggatgttttgtatgctatataacaaggtgcgatgaagaattggagattatgtttgagttaagctgaatctgttagatgaagattgtgcctttttgggtttgttagatgagatatctggcaaaacctcccatctaatttacttcttacctaattacagagaatttgggatttctggctatgcacctggacaagtactcgtctaagttcatagctagaaatgaagtctttgtgggacggaggtagtagaaatgatactttgtgcttcagaaactataacattcatgtgtatgtccataattggatacttttttttaacgttttcttcccagatatgcttcacactaatcagctaaacatgcatttgatgttgtcatgcaaattcattttttgggtttagttttggacacgcagtacttcattaccaatacctttctttgatctgtcaatgcagactaaaccaatactaactctttcttcagcgtagttatcatggagggtaatccacaccctggagctgcaaagggtcgaatgtcattcctgaatttcaacccatccattgatgtgagatttcaagattatttttttatatcttgttatttgcaatattgtcgtgttccctcacccaaacctagaactgtagaaattaactcaagaggcaacgggtggccgccaatcacagttagcatcacctagtaataatcatcaggatggttcgaattccagcaggttagctatttaccagctcttttctgtgctgtaactgttgttaacctatagctaatttatctgttacaaaatatagattacctgtcacaatatgtggattaatgtcgtgagtatgtgctaagagttatttagtttggacttttgatcattgaactggaaacataaccaaagcagaagagcctgaagctcttacatagttaccagacttgacattattaacattcatttagtgcacttcagccttgtgaaagatgaatcacctgttaataacttcactgcagctttgacatcatgtaaggtagaaatctaagcttgaagtgattgatttgttaaaaaatacactcgttgtggcgctaatgttggatgcagagttaccattcattgttagtgtataactgtatatcactatatccgtcattactggtagcttgctctgagtagttcagacattattgatgtattgctatagttaacattatttgctaaaagtaaagcttatacaactaatgctattctgaagcttatgagttactgcatattcacaaatgaggaagctttttgcacaaatggcatgaaaaatctagaatgcatacatttttggcacccaaaaaaaaattaatgaaattctttagtagaattctgattcagttcggtcagataagaaattaacaaatcactactatgcaacacaaaaaggtgtagccttatggacacaattcaccaggagaacactttcatctgtactttttatgaaaatgctaactacagccgctcaaaatcattgtgaggcaattgaatagcttgtggatgtaattttgagccgctcaaaatcattgtacaagttcttatgtggcacatataattttgagcactttgaatagcttgtggatgtaatgaattttcacgtgatcccttttacaatggaaatgcagaacggatgaagtatcaagaacaagatttagtgacttcaacattgatagttcagaaagcatatctctgaatgaactaaagaggaaacagcctgagcttgaaatggaaacaccaccatcacataggcagcccaagaccacaggtaagagtatcgatggtgattcatcttcccaaagcaatggccgtgggtctcacaagtcaaacaagcgtgaaaagcttgactggaatcttcttagaccacggaaatcaaaatgaagtccggagttagcgtagccaaaactttgctcttgtaccccatttgtactctgtatctgattagcattttctcctgtttcgcgagttatatctagaaagctggtaaccagtagtttatttacagtaaaatgtttgtccttgcctaatcttggtttcaactgttcccctgttcttgatatgttgtttactgcattactttgctgtaacaaggttctgcagcagcaatgagaaattacagttttgacagtggttaatgctgcatcctggatatatgttggaagtgtatttgattgagatatgattgccttgccttcctttgcacccacggtttcatttgatctcgtatgatttacagtggatttgcttgcgtatatttcacacttggaattggaagcaattgaactgcgtgagaaagcacgagatatccacaaaggtcccgtttgaatatgctaaaaagggatataaaattttggatactcttggcacacttttcaaattgcaaaacggtaaatttcatacgaaaactttctatatgaaagttgctctaaattatcaaattaatctatttttcacgtttgtaataattaaactcaattaatcatacgttaatatcacatcggttgatgataatgcctaccacctgaataatctctcccctttgggaaggctctctcaagtctcaacccaaggactcgaactggctggtcccacctgtcattggctttaatatggtcgacgcatcgtcctgaaggtgtctgcttgcttttctttctttctttttttttctctcgcttccaagttacgcccgccgttaaaccctagctccttccccggcggcggcggcggcgggagggggcaggaagcccggagatgccaccggcgtcgtcggttgcgtcggcggtggagaagctgcaggcggcggcgcaggacgcggcgaactcctcgtcgcgctcggcggccgccttctccgagcaggcgcaccaggtcctcgtgcccagggccgcagggtatactctcctctcctcctcacttgccctccacctactctagcttgaatgttttcgcacattggagctccaggttcagctcaatttcttgcttgccttgaattggtttggtgctggatttgcagtatcgaatgactccaattgctcccgatttgtgccatgtagctactatctgaaataagcaaactgcaattaggcgtgtttacaaaaactgatcagagtttgatagggtgatttggtatgtcctatgaaaagccataccgactgagggattgtaaaataggtcaatagctcgaagttgagaagtgctcttcgcaattaggtggtgcagtgttcaagtaacttttggcatcactggcatattgagttcctgaattcaggagtattgcaagggctcgtctcaaagttgagtgtattgatatgttgcaaggggtctgtatttgtatagctctcgtgtcatacaagatgcaaccagaagaggcaatggtgagttcagaagaatatgagcagattccattgtgatcctagcagctcattgagttcagagtagataaaattttagtgtctttctagatcaaaagctacgaggtttaagaccgtgagagtacttgattgtgattgagctgtgttcagaatttcagttggatgaacagtgaatatattgattgtataactgtgtttgagttgcaaaatagcctagagtttgtgtgcattggtgctgctgttactaaatctgaaagcttaacaacaagagctagacatggttgcataccctatatatatattctgcatgcagctttaagagcttattaagtaagttgcactgcctcaggaaaatttatttggcacaacttttcaacatttgctatcatttccaggcactgataccattttattcatgaaccatgtgctcaactgtccaacaccttagaacctgacaatagttacacttgtgttatattctgtattgcagtcgtgttgtctttctatccacttgtacgaagatcagcgccgtcagctttgcagtcggtgttgtggtgggcttcacattgaagagaagactacgccggtgggctgctaggctgctgaaaagaattaaggacgatgactagtgaaatcttttcatgccatgttgttctcaagttctgttgagtgttgagaactatgtttggttgtgcatcgcccgcaaattggaatcctttttacagttagataaaatcgcaagcaagacaaacttatggtttctaagctgtattacacatattttgtaggtccgtaagccttagaattgctactcagaatgtttgttttctgatgggtgatttacaaattctatttatcccccttttgatagagtattcagatttgtgacagttgactcaagcgagtgtactttgttttactggtatacacaatcaacttaaatatcttttagaaatacaaattagaaataactaagattagaaattagaaaaataagcagaatttggagaagagtctatagtatatataggaatacaattcataagtaactgaaattcgaaattaaaaataagtaatattagaaaaaactctaaagtctatataggaatacaatttataaataattgaaattcggaattaaaaaatacagatattggaaaaaaatagagtctatatagaaatacaattataaataaaagattgggaattagacaaataaaaatattggaagaagagtccatagtccatataggaatatagaactaagtgaaagttgaaattaaaaaataattaaaagtagagtttagagtctatatagaaatacaatttagaaaaaaaattaaaaatttaaaaaataagcaacattgggagaggagtctagcgtctatatatgaataaaatttataaataactgaaatttagaattaacaaataaggaatattaaaaaaaggtatagagtccatatacaaatacattttataaataaataaaattaaaaaaaataaatattgataaaaaggtctagagtccatacaggaatacaatttaccaataaaggaaatacaaaattaaaaaaagaatattaaaagaagagtttagagtatatatagaaataccatttacaaataagtaaaatgaatattggaagaggagtccaaggtccttataggaatagaatttatgaataatgaaaattcaaaattaaaataataagaaatattgaaagatgagtctaggtctagattggaatacaatttataaataacttaaatctggaattataaaattatttattact

SEQ ID NO: 51329 - DNA, 21579 bp, Oryza sativa
acccttcgacacccccctcctcctcttcagatctctctctccttgctagcaagctcgatttcttagaccatggaagattaagatcgaattctcaataagctaatcattcatggcggcagaagccagaaccctggtgggtgctgatcgcccggaacccgaaggccgccggggcccccccccctttggtgccggccggattaccaccggcttcgtaaccaacaattttggccgaatggtccaacccgcggccggtgggcttctcgccgacaccttctaccggctcgcgctctccgggaccttccttggcgggatgaccctggtcggcgcttcggtctgggtggccgacaacccggctgcccgccgtgccgccggcaagaagctgttatacaccgccatcccgccgctcctcgccgccatgggtttatcggtggtggcgctgctctggtaagtatggttctcgaacaggctccggtccggccgcaccgctgtccgcatatccatgatcggagcaaacaataataattgccggcgtctctctctagcttgctggtcgatcgtgtttgtgtgattgaaaatgaatatcatattcttcttccatttggtttgctcgtttgctgcgtcgtggttgtgtcttgtcgtcgtagcatgttctgttgttgcaagtagttagagagtccactgttctgttcttatttactctgtctcgtgtgcttcgattgatgaccggcttaatcgaccagtgttctatggagtgttcatcatatctctcgatttcaatttcaagtatatatggtgcttcattttttttaatgagatgataaagttatggtgattgtactcctaattttcatcttacttgcattctgcgaatattggatttggaatactccatggatccatgcatatcggcaccgccgccggcgagcatggcgccgtttctcctcaccaattaattcatcatcaattcaatcgcgccaccgctgccgcccgctggtagtaccactgtttcggtggcggtaggggactcgttcgttgccatggaggcggcgtcgtcgccggcgtggcgtctctctgcgccgctcgccgtcgacgccgacgccgaattgttctatttggaagcttctggcgcttctccttctagaagccatcctttcctctcttttttttcggtttttttgggtgatacaagtggggaagggtgggccatacaagtggggcccacatgccccctgaccttgttgtgttgcgggcggcggaagaaaattacacaggacctcagtccttcgctcatctggaaagacttcattttgtgaatgacacgtgttcgcacgaatcttgaggcagacaacagtcgtcttctacctcagactaaagtaccaaaataattcccccatctctctctcctctccctttccacttcccagtccggcagtccctacctcccctggctcccttctctatggccggaggcccaatctccagcacggaaacatggttcgtcgcctcttcctcctcctcattgtcacgtcgcgggatgcaacatgatgctgtacacaatgcgacgaaaaagttcagcgagctcgccgcctcctgcaagtggaaccttccctggctaagaaggaggaaggaaggtgggaagtggagaggagagagaaagggaaagtttggcactctgcacttgagctcaggtagaagatgactacgttaaaattcgtgtggagacgtgtcactcaagatgacaagtctttctggatgagcgaaggaccgaggtcttgtataattttcttccgcgggcggcggctacggccatggagatctcgcgactcgcgggtcgcggccatgtgccggtgaggtcggctgcttcgccggcgtctccgcctccgcatctacgcctgattgatcccccccaacctatctccactgtgctatcgcgtttcttgcggacttgcggaggttgtggttgaggcagtagcctgtggggcggtgatgcggcgccgagatcccgctcgtccacggatttccggtcgccatcgccgggattcgtcttctccggccaacccctcgccgcgccgcccgtcctcggccaggatctggtcgggatcgcttgtggtaggtgttgggcacttggggtttgaaagacagcatcgttgatgtgctttgagttcctgcctaattgacttacgctgactctgtcaatatcaacatcttcagttactattcccataatccctaaaatcccagcagttgcgtggtaggttatgtaaagcgcattcctgtgatgaaaaatagaccctaggagacatataatcaattgtatcaagtgatccaacacactaggtccccaaatattgtcgtagataccattttctcttcagtattctgtttaaagactgatattggtctttggatgatgtgcttgttcatcgcaccagttgatctttactattggtgcatatttagttccaaggcgtcgttttagttaagctgctgaagcgttgagcatcttgtcatgctgatattcttatgagtggttcaagatggtttgttctgttttagtggaagtgaaagaaggggctgtcccctgcttatgggaagagaaaaagagatgtattttagcaaccatgtgtttacagtacaatccaattagttcactaagctattatttatggctgttatatcctgttctgagtatttatttgttatactgtaatggtattaaatttctggcattgttatacatgattatattcgatcatatacagctattagtaattcatgtagttagagctgaatgggagttttgctagaaagacattgcttctttcaacgacccttattcaaacaaaattaaagtacctttttctctgttgtgctgattcccattgttacatagctgaaacttaagtaattgcaaaatttgatggaactcatatattcttctactcttataataagggaggtttgtatgtagctacactcatgctatatgcatgcgctctgtctatctgacttttgtatttacatttgtattcaagacattgaggtcaactaaattctatgcccaatggtgcagccatatttcatacatgaatatggctatctctttgcctggtaggttatgaaatatgaactctatgtgtttattttgatgtgaaatggcctcagggcaactcattttgatgtatgagtatacatgtcaatccacacagtaggtcctgagatattttattaatgaccttttcacttttcaccatccttcacttgagaatatgctctggttgatagtagttagtttccgtgctttgacttattgccgaacccttgagagcatcttgtaatgttcaactcttatgaattgttgatgatgaccttatctcttttgatgaataggatgaatagcggcatggcaacccaagggccaaggccagagcactagggcctagagccgcaggagtggagctagagcgaaacagagggtggtgccacttgcttaatttactctactttagatcaagtttaagctgatacgggtgcttaagtttgtattgaggagggtgcatacatggtgaaaataggtaaggtatagctaaaaaaatttcttgatcgggttcctgggcacccccctaatatatactagctccgcccctgcctagaggcattcctagaaacttaggagcaaacgaagaaaggtagcagaaccagtgtagaggaggcattaggagaaatcttaaggacattgggtaactttgaaataccataatgcgtctcataaaaaatattctaattttaaaatttgtactatgtaataggtggttaaatgctgttcttctgagtgatggagttgcagattgtaaatcaatctttacttatacaaacgatgggccaatcattggcttgttctcgtctcttttttttttgggtcaaaatgaattggaatagcaggtgcctttgaagtgtaaatataacagaacaagtgggtaaattttaatataattccgaaagaatcatcatccatgtgtcattttctttttcatgcaatgaacaacagatttgtatatatgtatttttaccatcagtaacagtcctttattaatgcatagtatgtggttctgcttttctgtagggggacgttgagttgtaagaactaagaagaccagatgcatctgctcagattttacaggcctgtataaccagttaacgagtggcaaaaaaaatgtctcgcggccgtgtctgatacataactttgccaggagatctatctgttgatgcacacaggctgccatggcattgttacccagttgctcttacatgcatttctgctggcataagatggtggaggttctgttgttgaacctggaacacaaccggtgctcagaagaattttgtatcactacaacctatcaggatttgatcgaacaatttggtatgttcatacacatttgagcaattgtacagtactccgaagttggtgttttctatcatctggtaattgtggatcactggcatatcgaggaattgtggatcactgacatatggaggaattgtggatcactggcatattgaggaatcaacctgacatataatattcagggtgtcttttgtatacgtggagactgttgtgtatgccatttttctggaatgtcatgtaatatcaacgtatccgtatcgccgtaccagtatcacgtatccgtgcatcacaaatagccatattattttctatatcgatatttatgattaaattgagttaagaatttcttttgttgtgcggataactgcactgattgcaaatctgccaatgagtactacctccgtcccaaaataattgtatttctatgattcaaactttgtcccaaattaattataattctagagcactaattgccccatcaatcatctctcattcaaatttcttcctattataccctcaaccatctttccactctcacataaacaccatttaatgaggggcaccatagtcttttttctcaaaccttaatatatgctaaacaacatagaattacaattattttgggacggaggtagtaccaaaatattcgtgatttagtgcattgtgttcctgtgactgaatctgaaagtttggcagctagaatgaataccaagtattgttgtgcatatccccgtggaataagtctatttacctccatcattgaatggtttcccttaaccacaaggctgggtattacgtcatcttcacaaaccagtgcaaattaccttcttcagtggtttgacaatcggtttttgttgacgtggctgcttgattgcagttgactcgccgagttggcaggtgggatccacatgtcagcgacatccacctcatatcatgcttttctccccttctctttcctttctttaatctcccttctctctcttaccttccagcagcaacagaggccatgagggctacggtggtagtgagccggattcgggggtggcgacgacaaaagaggagggaaaggaggatgtggagacgaagtagcaatagcagcaggaagcgactgcagcagcgagagagagaggaggttgtggtggcgcgtcgaacggaagcagcaggtggctgctgtggtggtgagggagaggaggctgggagacgacggcgtggaagcaacaacagcagcaggcggtggcgttgaagtggaaataataggtgattgcagtggcggtgatggagatgaggttgctacgacggcaagggagaggaagtggcggcatcgaagcaacagtagtaggcaacgacgaggaagaggaagtggcgacatcgaatcagcagtagcaggcgatggtagtgacaacatcgacgcagaggaatccgcggatactcttgatggcttcctcatctccctcctctcttcctcgccggccatcgaccgtgctactgccttgcttgacgatcactagctgttgtcgtcggcttcgtctccggctaccaccactgcagcaacctaggaccaacctgtgactagtgtaaatggagtggtatatgtaagtgggcccatctatcggatgggctaggctacgcggttgtagaggtagggctgttacacgaccggccgtcttcctcgttgggagaacaagattgggaaaaaaaaaaggaaagaaaggatagagaaggaggatcaaatgtttcactgataggtgggtcccacctatcatgttgataaaacccgttttccaaaccaccgaagtagtcgatttgcactggtttttaaagatgagggagatgctatatctagttttgtggttgaggaagatgattcaatcgggagtaagagatgagagaggaaaagtagacttgcttatctccgtagcccggacatgatccaactactaagctcggacaaattacgtggtccgactaaggtgggtctagttctcgaacgttcgcatctcgcaaaacagttcaataggttttatcgttatcagttctaacgacgtgtttaagctcgtactatatagtattttgttatttcagttagaagaccaaccaatcactttttcctattatcaagttgttcagattggattttatttcttgaaaaaaaaatccagtgatgcttaaattttttttatttatactgaaatttatacactaataattaaacttctaattgcaaattataattcatactataaagtttataaataaaaagtccataatataaagtgtatatacttaaaggctctatgcatagaaagtttatatacataaaatctatatatggaaagtttatacacataaattccatatatatagaaagcgtacatgtaaaaaagtaatacatgtaaaaaagtttgtactaaaaaaagctataaaaatgactataaagagaaaaaagtaatttaacaaaaagaaggggaaaaaatgatatgtaccgttaggagaattaacgtaaaaaaaaggaccacggtaaattgaaaagaatcacgtagaaaagaaaaaaggaaaattaggaatgtaaagacgacgccgtaacgacgcaacacacctgtcacgcatcgccacgtttccttttgtctccccaccctgacctgtccgcgcgatggacaagtagcgcacgtcgcccaatagtcaatccgcctactacggttggaataagtcaatttgctgtccctcgaatttacgttgagtccgatagattaccagatttgccctttgtactgcttagacctccccagaaaacgtgtcacccccggttcgcggcggctcggccgagtccagtcccgcaggggcaaaaccgtccttcagactctcctcccgataaccggcgccgcccagcccatcagtccgtccgccccagaggccccaactccccaggtccgtaattttgataatttgaccctttgaaaaaacttattttgatattgatccatgtcaaaacctattttcaaaaatagaccttttttcgtgccattcgctgagctacaacatcatagcgccacttactttggcgctgagataccgtccgacatgtcactggtgtcacacatcatacgatgtcagcgccaaattctttggcgctaacctccgtggcttgctatgtataaatactatgcatgtactaccgtgatacatggaagatttggcctagtggtgaaagcccgcctctcttaactagaggtcaggcgtaccacgaagatgttagcatgaagagctctccaccaagctatctcgttttttttttcagttgtggtagcttgtagcttgataatatttgtagactggagagaggtgacctcggataacgtgtaaaatccgtgacacctcggatggcatctcagcgtcaatgatagttgcgccaagacgttatagctcagcgccaaccacaatggcgctgagaaaacggcctatttttcaaattagtttttggtacagttcaattttgaaataagttttctgaaagggtcaaattgtcaaaattacgggaggtcttccccttcgcatccataaaagcagcccgagccgcgcgtgatcccgacgtttctgtagcttgatctttctagcatctctgctactgctagtactccaaccttctcaattccctagctttgattctgaataataggaagacccacacatcggagatgatggttgacaatattgctcgccgggaagcggaggccgacggcggtgcttccaagatcgcggcggcgctggggctgttcggcgtcgccacggcctctctgatcatcaacctggtcgccgcgttcgacccaccgcagggcttcgctgaaagcgcctgctacgacctcgctcttgtggggtccttcctcgccggaatgggccaggttggcgcggccatctgggtcgccgacgacccacgcggccaccgtgccgccgtcggcaagaagatcatgatcgcctccatcgcgccgctcgtcgtcgccatcggcctcaccggagaggcactgctctggtaattccactacacgtaccaacaccatggatcggagcgagtgtatcttgtactactatcttacttagtggagtcgcgtgatagtgtgatgatgctttttacttgatgtttttgtctactggctactgctgtttgtgttagttgatcaatgcttggattgatgaatatttcatgtaaattttaagtccatactattgtgtactacaatcaatgaaaaatttctcaaaaaaaaaaaactgctaatgaggggaacagagtatatggaattttggagtactccaattttcactgacgccggcgagcatgcgcttcctgatcaccaattcaaggtgcacttcccgccgccgccggcgggggtatttaccgctccggcgacggtggtgcggccggcatgccgccgccttgtcctccctggggaagcagccgctgtgagcctgtgactcatgcaacggccaaaagggcactctgttttttttttttaaagattctgatggaattgttggaagggggagtaggccatatttaagtgggccccacatgctaaaaattttccccaaaaagggaagggaggagtaggagatatcataggagcggcggccatggcgccttcgcctgtcccgcccactccatgtctctgtctcgctgctgcggcgccttttctacaccagtttgccccacctctccgtctcaattcgcgcgtgcggcggtgacacggcgcgcgagatttcgctccggctcggccacgatctgacctcgtcggcgccggcggaatcctccgttttccgcggccacccccttgccgcgaacctgcgccgggaggacctggttggcatcgccgttggccgtcgagtctgtgctattgcaacagatctgtggatagtactccctccgtttcaaaatatttgaaaccgttgactttttagcatatatttgaccgttcgtcttattcaaatacttttatgaaatatgtaaaattatatgcctacataaaaatatatttaacaatgaatcaaatgataggaaaagaattaataattacttaaattttttgaataagacgaacggtcaaacatgtgctaaaaagtcaacggcgtcaaatatttcgaaacggagggagtatgtgattttttgtttttttttccattggaggcgttgacttggaagaacatcagagtaccagagccatatctgttccgattttggaggttcatacattacaggtatctgcttgcccttacatagttacgtacatgcatttttcattggcaaataataatccttgggtgatgatgatcctgttgttgaacccttgaactgaaagacaacaggttcttaggggaatttcgtagggtgtgatagcctatcttacaatttgatagggcaatttggtatgttcggtgaaaattctgtagacatttgaacaattgtttggtgctgcgttttctgtcctctggtaattgtgaatcactggcatattcaggaaccaagcttttgtatatttgtcatgctcttgtatttgtgcacatgtggatgtggaggctggtgtgtgtatgacaatttcctggcatgtcatgtaatcggaagcattgtttcggagagggaagggcaatctcctttctaataggcatttacaggtttgcttgtgttcagacttcagactagttactagaaaatggtgcgccagttggcgcacctagtacttttatagcctgtatataacacttgtatgtaacagttacgacttagttacgacttatttagaacatatatttattagttttcaaggtatcctataatttttaattctgtcaattttatccgtttttaagaactcatgaaaaatagactatatattttctatggtttgtttagaacacaataatttggcacagtcaactgctagttcaattatcgtaaaatttatttgggatagagagtttagttttgtactaacttctcgaaggtcaaaatatttctaaatatcttaaggaaatttgatgtattttggtaaaaaaaaaacccacaaatctgatttttattttctttacctctgcataatgtttagtgtctctctgggaggggtatgtgtaaaaacatcttaatttacccaaccgagtttcatatgcacaccacatagcaaattttagtttgatatatgcacatgaattacatagcaaaattacttgtccaacttataaacaaaagcctacttattaataagttttatcttagggccatttataaatactacaaaccgagggcctatttgtacatttaaattttgagaggaaaaaaagaccagagtcacaccctttataaatgaccctcggtaggcctatttgtacatttaaaattttgagaggaaaaaaggatcagtcacgccctttataaatagctctcggccaaaacgaagtattatcaaatcggagggagtagtgttgaacaaatcattcttcctaataaagcttattgtttttctccaccattctctgtctcttatttttgtttcctccccgctgcccaagctactatattgttcggaaggctgatatgcggctgcggctgtacaaccaaccttgtctttgcttcttcgaacatgcatgttgacagccatagcacatgctgcattgctgccaaacaggtctattgtactaaaccaagcctatatgacacatgccggcgaactccccctctaaaaagttaccgaggcaaaaagaaacgaaaaaagaaaactaaatagagagacatattgtttcgcttgcaccaccggtacaccgctactttgatctaaacaactgaacacactctaacacccaataggggaaacctgtccaattttaatgagggtgaaatgttaaccaatcagcttgtgcggagtgcgatcagctttagattaactgataatagcttatattgaaaaatatagtttgtttttacttcaacattttttaagtgtaaatatgatactatctaccaattggcaacgtctagagtcgtatttttaaacatttaacaccgttttcatattaaattattattttcctattcttttttaatttttatcatgagattttgtattttattaagtttattatagcgtgaaatctgttaataactaacaatttattttatttcttctctcaccaactactgatattccctactgccctggcagggagcaccactgggaatagagcagcagccagctcctttttatttttttttatcagcccagatgaataaaaacggcacaggcctaggcatggcccaaatcgcatgcgtggctgccctggaataccgctcgaaggggcgagaagatgtgcgctagcgcgttagaaagcgattttttaccatcgtaatttgcatatttatcttaaccttttttaatcaagtagaaccgtagaaggattaggaggccacatggcacgattttagaggaggtaatcctggaaccaggtagtgccacgtggccctataagaggcccgagatcgcaccctgaaatcgtatataaagataaccatatgctattttctatatcgatgtttatggttaaattgatctaagaatttgtcttgttgtgcggataactgcactgattgctaatctgccaatgagtgccaaaaatattcttgattcagtgcattgtgctgctgtgactgaatctgaaagtttggcagctagaatgaatatcgatcaatgttatgcatatcccgcggcccggacatggtccaactaccgcagtcaggtcaggcccaactaaacttggatggcaactaactgtagcgatccagattcacggtcaccaatggaaaaagtccaatttgtctcccttaattgttcaccgaatctaattcgtgactcttaactggaaaaccgggtaagatgacttcccgaattattgaaactaatgtaatttgactcctccagcggttttggagggcggtttttgctaacgtggcagcgctgacgtggttttcattccacatggcgtttatgtggcattagaattaaaaaaatatctatgggactcacacataaatatattgtgggacccaccgacatgtggggcccacatgtcatcctttctccttcccctcttcctcttccctctcttcctctctcttttctttcccccttttctcttcccccttcgaacgcatcaccgtcacatcggccacctcctctcctctcccattgttgccgtcgcgccggctgcctctctccccctctcctgccgccaccgccagccgccgcttccctatctgccgccgcacctgcttgactgctcgagagaatcaaggagagaagaggaaaaaaaaagaaaggagagatgtgggatccacaccattttctctcacttacatgtgggctcgacatatttattttaatttttttgttgactaggctgccacgtcagcgaaactaggcatctatactgtctcgggacttttttttggatggttttacatagtttaggggtatacatttctggtattgcggttaggggacctcaaacagactcggcgtaaagctgagagatggctgatgaacttatttctctcccgggtgcctggcccaagcgggcgctgaatcatgtgtagcttgtgcagttctttttcttccggttatttgtttgcctcttgatgcgatatactgcactactcggtatacactagtttgctctatattttgaattttccatgtttctgcatttcaaatgtgcaatggaataattaaaaatgattcatcgaatggaaactattgactgtgagattttgctacatgattatgggttttctgctgcttctttttttttttccgctgatgccttatagttttttcatgggagagaattagggaaggcaatttcccccgcggggacccgaccctatgggggcggggggcggggacgggttaagtttttgacccgcgggggaggcgggggcgggccccgcatttttacgaggaggggacgggggagacagttcacccgcggggcccgcgggtgtatattaacccttaaaatgtagcacatagaagacccaaaagagcccaacccaataaaataaagataaaatgaaaaggaaccctagccttatcctcaccagtgtcttcccaactcccctcctggctcccgtacgcatcatccaccggtggaggcggtgctaggggccagggcgcacgagcacacgacgcacttttttggatctcgccggcgccggtcgccctctcccctcccctccggccttccgagtcccatcctctccaatatccctctccggctctccctcaggtctgccaatgaggcgacgacgcacaggcgcacgggcgcggcgaggacgccgtcgagaggcgagggtgtggcgcacaggcgtggcagccggcaaggggaccgacgtggcgtccggcgagcagcgaggggataggtgcgcatgaatcgaatgatggatcaatgtgttcttggcttcttgctgaattttttgatgctatttatttttatggtgttaattatgtacaatatttgttcttgccgaattgatgattgtcttgtaatttttgtgctgattggatggagatgctacctaatgcagggccccggtcgggttgcggggccccggaggggtccgggatgggggatgatgtcgggggtcgggtgcggggccgtttcagcccaacccggccccgccctgccccgttgccatccctagagagaatatgataggtgagcccactaatttttaaaatataatcgttgaatgttgcgcgtacgtcatgtagaacaaaaaccacttcagattgagaggggtgaggggtaatttggtttgagtagttgggtgtatcaaaatgtctggtattcgagatcatgggttagttaggtcgactgcaataattcaagggttaattcgaacttcttcctcttataatattattttgggagttcaacaatcaatttaccatgttttcacggttcgcttaatcccataagggattagggggattaattccatgttgcaatagcagttgggtgaaggattaaacaaacaagacctaagtggctaggtgggtactacattttgcagttatggctagttctatgtgtcggttgattttatcagcccaattattgggaggagataatactacctagcggtttttaccaatcaagaaaggaagatataattattggtataaaaactaatttgaatcctactccctccgtttcaaaatatttgacaccgttgactttttagtacgtgtttgaccattcgttttatttaaaaaatttaagtaattatttattcttttcatatcatttgattcattgttaaatatactttcatgtgcacatatagttttacatatttcacaattttttttaataagacgaatagtcaaatatgtgctaaaaagtcaatggtgtcaaacattttgaaacggagggagtatttgaggatacgccctcgtgaaaatgaaagaaaaaggagagatagagaggaagttctaagtctcgacaaatcctaaaaccctaatatactcatccgatcaggagatgtttggaagatgttcgtgtgtggtggtctccagatagtgccattggcgccccgagggacttcgcttcaccaactaaaaacattcggcgcgacggcgacctcaagcatgttaaatcggcgtctatgcatgcttcccttgtagcagaaccgaagaaagaagaaaacaaggaagaacaacaaacggaataaatcaaagttgttggaatataaactgaattacccacattttctcattagtttaagcttttggattaaattggtcggcgtatacaacttaatgtataagtgattgcgattgactataatggctttactaaatacaagtgattgcgattgacttatcggttagataaattttcgcattgaacaaaagatgatcgtatatagactaaggctgtgttcattgtgggaggttgggaacaaatctcctatacatgaaaaacggagcgttctattaacgcgtgattaattaagttttttttttcaaaaatgaatcaatattaattttaagcaactttcatatataaacttttttaaaaaaacgtattgtttagaagtttaaaaaacatgcgcgcggaaaacgagaaagagaggttgggaactagtagaaggaacgcagtctaagacttaagtgaataagtaaactaaggctgtgtttagttggatccaaagtttggattttggttgaaattgaagatgatgtgattgaaaggttgtgtgtgtatgacatgtgatgaaaaaggactgaagtttggatccaaactttgggtctaaacacagcctaataaactacaaaagtatatgcagttgttgctgtggtgcagtggacctgctaattttgcccgttaaaatttcttcccgtcttcatgtatgatctctcagctgattggtcgagatgaaaaagtgatgacgtcaccaacgtgtcatgctaccagtggtggacgaaacgagttgagagaaccgaagtaaaataaatatagaaaaaaatacccgtgcattgcaacggaaaaaaacatgagaaatttacgtaaaggttaagaaatatttatattatgtaattaatttaaatataaaatcgcaactatacgtgtatatgatgttgaagaaaaaaagctcttaaaaataagttaaatgtggaaaataaaattttccaaataaactatagctggatttaatttttattaaactctccatgattaataacactatgtgaaatttcttcggtattttcagagcagtagagcaccattgctaatctatctatctatctatctatctatctattatattattaaaacagccttgaaaggaggcaccacgttcgctgtggaggctataaattctcacattaatcggagaaaaagaaaagaagagtccaagtagaaatacaatctaaaaataacagaaattcggaattaaaaatatgcaatatggaaagaggagtccatataggaacccaatacgagattaatcaaaagttggaataatgataaaataaaatccaaaattagaaaaggaaaggagagtccaagtagaaatacaatttaaaaatagctgaaattcggaattaaaaataagcaatattgaaagaagtttccatataagaacccaatacgagattaaaccaaattcgaaataaaaaaataaaatccaaaaatagaaaaggaaatgagagtcaagtaggaatacaattttaaaatagctgaaatttgaaattaaaaataaggaatattaaaagaagagtccatatatgaacccaatacgagattaattaaaattcggaataaaaataaataaatccgaaattagcaaaagaaaataaaagaagagttcaagtaggaatacaaattaaaattagctgaaattcggaattaaaaataagcaatattgaaagaagactccatataaaaacccaatacgagattaattaaaatttggaatacaaaataaaacaatatccaaaattagaaaaactaaaagaaagttcaagtagaaatataattttgaaacaattgaaattgaaaataaaaaaaaatatttaaagaacccaatacggtattaactattttttttaaaaaaaattctgaaattagaaaaaggaaaataagatttcaattaggaataccatttataaataaccaaattttttgataaaaataaagatttttgaaagaaaaggccatttaaaataaaacacatgacgagataaattaagtaacatgcatataaaggaatagagtggtggcggttgatacgacatataaaaattattaataaagcaccaaatagaatcctaatgacaattaaaaggagggatgttaggcaggccgtgaagcaaacgagtaaggcggttgccggagcttctagaaagtaaaaaaaaaaacccattgataatcatattcgatttttaaaatctcaatgacaattatattattaaaaatagttttgaaaggaggcactacgttcgctatgtgagctagaaattcccacattaatcggataaaaagaaaaaaagaaaatgagagtccatgtagaagtacaatttaaaaatagctgaaattcggaattaaaaataagcaatattgaaagaagtttccatataagaacccaatatgaggttaatcaaaattaaaaataaaaataaaataaaatccaaaattagaataggaaaggagagtcaagtagaaatacaatttaaaaatagctaaactttggaattaaatataagcaatattgacgggacttctagaaaataaaaaactacaatttcaatttttaaaggttcggaacttctaaaaagtaaaaaaaaaataatgataatcatattcgattttaaaatctcaatgacaacaaagaagggaagcagcgggtgagccataaaggagtacaatggcaaagccactcacggtttggcggtacttctagaaagtaaaaatgaacctaaacgataattatgttcgatttttaaaatctcaataacaataaagagaagagacagtggacgggctgtagaggtgtataatggcaacgtttgacgggacatttagaaattataaaaatgaaacccaacgtgacaataaactctaaaaactataaaatccaatttttaaaggttccacgaagaatgaatagaaatagtggtagatcgagcaagcaaataaagaaggagatgacatgagggatagcaactggtgtgatttttaaaaactatatgattaaaaacacgatgatgataaggtttggtctttcaaagtcttaagacaatgagatagctagtaaaatcatactaaaaaatatattattttgtttgggtgctagccgtgcaattgcgcgggcaacccaactagttttgataatacaaacatcattttatcatttatttaaatgagaaccctcctttctccctgggccattttgagcccattctttctttagcccgtagcaaagccagcccattaacctgacttctcctcccttccacctcgacctgcaagcgcgcatccagcccatcaagcaaccacaaagtctaattagtgtcccttctcctcctctagctgtcgcgtgggtcccagtgctacatggtcgtcccctacctccgtccaactcccgcagcttcccaacactgtcggaaaccatccccttcgtgaaatccctccacatccacggagataaaacaaaattgattgagggattttaatccttatctccttctctttccgttttttcaataattagagcaaaatcgcatcgtatcgaccttagaattaagccatatagcaaaccatagagttgtctgttatgcgtacgggagggaatcgaaccgcgcgcttaggtacaacgtacgaaaaaaagttggaaaaaacatcttaaacttttataataggtaaagataaagatatatatatttatggaaaatttgtgggctgaaaatcagattgctaaggggcgatcgatcgccctgagcgatcaccccctcctccacgtggtttgcttttttggcaccacattactttcttattttagtaaatttatacacctcaagtttacacatgtaaagtttagagacccaaagtttataagtcaaaaatttatatttccgattcaaatttgaatttgaattcaaatattttttatatatagtatttctatacatctaaggtttatacacctaaagtttattaacccaaagtttataagtcaaaagtttacatacccgtttcaaatttgaatttgaattcaaatattagtttatagatccaaagtttataagtcaaaagtttacatacccgttttaaatttaaatttgaattcaaatattttttatatataatatttctatacataaactttttcaactttattttttatttttttagtggtgtaataggaagagaagaagggggagaggagggagcatacaggggggaggggggtgcccctaatgcgcgatcagtcgcgcggtcacgcgggcgcgcgaccaccaggtccacccatactactcatacgctactgctactactactacaaatctacaactcatacactactactgctactactacatgtatatatgaatatgtatatattgtatattaaactttgtattattgtatatatacatataaattttgtattaaataatataaagtttatgcatatatatataaagtatatacatacgtgtatatataatttttatgtgtaccaaaaaatcgatgtataaaaaatatgcacatatacaaactttatatacgcgtgtataaactttgcatacgcgtatacaaactttgcatatgcgtatataaactttgcatacgtgtatataaactttgtatatctacatattaaaaaccgagagaaaaaaatacgaatacaaagattgtatacgtatgaatacaaacttggtatacacacaaatacaaactttgtaatacgtacattaaaaaaagaaaaaaccaaaaacagaagagaaacgaaaaaacaaaaaagaaaaacagaagagaaacgaaaatggaaaaaggaaaaacaggagaaacgaaaaaaacccggaaaaatcgctcagtcgcgccggggcggggggcggcggaccccgtcccgaacgtgtgccccgaacaaaataaaaagagcacgggacgggtcgacgtgtacccgaaggccgaacgtaaactgcagggttatctatgtgcgttcgcccttcgcagaagcttctctaatctctctccaccgtagcgcagaacgtaaactgaagggttattagtaccttggaatgactggatgacaagtgggcccagtacagaaggtcccattatgtcagtggcactagatcgagcactcgcgccgcgagcccgcgattggaatgccatgtgggtctttctcttgactactccatccgttgaatgtcgttttcagttttatgtcaggtttggtaggtcgtgatctttttactattttgcccattgtgcaaaattttctactacatgcaaaatccgtcgaatgtcgtcgtttcgtttgcgtccgcggggttatcactatatattcctctctctctccaggaaaccaagccttccccacaggatcgagtcgggcagccacgaatcgatcgagagatctaatggcggcggcaaagctactgctgggtgatgctcgccgcgaaccggaggcctcagctttgggcgcgctcggcgtcgccgccatctccacggccaccactttggccaccgcggcgttcgagccgccgccgggcggcttcggcaccaccacctacaaccatctcgccgtcgccgggctcgcagggaccttccttggcggggtggccctggtcggcacttcagtgtgggtctctgacaacccagctgcccgccgtggcaccggcaagaagctcctctacgccgccgtcccgccgctcctcgccgccgtcgttctatcggtggcggcgctgctctggtaagcatgtacaagcccctgtccgaccgcattactatccgccatgatcggagccaagccggccgtccctagcgtgctccttgtgtcaatcaaatgcaatcttaattattccatttgtattgttcatttgtttgttttgttggtcgatcgctccgtcatgtgttatgtctcgtggagttgtagtatcatcatgtaatagtgcttgcttcttcttcttctagtccattgtgtgtatcacatatgtatgatcacgtctcctgttcttggtctgtcaaagtgttattcgattgatggccggcttaatcgacgagtgttttgttaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctcctttttttttctttcctttttttttggaggcaactgttaaaaaagagggaatggggggccatattaagtggggcccacatgccgtatcatatccatgacctttgtccttgcgttgcc

SEQ ID NO: 51330 - DNA, 2090 bp, Oryza sativa
ttaactcttatgaattgttcgagatgaccttttttgtcttgatgaattgtggcatgacaacccaagagtactagggtctagaggtatccctagaaacttaggagcaagtggagaaagacgtagcaggaccagagcagaggacatttggcacctttgaaacaccataaatcatctcgtaaaaaatattcaacttttaaaatgtgtactatgtaagtgttgttcttctgagtgatggaattgcatattgtaaatcaatctccacttgtacaaaggatgagcaaatcttttgcttattcttgtctacttttttttttttggtcaaaatgaataggaatagcaggttcctttaaagtgcaagtataatggaaagagttggtaaattttaatatacttctgaaagaatcatcatccttgtgtcattatctttttcatgtattgaacaacagatttgcacatgtatttttaccatctttaacagctctttattaacggatagtatatggttttgcttttatgtagggggatgttgagttgtaagaagaccagatgcatctgctctgattttagaggcatgtataacctgtcaaagagcagcaaaagaaatgcatcatagctgtgtgatacataactttgccaggagagatctctctatttaagcacacagactgctatggcattgttaaccatttgctcagttgctcttaaatgcatttctgctggcagaagatggtagcatggtggaggttctgttgttaaacccggtatcaggacttgatcaagcaatttggtatgttcggtgaaaattcatgcacatttgagcgatcgtacagtactccgaagttggtgttttctatcctccggtaattgtggatcactggtataatgaggaaatcaacctaacgtataattgccatggtctatatttgtgtgtatgtggagactggtgtgtgtactaattttctggaatgtcatttagtcagaagagttgtttagaagaggcataggcaaattctcttgtaaggcttttgtagttccttgagagtttaacatggttataacattagtgcgccggccgtcctcggccaggatctggtcggcatagcttgtggttgttgggcacttggggtttggggtttgaaagacagtgtcgttgatgtgctttgagttcctgcttaattgagttatgctgactttgttagtatccacatcttcagatactattcccataatccctaaaaaaccagcagttgcgttgcgtggtagctaggttatgtaaagcgcattcctgtgatgaaaaatagaccctgggatgtatcaagcgatccacacactagctatgtcccccaatagggacaattaatagaaaaaggtggaaagatggtgatagggaaagacgacaaaatggaagtattaaccaaaagatcaaagaagtattagccaaaagatcaagacggggatagagaaatgtggaacatattagccaccaatcgcagtccacatttcgacgacgagagacctggctgcccttctaccaccagttcacattcccccaaagcatttccaggtcttttacctcctctgcttttggaatctttggaatcacaggcatggagtggttttaagaaatgaagctctgtctcttcatagattgttgacgaattgcattaaaaatgtgactctttgggcggaacgtattaagctcgatgatagagttgtaatttcttcctagaaagatcttttctcctcctcactcagaactctaaacatgtactccctccgtcccataaaaaacaaatcagtactgatatattctagtacgatgaatctacatatgtatgtccagattcgtaatagtactaggttggtttttatgggatggagagagtaataatgatctaagagttttactcccgtcggcgtccggcagcctgtaccagacggtactagtaccgggaggtacaagatcaaatctggccgtccatcttgaaatgatacgattgggaaacagaaaagagaagcggaacgattccagagtcacgccggccgtttcctccctagctgccctctttcttttctccctccccgcatcg

SEQ ID NO: 51331 - DNA, 3597 bp, Oryza sativa
acgcgctccgtcaccagcaacgccgccgcatcacgagcgaaggtccggtggtattctgtgtcccctatccccccccctcgacggctcaagcaagtacctaacctcccccgctgccatcggcgcagcctaggcccccattacggctcaaacactgctccactatatggtctagttattttgtaatgaacaattcaatctgccatgtttcttgtaatgaatttgtgagaaaagcacaagcttttgctggagactttaatctttgaatggaaaattttaagctcatctgtcgtctgttttttttatgctgtttacagggcatgatctatcgttgaatggagcttttgacataatttttgtctgctgtgaacagagcatgatatatatgtcgtattgagagccattaatattttgtctgctgtttttgctcgatctcctgtaaaatacatgtcattctgcggagtgatcagcagcacaacaatggttacaaacaagtgttttcaatgaacagcaatccagctagagatctaaaagttgaggaatcactggagtaaagtgctagacacatgggcaataattgctgaaaaaaagtataatttacatgattctgaaagactgaaacaaacatactcgtactagtgagctgtaattcagagtttcagacagtgggagtgttaaatatgtgacaatatattcggattagtttcccagtaggagtttctatcaggtgtatttattttatccccctatatatactcttgtaagccgtacaggaaggggtgacgttcacattgtgattcccctacgtttgtaatcatctcctctgtagtgatcattgccggtcggcatccatggttttttcccgcaagggttttccacgtaaaattcgtgtctccgttgtgcatatattttcataacaagtggtatcatagcattggacatcaatctactaatcacgcggccaccggtgtttttgggatcggagaatcaatctgatcagcggcggcggcggcgctcgtcgttcgttggtgtcgtcgagttgccgacttgccgtcctcctgaccgccctgcgcatccacgcaggagcagcagcagtgccgcgtggaagccgcgcgggagaagcagaaaagcaggaggagcaacagcgtccaatccatccaaccagcgcacagttcccgagaaaacaaaaataatctaccgagagatttctgatccggttgattttttcaaagtgggaattgctacggccacctaagcttgtgtaccaggagataccctgatctacgcttcgtgcacacggaaagtgcaccagaggttcgcgtttttgctagatttaccctaatttctttctagcaaattcaggattaattcccatagcgagtttgaagtatgatctaccgctcctggaccaacacacaagattctcactttgacaagtgaagatgcgagccgttcttgcacaacaagacctcgatgatgcactttctggatttgacaagaagacacaggattggtccaacgatgagaagaaaagggatcataaggctatgtcatatattcatcttcatctatctaataatattttgcaggagatgcttaaggaggagatagccgctaggctgtggttgaagctggaacagatatgcatgactaaggatctgaccagtaagatgcacctgaagcaaaagttatttttgcacaagttgcaagatgatgggtctgtaatggaccatctctccacttttaaggaaattgttgctgaccttgagtctatggaggtaaagtataatgaagagaatttaggccttattttattgtgttcattgcctagctcatatgcaaacttcaaggatactatactttatagtcgtgatactctaactttgaaaaaagtttatgatgctttgcatgccaaagaaaagatgaagaagatggtaccctctgaaggttcaaattcgcaagcagaaggcttggttgttcggggcaggcaacaggagaagaacacaaacagcaaatcaagagataaaagttcaagtggctaccgtgggagatcaaagtccagaggtaggtataagtcatgcaaatactgcaagagagatggacatgatatctctgaatgttggaagctacaggacaaagacaaaagaaccggaaagtatataccaaaaggtaagaaagaagaggaaggtaaagccgcagttgttactgatgagaagtctgatgcagaattgcttgttgcttatgttggttgtgtacaaactagtgaccagtggattcttgatactgcatgcacctatcgcatgcacctatcacatgtgcccgatagggattggtttgccacctatgaagctgtccaaggtggtactgttttgatgggtgatgatacaccatgcgaggttgcaggtattggaacagttcagatcaagatgtttgatggctgtattagaacattgtcagatgtgcggcatattccaaatttgaagagaagtctcatctctttatgtactcttgatcgcaaagggtacaaatattccggtggagacggaattttgaaggtaaccaaaggctctctcgttgtgatgaaagctgatattaaatctgccaacctataccatctgcgaggtacaactatattaggtaatgttgtagcagtttctgattcattatctaattccgatgctactaatctttagcatatgcgtcttgggcatatgagtgaaattggtttggcagaattgagcaagcgaggattgctagatggacaaagcatcgggaagctcaaattttgtgagcattgcatctttggcaagcataagagggtgaagttcaacacatctacacatactactgaaggtatacttgattatgtgcattctgatttatgggggcctgctcgtaagacatcctttgaaggtgctcattacatgatgactatcgttgatgattattcacgaaaagtttggccttatttcttgaagcacaaatatcaagcttttgatgtgtttaaaagagtggaaaactatggttgaaagacaaactgaaaggaaggtgaaaatccttcgtactgacaatgggatggagttctgttctaagatatttaaatcatattgcaagtctgaaggcattgtgcgtcactacaccgttcctcacacacctcaacaaaacggcgtagctgagcgtatgaacaggacaattatatcaaaggcccgttgtatgttgtctaatgcaggtttgcccaaacagttttgggcggaagccgtttccactacttgttatcttatcaatcgatcacccagttatgccattgataagaagactccaattgaggtatggtctggttccccagcaaattattcagacttaaaagtattttgttgtactgcttatgctcatgttgataatggtaaattggagcctagagctattaagtgcatttttcttggttatccgtctggtgtgaaaggctataggttatggtgtcctgaaaccaaaaaggttgtgattagtagaaatgttgtcttctatgaatcagttatgtgacacgtcaaacactttactaatgttcctgttgagagtcaggagaaagcaaatgtgcaggtg

SEQ ID NO: 51332 - DNA, 8370 bp, Oryza sativa
aactgctatgcatgatgagatggagtcacttgaaaagaatcatacttgggaattggtgaagttgccaaaggagaagaaacctatccgttgcaagtggatcttcaaaagaaaggaatgtatatctccaagtgatgaggcaagatacaaagtaaggttagttgttaaaggttatagccagattttaggtattgatttcaatgatgtcttttcccctgttgtgaagcatagttcaattcgcaccgtactcagtattgttgcaatgcatgattatgaactaaagcaaatggatgttaagactgcatttttacatggggagttagaagaggacatttatatggagcaacctgaaggttttgctgttcctggaaaagagaacctagtttgtaggttgaagaaatctctttatgggttgaagcagtcacctagacagtggtataagagatttgactctttcatgctttctcagaagtttagaagatccaattatgatagttgtgtttatctcaaagttgttgatggttcagctatatatttgcttctttatgtcgatgatatgttgattgctgcaaaagacaaatcagagatagcaaagttgaaggcacaattgagtagtgaatttgagatgaaggatttgggtgcagcgaagaaaattctcggtatggaaattactagagaaagacattctggcaatttatatcttagtcagaaaggttatattgaaaaagttcttcgtcgtttcaatatgcatgatgcaaaaccagtgagtattcctttagctgcacattttagattatcttcagatttatgtccacagtcagattatgatattgagtacatgtctagagttccttattcaagtgcagttggttcacttatgtatgccatggtatgttctcgtcctgacttatcacatgcattgagtgttgtcagtagatacatggctaatcctggcaaagagcattggaaagctgttcaatggattttcagatacctacgtggtacatctagtgcttgtttgcagtttgggagatctagagatggacttgttggctatgtggattcagattttgctggagatttggataggagaagatcgctcacaggttatgttttcactattggaggatgtgctgttagttggaaggcaagtttgcaagcaactgatgccttatctactactgaagcagagtatatggctatttctgaagcttgtaaagaagctatttagcttagaggtttgtacactgagctttgtggagttacgtcttacattaatatattttgtgatagtcaaagtgcaatatgccttacaaaggatcaaatgttccatgagagaacaaagcacattgatgtgagatatcactttattcgaggtgtgattgctgaagatgatgtcaaggtatgcaagataagtactcatgataacccagctgatatgatgacaaagacaattcctgctactaagtttgagttttgctcaagcttggttggtgttacagtatagtcctagagactatttggcgcgcggtgattttacctacatgaggtatttttggtgattgatgtttttatgctacaagaggaaattcgtctcaaggtggagattgttaaatatgtgatccaaattttgggcccacaatatattcggattagtttcatagtaggagtttctattaggtctttcttttatcccctatatatactcttgtaagccgtacaggaaggggtgacgttcccattgtgattcccctacgtttgtaatcatctcctctgtagtaatcattgccggtcggcgtccgtagttttttcccgcaagggttttccatgtaaaattcgtgtccgttgtgcatctattttcataacagggagatagataaacagagttctgcaaattttcagccaaacagaacgaactaggacttagcaagaatctaaaactgaaggataagttagacaacccatctcaaaaagctgtaatttagagtttcagacaatgggagatagataaacaaaattcacatggattggttgctgagacatcaacatgctgggtgatccccatccattaattctggtaattgacatgtacaaaatcaacaatggcaagcatagtacatattatcaaatagcttcatgagaaggaacacagctacaactactattcctatgaaccaatttctaatgtcatcagtctcttttttctgcttggacaacttcttgaatgaattttccatgtctgaaagccggtcagccatttccagctctagcttcattttctctcttctgccttcgttttctcaacataacagttgagtgcttgagctgtgggcagtgctacagaataaccagaggttgaagaaggatgcccgccacgaaccacctgctgccgacgccatcgccgccgccacctcgcggacacgggcccaagcaccggacaccgccgccaacaccacctcaccaccgcagcccgcggaccagccaccacctcctcgccgcctcccatggaccacctactcgccgcctcccacgaatcagctgtcgccaccgcccacttcgccgccgccgcctacggatcagccgccgccacctcccaaggaccacctcgccgctgtcctccgagcgttgctcccgtccagcaccgccgccacctctcacggatcagagctgaatcgagatggattgtaaaaaccctagtttcaccactcaaaacgcatccctacgtgaaaagacaacattacccttccacccctctaactattctggtaccacctcatgggcaaatatgtactgagttaccgcataatttccaccgtccgatcgagctgaatgaatggctgagatttggaactgggctagtaccgtggtacctgctggatgggagcaatcctcacgatctaaaccctttggactctcccttttcaaatgaatacaggtggggaaactccccctcccgggtgaattattattttttaaaaaaaaaaccaatcgcagtccagtgtggtttttccttttttgacattgcagcccagtgtggttagggatgaaaacggagcggatacggacggataatgctcataccatattcgttttcatattttttgctggatatggaaatgaatacggatagctcgaatacggaaacaaatacggattatctcgaatacaaataagtatcgaatatgatcggacacgaatacgaaaacaattttttttcggaacacgaaaaccaacttaacttctaatataaaaaaatatcaacatatatagttagctcattttatataaaatatagtataatttataaatattttttaaaatttaaataatattaatagtgtggactagatttaagagatgaactactattaaaatgtaaaaaggtatattgaaggtcataaagttataaagaaatgaggtatgtctcatggcttctgcggatatctgaatagcactgttcaccggacatccgaattattatccgtatccgacggaaaccccgataccatatttgtattcgcatccggaagaaaatatccgtattcgtatccgtatccgaactatccgagaaatatccgatccgagaggtatccgttttcgttttcctccggagcggacagaaactatctgctccgttttcaaccctaagtgtggttcatccaaaggaccggagaaagtgggttatgctgcctaatttagttctgctgactctatcagtatccacatcttcagataccattcccataatccctaaaatcccagcagttgcgttgcatggtaggctatgtaaagcgcattcctgtgatgaaaaattgaccctgggatgtatcaagcgatccacacactagctaaggtccctcaatagggacaattaatagaaaaagatggaaagatggcgatgggatgtatcaagcgatccacacgctagctaggtccctcaatggggacaattaatagaaaaaggtggaaagatggcgatagggaaagacaacaaaatgataaaaggaagtactccctcattctctaaatgttagacaccgttgacttttttaaacatgtttgaccattcgttttattcaaaaacttttgtgaaatgtgtaaaactatatgtatacataaaagtatatttaacaataaatcaaatgatagaaaaagaattaataattacttaaattttttgaataaaacgaacggtcaaacatttttaaaaaagtcaacggcgtcaaatattttgggatagagggagtattagccaaaagatcaagacggggatagagaaatgtggaacatattagtcaccaatcgtagtccagtgcggttttttttttgaggaaatgtgaaaattcatcacacgctgttataaaagatatccttttttcgaggaaagtctcccagtcaatatggtgctcctatcgctatcaatttctatggtactaaccacgatctcctatgtaaaaaccatctgaaacgtccggaagtctgtaccatctgaatgacatcattcccagatagaaacaaaccgatgacatcattcccagatagaaacaaaccgctcgtagggatagaagatgaaatgaagataaatattaagtgtttcacataaaataaggtgttgataacgtatgattaattgtgttttaattattacaaacttaaaaaattgattaatttaatattttagaacaaccttcatatataaagttttcgtacgaaacgtaccgttcaacagtttaaaaaacgtgccacgagtatctaaatttttatccggttcttacataagaaacgagcgagaccattcgacagtcaaaagatatgagactgagaaaacgacaggggacagaatgccacatgcccgtcatctctcctcacctcccctccgctatataaaccagggcaaaactgaaggcacgcaggcacaacactcctctctagcttgatctttctagcatctctgctaattgccaagctccaaccttctcaatttcctagatttatttgattctgaataataggaagatccatacatcacaggtgatggctgacattgctcgccgggaagcggaggtcgacggcgctgcttcttccaagatcgcggcggcgctggggctgttcggcgtcgccacggtctctctgatcatcaacctggccgccgcgtgcgacccaccgccggcctacggtggtaacacctactaccacctcgctcttgtgggttccttcctcgccggaatgggccaggttggcgcggccatctgggtctccgacgacccacgcggtcgccgtgccgccgtcggcaagaagatcatgatcgcctccatcgcgccgctcgtcgtcgccgtcggcctcaccggagcggctctgctctggtaattacacctaggttcgttcaactacaccgacatcgccgcctcccgcgccagcttctccctagatcggcgcgaatgtatctatatcgatcttacttgtttcagttgtgtaatgctcctttcttgctgtttgggtcactgatcgagcttttgtgtatcacctcgcctatatatctacaataaatcgatcacttcgtttcctccaccgcttgctgctgtgctagctgttgtgttagttgatcaatgcttggaccgatggaacatgtgatgatgcaagttttaagtccatatagaaaaggcaaatcaactaattgtagaaattatctaatttagggagtatttggaattttggagcactcgtgatcaccaatccaacgtccactttctcgccgctgccggcggggtgtctaccgctccggcgacggtgtggcgtccgtacgtccacgccgcacgccgcaccgtacggccggcccgcctccttgttctcccttgggaagatagccgctgtcaaaagggttcttttagtgaattttgtatctatgtttaatcaagattctgattgaattactactataatgtttggttgtatgagtggaccccacacatgccacgtaggataggagtaggagtaatattagtggaggaggagagggtaagggtcgcggatttgcggctgcggcggccgagggccacggccatggcgccggcgacttcgccttcgccctgcccacccactccaagtatctctgtctcgcagcttctgcgccctaactcatccgcttgcctctcaattcgcgcgtgaagcggtgaattgaaacggcgcgccaaaattttctcggtcacaacctgatcaccgtcgccggaatccgtcctccgctgccatcttcccctcgccgccaacctgcgccggcgagccgtttgcccgtagccgtcgcggctgtgggtggtattgcaacagatttgtggaagcttttgtttttcatgatccatatgggattgcggtcgtgttgtctctctatcaacttgcacgaagatcagcgccgtcagcttcgcagtcggtgtcgtggtgggcttcacactgaagagaagactacgccggtgggccgctaggctgctgaaaagaatcaaggacgatgactagtgaaatcttttcgtaccatgttcttcctaacttatgttcagaactatgttttgttgtgcatcacccgcagtttggatccctctttacaattcgataaaattgcaaggaacacaaacttatggtttctaagctgtattacacatttcttaaggtccgtaagccttagaattgctactcggaatgttgttttttctgattggtgatttacaaaatctatttctccccctattgatcgagtactcggattagcgacagttgtctcaagtgagtgtactttttcacgcctaccgttcagcctctgcatcgccatattaccgatttactggcatataaataagccttagtccgccccttttttttttttgagggaacgggtagggagaagagagttatctagtttataggaaaagtcagacctaaaatcttattaattatggaaaactggtcaaaaccatacactaaatctaaaaatagcaatctaacaagagaaatctcttaaaaccaagcctttgagaaggacacaagtcaacggaacgataacatcgtccgaatataggttgatttgagaagaaaaccgttaatgcttcaactcggacgtccggacggaaggagaaaaattggacgggctgactctgacacatcctttcaagcctacacacatgtacctttaacgatatttaaaacattttttttctcgtaaattactaatccaatctacaatccgatcacactgttgtatttgttgtaattaaatctttacaacaagatgtcgcatgattatattctgattaaaaataatcatatgtttcaatccattaacactctttgtttcatacgcgatagtgatagatatgtttcaatatgtctcttatgcatgtttcacaaatttcatgaaactatatctcactactctctctccacctcaaacatgcatgcatgtatgcattttagcgagcttcaaaataatttttctcataaactaattatccaatctatgattcggtcacaccgttgtattcgttgtaattaaatctttacaacaagatatcacatgattatattttgatgaaagaaaaacatatgtttcaatccgttaacactattgtttcatatgtgatagcgatatgtttcaacgtatatcttcatcatgtttcataaaatttttaaatgtttcagttgctgattttttgtttcaccatatataatttgatgtttcactcaatggtcaactagaacatttgaccaaccaattttctttaggacatgggacgtcagatgagaagattcttcatgattgaggagtgaagaataaagtgcggcaacatgcacatgcacatacgctcggtgtttggctgggcgtccgatatttggtgagatatcgaacgtccgagccgtagtgctatccgaagaaagctcttaaaaccaagcctttagcgttgagttttaggttgttacaaataaatatatactacctctgtcccaatataagcgtaattgttggtttccgtgtccaatatttgaccgtctatcttatttaaaaaaattggtcacatataaaatattatacatgttttatcatctaataacaataaaaatactaatcatcaatatttttcaaataaaacggatggtcaaacattggacacggtaactgacagctatacatattttagaataaaggcagtaaaaattttacctataaattaatttttattctttagtaaactgttttgtcttatttgcctaggcatcacctctagaatgaagcttcattgatttctgggttgaatttgctccaactgacacaaaagccggtgaatgccccccgcaaaaaaaaaaaaaaagccggtgaaatggcgtccccaacgt

SEQ ID NO: 51333 - DNA, 10688 bp, Oryza sativa
aatgtgatttctttctcacttttttttttgttctgttcgaggagatccagtaccatgccgtatttttttgttacaacacgtcccgcgaccaggtagatgagttaggaccacttttgttgttattacagtatgtgctatgaccattttagatgagttaggaccactttatgttctaggaggtccggggtccagtaccatgccgtccatatatagcgcatttgagttgcacatctccagcaaccaactccctcccaaccgatcgatctctctcttctacttcatccaggtccaaggagcggctcaatcagtcgagagattaaatggcggcacagtatgaggtgagtgacgcattaggcgcgctcggcgtcgccgccatctccacggccaccactttggccaccgcagcgttccagccgccgccggcgccgggcggcctccgcaccaccaccacctacaaccacctcgccgtcgccgggctcgcagggaccttccttggcggggtggtcctggtcggcgcttcagtctgggtgtccgacaacccagctgcccgccgtggcaccggcaagaagctcctctacgccgccgtcccgatgctcctcgccgcggtcgttctatcggtggcggcgctgctctggtaagcctctcaaattaacgctcatgtacaagcccctgtccgaccgcattactatccgccatgatcggagccaagccggccgtccctagcgttctccttatgtcaatcaaatgtaaccttaattcttcatattgtttgttttattggtcgatcgctgcgtcgtggttgtgtctcgtggagctgtagtatcatcatgtaatagtgtttgcttcttattctagtccattgtgtgtatcacctatgtatgatcacgtctccttctgttcttggtctgtcaaagtgttattcgattgatggccggcttaatcgacgagtgttttgttaattatgagttcatataatctcggcgtggaaatctcggcgtgggctgagagacttaagttagatgacagacatgtaatctcggcgtggaaatctctcttctccttttctatccgctccctcgatatataattggactctctgtactttctttgctattaatggattcaggtggggaagctctcccccccgggtgaattttcaaaaaaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctccttttttttttcttttcctttttttttggggggcaactgttagaagagagggaagggtgggccatattaagtggggcccacatgccgtatcatatccatgacctttgtccttgcgttgccggcggcggcggcggcggcctacggccatggagatctcacgcgaccatttgccggtgaggtcggctgctccgcctccgcctccgcatctacgcctgattgatccccacccctctctccactgactgtgctatcgcgtttccggcggtggttgatcgaggcggtagcccgtgcggcgcgcgagattccgcccgtccacggatttccggtcgccatcgccggggttcgtcttctccggccagcccctcgccgcgcgaacctgcgccgcccgtcctcggccaggatctggtcggggatcgcttgtggtaggtgttagggggcacttgggtttggaggacagcatcgttgatgtgctttgactttgagttccttgctaatttagttatgctgattgttcccataatccctaaaatctcagcagttgcgttgcgtggtaggttatgtaaagcgcattcctgtgatgaaaaatagaccctgggagacatattatcaattgtatcaagcgatccaacacactaggtccccaaatattgtcgtagataccattttctcttcagtatgctgcttaaaatgcaaattgtaagcttttctctgtgctgtccagttacgtctagtaattccttatgtttaaagactgatattggtctttggttgtgtgtgatgtgcttcttgttaatcgcaatacttgatctttactatcggtgcatatttagtcccaatatgcccttttagttaagttgctgaaacattgagcatcttgtcatgttgatcttcttgtgagtggttcaagatgatttgttctgttttaatggaagtaaaaaacgagggctgtcccctcctaatgggaagagaaaaagagatgtattccagcaaccatgtgttatagtacaatccaattagttcgctaagctattatggcctttatatcctgctctgagtatttatttgatttgctgtaaagttattaaatttatggcattgttatacgtgatttgtacttgattatatgctgctattggtgattcatgtaattagagctgaatgggatttttgctagatacacattgcttctttcaacaacccttatgcgaacaaaattaatgggctggtttctcttctgtgctgatttccattgttccatagctgaagcttaagtaattgcaaaatttgtaggaactcatctgttcttttgctgaaccaatagacttttgtaaatacatttgcacaagacattgaggtcaactaaaattcttctatgcccaatggtgcagccatatttcatacatgaatatggctatcgctttgcctgataggttatggactgtgaactctgtgtttattttgatgtgaaaatggcctcaggggaacgcaggataactcatacatgtcaatccatacactaggtcctgagatattttcttaatgcccttttctcttttcactatactctacttgttaaacttctaagaaaagtcttatccctctactgttctattatatctataattcctttgttttgatgtcaaaagcagtgtattcagctgtatattttgttgtgatatgctctggttgatagtagttagtgtccgtgttttgacttgttgctgaacccttgagagcatctcgtaatgtttaactcttatgaattgctcgagatgaccttttttgtcttgatgaatagtggcatggcaacccaaggcaagagcactagggcctagaggtattcctagaaacttaggagcaaacggagaaagacgtagcaggaccagagcagaggacatttggcacctttgaaacaccataaatcatctcgtaaaatatattcaactttaaaatttgtactatgtaataggtggttaaattctgttcttctgagtgatggaattgcatattgtaaatcaatctctacttgtacaaaagatgagtaaatcttttgcttattcttatctacttttttttgtcaaaatgaataggaatatcaggtgcctttaaagtgcaagtataatggaaagagttggtaaattttaatatacttctgaaagaatcatcatccttgtgccattatctttttcatgtattgaacaacagatttgcacatgtatttttgccatctctaacagctctttattaacggatagtatatggctcttcttttatgtagggggatgttgagttgtaagaagaccagatgcatcagctctgatttagtgattttagaggcatgtataacctgtcaaagagcagcaaaagaaatgcgtcatagctgtgtgatacataactttgccaggagatctctctatttaagcacacagactgctatggcattgttaaacatttgctcagtttctcttaaatgcatttctgctggcataagatggtagcatggtggaggttctgttgttaaaccctggtatcaggacttgatcaagcagtttggtacgttcggtgaaaattcatgcacatttgagcgatcgtacagtagtctgaagttggtgttttctatcctccggtaattatggatcactggtataacgaggaatcaacctaacgtataattgccatggtctgtatttttgtatatgtggagactggtgtgtgtactaattttctggaatgtcatgtaatcagaagagttgtttagaagaggcataggcaaattctcttgtaaggcttttgtagttccttgatagtttaacatggttataacagtagtgttttctatgacgacatttatgattaaactgtgtctacaattcctgtcttttgtgcagaaaaaaaaaaagcactgataaaacaccctagagttgaatgcattgcgctgttgcgactgattctgaaagcttggcagcaagggcaatgttcagcatttttttcctgcagctgtgaattttgctactcttgttaaacccagggttcgaaactccccgcccccccccccccccaaccgaaatgctcacatatcgcccaaaattttggttttttgcttttttttttccgaatttggtcaaatttattcaaaatcagtcaaaaattcaaaaaaaattgtacgaaaaaaataaaaaaaaactcagaaatttcggttctatcacccacctgcggcagaaattttagtttcaaaattaaaaaccttggaacttaaacctgtgcccgggtgtgcaaacctgacagccattatggttgtgataactgataggtgctatgcctatagtttttcaggtgagctggtgatggtatgtttggtttagagctgattctgtggtggagacgcaaattaaaccgagatactaagggaatcgagacacaggagtctcaaatggcccaattttttcaatactcttctcactaaacaaatacgagtacctctcaaaaagagaagaacaaatacgagtactttatacaaaaatgaaatagggactaaatgatgattctttgtcaacccatttgtgctgatgacctgcatctttgatgtgatgtttctaatgtttctttaccaattaattttacacaaaacacattgtttaggagcttggaacttggaaaccatgcccgcgacaatccagaatcctgaattagaaaagaaattaattacaggcccttcgttgtggcaatcacaggaaccaggagtactactgcatactttaacgacccgcctaatttattaaacatcacagggacatgaatacatgaaaaaacagtagattacacgaaaccaccatggatcatacacaaagaacattagattagatattatagtattaaacatcaccatcataatcacagcagtaacgacacataccacgaatagagggagggacataaatggagggtgacgtcaccgacgctttggcagtgtttggcaaatgtctaagggaaataatttcccacccatttttaaatcctaaccattcattatccatcatccatttaatcttaacccttcgtcaaagttcaaaacggagaacttccatgaaattatttgcgcgcatcccgcgtacacacaggaagctggaagccgcagggggcgcgcatcgcacaatatatatacttccacgttcatagttgggaactcggaagctagcccaccccgtcccgtccctgattcaccgcagatccctctaattcatagctagatccattaaggagaggatcgaatcattgatcagctaggaaccggtcgggagattgtccattttggggagggattagcgaaagagatggcgccacagcttccggcgggtgctgatcgccgggaaccggaggccacgttgggggcagtcggcatcgccaccgtctccgcggccaccgccgctctggccgcagcgctcgagccgccgccgggtagcctcgtcgccgacaccttctaccgcctcacgctcaccggggccttccttggcggggtcgccctggtcggcgcttcaatctgggtggccgacaacccggccgcccgccgtgccgccggcaagaagctgctatacaccgccgtcccgccgctcctcgccgccgtcgggatatcggtggcggcgctgctgtggtaagtccgtcaaatgttcatgcacaagcccctgtccgaccgcatcaccgtccgctggcgtcgatctctagcttgttgctcgtgtttgtgtccctggaaattgtgtgcactactacttcttgtagagtttgtgtgtatcacccaggctttgaaggtatcaccttacgtatgatcatatcagtgtctgagtgtctcgttctgtatgttttgtttggctgtcgtgtttgttcgattaatggccggttggtttaatataaaagagatccacaaaagtttttccacttcaaatattcccagttaaaagccttgtgcgctgtaatggcgggcggtcgccaaggaaaaaaccagcaggttaatttgttgtaattttcagagtgaggacgtcgtaggaaccctgggtatgtccctggtgccttgccacatgagcgccacataggatcatagagggaatgtgtccatttgggacctagatgatacattttgacaagttctggaacctggatatgcattttgagagtttatgaatttatatgacacaacctacaagtttaagtaccgccaatgcactttactttttttttttgtttttttggggggtgattttctctctcaatgctgaactgctacatgggccatagaagtggggcccaaatgccgcatgatatcctttgaccttgcgttgccggcggcggttattacggccatggagatctcgcgcggccatttgccggtgaggtcggctgcttcgccggcgcctccgcctccgcatctacgcctggttgatcccccaacgctatctccactgtgctatcgcgtttccggcggtggttgatcgaggcggtagcccgtgcggcgcgcgagattccgctcgtccatggatttccggtcgccgtcgccgggattcgtcttctccggccagcccctcgccgcgcgaacctgcgccgcccgtcctcggcaaggatctgatcgggatcgcttgtggtaggttttgggggcacttgggtttggaggacagaatcgttgatgtgtttttgagttactgctaattgagttatgctgattccgtcagtatccacatcttcagttgctattcccataaaatcctacattgcctgccgatgcttttcgagcccgcagattatactagacttgtttggtagcacgctatgtacttcacaagtgcgcattccggtcatgaaaactgcactcagggagacatataatcatttgtatcgcacattaggtcccttgatattgtctttgataccttgtcaaaatgctgagagtaagtttttctctgtgctgtcagttacatataatcccttatgtttagactaaaaaagaaaaggtatagactgatattggtatttggcagtatgtgatgtgcttcttgttcatcgcaccagttgatctttacgatcggtgcatatttagttccaagatgtctttttagttaaattgccgaaccattgagcatcttgttatgttgagtggttcaagatgatttgttctcttttaatgtataagtgaaaaaaaaggggtttaatgtaaagaaaaaagagatgcatttcagcaagcttgtgccacagtacaatccaattagttcgctaaggtaagctattgtttatggctgttatatcctgttatgagtatttgtttgatttgctataacgttattaaatttctggcattgtcatacatgatttgtgttctgttacatgctgctattggcaattcatgtaactagagctgaatgggagttgtgctagaaacacattgcttctttcaacaacccttatgcaaacaaaattgaaatgatggtttctctgctgtgctaatttccattgttccataactgaaacttaagtaattgcaaaaaaaattttggaactcatctattctcttactcttataataagtctgggttttgtaggtagctacgctcatgctatgtgcttgcgctctgtctatctgaaccaatagacttttgaaaatccatttttacaagacattgagatcaactaaaattctatacccaatgatgcagcactgcagccatatttcgtacatgaatatggttatctgtttgcctgataggtttatgaaatgtgaactgtatgtgtttattttgatgtgaaatggcctcggggcaacacgtgataactcatacatgtcaatccacacactatactctaattgttaaacttctaagaataggcttatctccctactgttgtattacatctataattgtttttgttttgatgtaaaaaagctgtgtattcagctgtatattttgttgtgatatgctgtggttgatagtagttagtgtccacgttttgacttattgctgaacgcttgagaacatctcgtaatgttgaattgttcaagatgacctttttttgtctcgatgaatagcggcatggcaacccaaggccaggaactagggcctagaggcattcctacaaacttaggactttaggagcaaacaaagaaatagcagaaccagagcagaggaggtgttaggagaaatataaagggcatttggtaccttcgaaataccataatgcgtctcggaaaaaacattcaacttttaaaatttgtactgtgtaataggtggtaatgctgttcttctgagtgatggaagtgcagattataaatcattctctacttgtacaaaagacaagcaaatcttttgcttgttctcgtctctttttttttggtcaaaatgaataggaatagcaggtgcctttaaagtgtaagtataacagaaagagttggtaaattttaacatacttcttaaagaatcatcatccttgtgcctatctgtttcatgtactgaacaacagatttttaattgtgtatttttaccatcaggaacagttctttattaacggatagtatgtggttctgcttttccatagggggaacgttgacttgtaagaagaccagagccatctgttctgatttgagaggcctgtatattaacctgtcaaagactcaaagagcagcgaaggaaatgtttcatagccttgttagacataactttgccaggagatctgtctgttttgatgcccacaggctgttatgggggttgctagtcacttgctcttacatgcccttctgctggcataagatgatagtctggtgtaggttctgttgttgaaccctggaagtctggaacacaaccggtgctcagaagactttcatatcactgcagcctaccaggatttgatagagcaatttgatatgtttggtgaaaattcatacacatttgagttattgtacaatactcagaaattggtgttttctatcctctggtaattgtggatcactggcatattgaagaatcaaacctgacatataattgccagggtctgtaatttttatacatgtggagattggtgtgcataccaaatgttctgcatcatgtaatcagaagagttgtttaggagaggcataggcaaattcccttgtaaggcttttgtagttccttgagtgaacgtagttataacagttctgttttctacgacaaaatttgtgattaaggttcacaatttgtgttggttgggcagaaaacaatgagctgatagaacatcctagaattaggccttgtttagatactaattttttttttgccataaacgtcacattaaatatttggacacatgcatggggcattaaatgttggaaaaaaccaattgcacagtttgcatgtaaattgcgagacgaatcttttgagcttaattacgccatgatttgacaatgtgatgctacaataaacatttgttaatgatgaattaattaggcttaataaattcgtctcacagtttacatgcagaatctgtaatttttttttgttattagtctacgtttaatacttcaaatttgtgtccgtatataaaaaactttacacccaacgtactaaacacacccttagtgcattttgtgctggtgtgaccgattctgaaagcttggcagcaaagagttgtgaaatttgttaatcatgtcaacttgtgctcggggtgtgcaaacctgacaagcattatgcttgtgataaccgataagtaatgtaggagtagttttttgtggtgagttgttggtggtggtattaaaagtcattgaaccgacataacaaggggcattgggacacatgagtatcaaatggtccaatttggccttattctatactcttctcactaaacaaacgcgagtactgtatacaaaatgaactaggaataaaaattgatgttttacttattttgtcaacccatatttgtgctctgctagctgacctgggtgtgaaattgaagcttgtttgacaacgaccattattctgatcgatctctttgtgatggggtaacattgatgtgatgctttctaatgtccctttaccaatcgtgatagcgctctcaacagtatgcaacagtattcctgaagtttttcgccaatcaggtggtgatgaccttgatctggtgtcccttgcaggcttgcattgtgttggtctaacaatccatttggaccatttgtcgtatccaaaggctcgtaagtttgtcaactcggctttgtatatctttatgcatgagatgtgtttccaggcgtgcatttgcattgtacttgatgtaatagatctcccggcctgatttatatttgtttacgtac

SEQ ID NO: 51334 - DNA, 11103 bp, Oryza sativa
ttttaaagaacagattttataaacagattgcgagaaaacttgttgcgtatatgcaccctatatcggcgccaaatacaatcgcgctgaacctaaccatcaatcattttagtgtcgacctctctgacataagaaaatctcattttccattcaaatactattaatttgctatcaaatttggaaactaacaaatcgtcctaattggtttctgatagttcattttttatcgagtggttggttaaatgtgtgtgattgctgggaggcttagcatttatcttgtgacatagagatattatgggtcagctaagtttttttcaagaattagacagtataacgcagacacttataacgcacgcgcactcactcctatgaatacacgcacgcaaaccctacccctatgagtatcttcgaagactgggccgctgtcgacgggtacgtcgcttaccactgaaagcacaacgctgttaaatcctgaaaaattcgctctcatgggtagtcgaatctaagaccttaagtgctactgaggctcttgtaaccattaggctacagactcttttgctatgggtcagctaagtttaaccacatttaaggaaggtttttgcgttggtactatttgcatgtagattgagaggtgaagacctgtgcagttggttgccggcaaaaatttgctgccgttggggagcttttggggctgatgatcatatacgtgcgtgctgctgcttgacttttcccttattcgcttgcgtgcgccatattagcatggcatttttttccctaatctacttgacttctcccttaatcgcttgcgtgcgcgagagccgtattagcatggcattggtgtgcggctgcgtgaaggatatgcagttgtggcgtcggtttgtaaacgatgcgatatgattagcgtgtgcagctgctaggaagatatgcggcctcatctcttgtttacgtatgcttatacttatcagccaaaatttaaatttttaaccttcaatttgaagctgattttaatgtttttttatcaaaatttatttatcaacatttgcttttagatcactaagaacacgtatataaaagttttattcacaaaattatttttcatttgtgaatatgccgaataagccaaacactagagccgatagattttccatcttaacagtttgtttcctttttgtttgaaccttgctatttttgtgttggaccgatgaccatgctacctgcgtatatatgcgggtgtacggttaattgaaaagcctcgaacaatttatggatatactatttctctcgttctttactttttcgttattttctattttactttcatggatgagttctagtaaccctagaatttggttatatttgccgttttgtgctgaaaaatggtcgtgcttttccataaaagagacgaggttatcctttgctagtttgctcggaaattagtagttcgtcgtcacataagtacgatatttaccttctttgctaatttgctcttaaattagccgtgtgattatacgaaagtgaattaatctcaaaatcggtttagtcggctagttttgatctatcgattttgacgactccgtcgattaaatcacaaatcgttaggtgatcttgtgttggccataaaaaaagtgtcaacaatttctatctctactacttaaaaagtaggttcaaaacataaatctctatctctactacttaaaaagtagatctataatttctaaatcttaaaaagtaaatctctatctctactacttagaaagtggcgaaaaaaacgtagatccaattcccccttaaaatggggaaaaaatctgagaaaaaatagcgaagaaaacaacaaaaataaaagaggtctgtgtcgacgtttgatgtcgcgattccggtatttacatggtatggggatcgttggtattaggatatatgcgagattgaggtaaaagagatggagacgatgatttttatacaggttcggacccctgaattgtcaggtaataaccctactcctattggttgaagtcggtcgttactcttattcaccataatcacaccagtaccatatttggggtagcctatctaactgttgtcaacttggcggtttgaagttctgactcgtagtcgacaatagggtagccttcctcctcgaatctgcatccggcgagatcaaagacagtgctgtctctcctgacaatatccgtagataccgtgggggactagtcatgcttatctctgaagtcgatatccggcgtcttatcttggcacatgttggcttgtatgttgatcttgtgtcttgatctattgttctgtgtcccctctcctcctagagggccttgtatttatacccataggtgtcctattgtccaagtagaactagggaaaccaatatgaatataatccaagtagtccttgtcgtttccatgtataactctattcatcattccttatgcggaactcctcctatattcgaaggttgtttccgtataagacatggtatgtggtgggtcctgccgagatttagtcaactactattaggtatgtggtatccataaccctgacagtctgtttcacctaagtggcgaaaaatatccgtagatccgaactggaaaaaatccgattcctaaagaaggcgaaaaacaaaaaaaagtggcaagaaaaggctagatcggattcctttaaaaagagggaaaatattcctataaaggcaaaaaaaacccaaaaaaaaataaaaaaagtccgtccgattccctaagaaagtagagaaaaaagttcgtataaaataaaaaaaacgcgtgagaaaaaaaaataaaaagacgggaaaaaagtccaatttgtattcatttccgtatgtatctcttctctatctttaatctaacctaactatttaaaaggagaagtttttatcgtacaactaaaaacaaaaagtgcacgagagaataaaaacgcgtgagaaaaaagttagaaaaaaggaaaaaaaacacgctataaaaggtttcccatctttcgtaaaaaataaaaaaacatgcgagaaaaaatatttccatcgtccgtaaatttttttaaaaaaaacatgcgaggaaaaaattatcagaaaaaaatgcgccatttctaaaaaatggtttgaaaaaactgcgcaagaaaaaacaccgtctatatataaaaaaacaagctgctttggaaaaactgtcagaaaaatgctaaattcatgtacgcttgagttggataggatccattgattttttttccatctactacaccattcataaaaaacaacccgctctggaaaaactatcagaaaaaacaccgtttataaaaaacgagtaaaaaaaacaattggattcaacacgagaaaaaaatcgctatttctaaaaacagttcgagaaaaccgtctaacttaacatgagaaaaaaaactatcatttctaaaaaaaaattagagaaaatcatccaactcaacacgagaaaaaaaactagcgattatagtaggcaccgccccgaaaacccgcatgactcacgggagataagactgatggacgcatgggttggataggatccatcaattttttttccatttcctacacaacttttgttttctcatctattctcatgtattggagaccctgcacgtctctgtatgcaattgttagactatttttgttaagtataactactattcttaataacatatgatatagaaataatattaaaaaataaacatattttaattgctatttagagaagagtgcacagtaactctattttgtgttgacttgaccatgcaaggcagtgtatgatttgattgattctattattgggtgcaagaatgagattgaaagagtatttttagattatagatgtatgttctcgcatgattaatctaattattttaagtaaagcacgcatcagtcaggttgccaccgtcgatgttttttttagagaagggtattttttacccggcctctaccaagcagatcgaaaatgttttaccaattaattaatgtccaccgtcgatgttggaccattacattgaagatgtttcaattttttgattgtattaattacaaacgatccatacaaacattgtcattgatatggttatgcatgaaaaatatatattttgattagaattttttcacccgtcacaacacatggttattttttatagtgtaagttataagtataagacttccggtgaaaatttggttccatcacgagtccatcaggagaattaattgtcgattttgctatatatttgtcgataaattttttctcaaaaatttgacacatgtaattacagtacaatcgtagtgtaattacactgtaacttgcatgtaattacactataactatagtgtaacttgtatgtaactttcaaaaatctctccgtaacatgttatttcggtaaaatttaggtcatgggaacaaattctttcacatatgtgtgtgctatgatttgtttttttcctcaccaaaacaaatcttgtaatagatctaacgattcaaaattatgtgaaacttacatataagttacagtgtagttacatgcaagttacagtgtaattacatataagttacagtgtaattacattacgattgtactataattacatctgtcaaatttttgaggaaaaatttgttgacaaatgtataggtagtcccttaattgttcggccttgacccaaactctctctgaatcaatctatcggcatttatgaattgggatgttctcattatgggctggctaggcctgttttgtaccgtgctattacactatatttcctatttctgagccccaatatgtgattataatacttaatcttccaggcctaaggttgattgggtaattattatttcataacctaattttggttcgatgtatccatataggggcatattcaaggccctggtatagcagagactattagtatcttataaacagttaagacgataaaagacttaaatatataattaacatgaaggttaaatggcagtcgaacgatttttgatatctaaattatttgtgtttcaatatattcagaattattgttttatacgttgtagcaaaatatttcatgaggtgatttaattgtgtttcagttatttagaagattgaaactttttcgatctacttggtgaaatattttcgatccacttagcgaaacagcgcttgattggcatcaaaatgtgcatgatggaagcttaaaaaatcatgcgaatcacatatagactttttctcgatgtacttggatttgtttcatgtttcaatattttcggaaccgttatttcatacattgttacaaaatgtttcatggggtgacttgattgtgttctagctttttttaaaatattggaacattttcgatctacttggtaaaacatttccgatctacttggtgaaacactgcatgatggaagcataaaaaatcatgtgaatcccattttgatagccccattaattaatacagtaaaacaatatttttgttatttttctttccttttcttcattcttatacaacgaaaattccttttataaccgctaagagtcaatgttaagatgttgtcatgcgtaacaacatgttgtttctctgtttaccctctttcgtagtaaatgttagcaaagttaccttgttaccaactctaacaatatgttattaattgatattatacatgtcctaactcctaagtctatgtattgatcgggttaattaacctgctgttatggtaatcaagcatcccatacatacttaggtggtgtttgaatcttctgaagatgaagatgaagattaagtgtttcacgtaaaacgaagtggtaataatatataattaattaagttttaattattacaaacttgaaaaatagattaatctgatattttagaacaactttcatatagaaagttttcgcacgaaacacaccgtttaacagtttgaaaaacgtgccattttaatccaaaattttatccacccttttaagtagattcaaacagggccttaaaagaaataacaggaaattattcatatcacgtttcttcttttcttttccaccaagtatgatggatcccccacgagtcatggatttcacctgttgcaatgcacgggcatatttttctagtgatatataaaaatgcttgttaaattaaattgataaaaggctgtaagcattcttttaaaacggaacccaaacatttatagagtaataggcacggccaggctcgcaagaggtcaaattgtaggcgtcctttagaaatagttgaaattcggaattagaaaataaagaatattagaagaggagactagagtccatataaaaatacaattaggaaataattgaaattcggaattaaaaataaggaatattagaagtagagtatagagtccatatagaaatactattaggaaataatagaaattcggaattaaaaataaggaatattagaaatagagtatagagtccgtatagaaatacaattaagaaaaaaaaaagaaattcagaattaaaaaaataaggaatattagatgtagagtatagagtccatactaaaattcggaataaacataataaaattaaaagtagtgtttagagtccgtataaaaatacaatttacaaataactaatattcaaaattaagaaaaacatgggaagaagagtttaaagtcaatataggaatacaatttagaagtaactgaaatttgaaattaaaaattaaagaatattgaaagatgagtttagagtccacatagaaatacaattagaaataataaaaattcagaattaaaaaaagaaatattaaaagatgagtcgaatatatataatttataaataactaaaatttgataataaaaataattaataactaacacgtatataaaatacaatatgaatattgcacattagtagtttcgtaaagttattgcaaaatttaaaattatgttatcattttaatatatttgaataatataatgagaaaacatatatgctattatatgagagaaaatataatgttgctagctgcgcaatttgcgcgggccaccatgctagttttaaaggatggaatttctaaggattatatttttaatatgattagctattaacttattaaagtaacagaaaaatgatcatccatgttcgttctcagagcctagaaattctcgtattaatcggagaaaaagaaaaaagaaagtttatatatatggtaataaaatttaaaaataactaaaattcataattaaaaataaggattattaggagaagagagtctagaggccatataacaatacaatttagaaataactgaaattcagaattaaaaaaatacagaaaaattaaaaatagtttagagtccatataacaagtaaattcaaaattttaaaaaataaataatattggaagagaagtatagagttcatatagcaacataatttatgaataattaaaaaatcagaattaaaaaaataaagaacatttgaagagaagtatatatagagttcatatagaaatacaatttaaaaataagtgaaattcgaaattgaaaaataaaaatattgaaagaaggatttagagtctatatatgaacaaaatttataaataacggaaatttggaactaaaggtaaggaaatttggaatcaagatcgcatgcaccatccgaatgacggatgacaaggtcagcgagatcgaatggagcccgtattgtcagccagtcaaaccccacactttgttcattgacagttcgacactcgaccttgttgcttgtgcaacttcggagtgttctacccgagattttcttcttcttctttttgcgatagttctacccgagattttcgtgaaaattaaacgaccctcacccacgggctatagtcgctttcaagttcgtaaggtgcgggtgcgggccgcattcccgtcgaatttgtgttttttgggtggagaacggatccatacaggccaagttccggatgaatataggggctgtttggtaaacgtcctgaggcttgtatgccgcgtggacagctcagccagtagtctaccgcatttttcaagtcgctttcacgccggtgggccacaacacccaacaccgtttgcctatatatactctcatttttatctctctaccatctctgtccaaccttctaattccctagtcggttttgatcgatctattatattattaaaggaatagaaaaaagagcctcgacgttcgctctcatgggctagaaattctcacattaatcggagaaaaagaaaaggcagagtccatatagaaatacaatttagaaatagttgaaattcggaattaaaaaataaggaatattagaagaggaaactagagtccatatagaaatacaattaggaaataactgaaattcgtaattaaaaataagaaatattggaagtagagtatagagtccatatagaaatacaattagaaaataactgaaattcggaattaaaaataaagaatattagaagtagagtataaagtccatatagaaatacaattaggaaataactagaaattttatcaatacgaaacaaagtctactcaatacatgatagttacccctaatctttcacgtacataatgagcatacatttatgttggatttctaatagtactctttgatcaaggatgttttccgattgggtgtggaataaaagggaaaaaaaacagatgcacagtccatggaagagtccatctggactcaagttcacttagcccaaataatcttgccgtcccgctaaagccacgtgcattaattcatcttgatatcaacacctacacgacatattactgggaaaaaaaagaaataatcggagaaaaagaaaaggacagtccatgtagaaatacaatttaaaaataactgaaatttgaaatttaaaaaaagcactattgaaaaaagagtccttataagaacctaatacgagattaattaatattcagaataaaaaaataaaataaaataaaatccgaaattagcaaaaaaaaaggaaaaagaagagttcgagtagaaatacaatttaaaaataactaaaattcggaattaaaattaagcaatattgaaagaagagtccatataaaacccaatacaagattattaaatttcggaataaaaaataaaacaaatcaaaattaggaaaaaaacagaaaagaagagttcaagtaataatacaatttaaaattaactaaaattcggaattaagtacaagcaatattgaaataaaagtacatataagaacccaatacgagattaattaaaattcagaataaaataaaatccaaaattagacaaattaaaaagagagttcaagtaggaatacaattttgaaaaactgaaattgaaaacaaaaataaaaaattaaaagaacccaaacgatagtagttaaaattcgaaaaataagtaaataaaatctgaaattagaaaaaggaaaataagatttcaactaggaatacaatttatatataactaaaattggtgtaaaaaataaagactattaaaagaaaagaccatctaaaacacatgacgagattaattaagtaacagacttataaaggagtagagtggtggcggttgatgggacatctaaaaactattaataaaacaccaaatagaatactaaagatgattaaaaggaaggacgataggcaggtcatgaaacaatcggtcaaggcggttgccgggacttttagaaagtaaaagaaaaaccaatgataatcatatttgatttttaaaatctcaatgacaataaaaattagaggcaatgggcagatcgtataggagtacaatggcagtgccgtcgatggttggtgggacttctagaaagtaaaaaatgaattccaacgatagttatgttcaactttgacaatcctaatgataataaagagtaggcggcggatgggtcatagaggagtatagtggcagcgtttgacgggatttctcaaattatataaaatgaaacccaacgagacaataaactctaaaaactataatgtccaatttttaaaggttcgagcttctaaaaagtgaaaagataaacaccaacgataatcatttttattttaaaatctcaatgataataacaaagggaggcagcaggcgagtcgcagaggagtacagtgacaaagtcgctgacgttttagcggaacttctaaaaagtaaaaaaaataaacctaaacgataattatgtttgatttttaaaatatcaatgaaaagagaagaggcagtggacgaccatagaggagtataatggtagtatttgacgggacttctagaaattataaaaacgaaaccaaataggacaataaactctaaaaactataagatcaaaattttaaaggttccaagaagaatgaatagaaacagtagtagaccgagcaagcaaataaataaggatatgacagaagtaaggggtagtagttggtgtaactttttaaaactataaaattagaattacaaggatggtaaggtttggtatttcaaaatcttaagacaacgagataactaattaataaattttaagtaaagtcatattaaaaatatatataattttgtatgggtgctagccacgcaattgtatttttatatggactctatactctacttctaatattccttatttttaattctgaatttctattgtttcctaattgtatttctatatggactctatactctacttctaatattccttatttttaattttgaatttcagttatttcctaattgtatttctatatggactctagtctcttcttctaatatttcttatatttttaattccgaatttcaattatttctaaattgtatttctatatgaactctagtggcaagctgcgatactacgccggaaggaaggatgccgaggcgaggaggaaacggaagatttcgccatgttttgcccgcctccgcccacgcgtcccttgttgccacgcactacccgagtactccgcctatttaggccccaccaccaccaccaccccccaactctccccctccgacggcgtccaccacccgaccacctcccgcaccgtataatcgctgatcatggtgaacgttgctcgcttggatcaggccgacggcgcagtcggcgctgcgtccaagatcgccgcggcgcgcgcgctgggg

SEQ ID NO: 51335 - DNA, 16658 bp, Oryza sativa
ttgagtccccaaatcaaccccaaaaaaatcagctcatttacagaagagtgtatttggaattttggagtaccccgcgaattgcgaagccggcggaggcgcgccgaccggcgattatggtgttcgtgatcaccaattcgacatccacttcgtcgctgccgctggcggggctccggcgacggtgcgcaccgtacggccggcccgccgccgccttgttctcccttgggaagaagtagccgctgtcatgtgatggccaaaaggattctttttgtgatttttctatccagtttttaatcaaagattatgattgaattgtttggattttggaggaaaggtggggcatattaagtggaccccacatgccacataggagggtatgaggattagtggaggaggagacatcacagggtcgcggtctcgcggacttgcgactgcggcggcccgagagggccacggccatggcgacttcgcctttgccctcgccctcgccctgcacactccaaaaaagtctccgtctcgctgctccgtcttcctaactacatccgcttgcctcctctctgcctcaattcgctaaatcttgtcgccggaattttgctcggccacgatccgatcactgtcgccggaagccgtcctccggccaccccctcgccgtgaaactgcgccggcggatcttggccaggatctggtcggcatcgcggatgcggtattaattgcaacagatttgtggatgctatgatggccgtgcgccgttcagctgttgacttgtaagaacaccgcagccacctcttctgatttgagtggttcatacaggtatcgtgacttcctcaaaaattttatgcaaatatgaaaatatttatgtcatgcttaaagaatatttgatgatgaatcaagtcacgataaaataaataataattacataaattttttgaataagacgaatggtcaaacgttggataaaaagttaacggcgtcatacattaaaatatggagggagtatattgaggagcccaacttttgtatatttgccattgtctgtatttttcacatgtgggagactggtgagtatgacagttttcctggcatgtcatgtaataatcggaattcggaagatttgttattaggagagggatgctcaatctcctttctaatattaggcttttaccgttgtttgtgtgcaatcttcagcctttttcagactagttataaccataccattttgtatatcaaaatttatgactaaattgcactaaatattcgtgatttagtgcattgtgatgctgtgactgaatctgaaaatttggcagcgagaatgaatatcaagtaatgttgtgcatatccccgcagcctggacatgatccaactatcacagtgagctcggcccaactaaacttgggctgacttgggcagctatccatattttcatgggttgacttgggcttacaaatttctcccaaaacgatgcccaaagctttaatgggccataaagtggcgatccagttgagcacgaataaatcgcgtggttgaggttcggagtttaattcgccaacccctgtctatgcaaaacttttccattgtttgtttcaaaaaaaaaaaaaacatttccattgtttggaggcaataagaagagctccatgatacaaatgatttcatctgagcacgtaaggttgcttctacataaggttttgttcccatcacactatctcacgaaagcaaattcaagctgatataaaacttcatttgctgaaaacatctgaaaaatgtaagcgtggtactgcaggtctgcacctgccatcggccatattcgaatgaacgcattgcagttgtaatcctcggcgatgttgttgtatgcatgatctgccgtggtgatattaatggtttcttctaccttatctatgatgttcagcacagcagcagtcaacagttgatgacggagatgatgaagcctcccctagccgtcgccacccactagagctcagctatctcggggccttacaggagagagagaaaactgtggtggcggccgtgttttttttttaccttttccacatgactaatatgagggccctatggtttttctgatttcttcctagaatatataattatcacgtaaacgtcacgtcagtatgtgtgtggaccgagtcaaaatgataagttaaacaaaaccgctcaaaaagaccaccgagagagagttgatttgtactgattttgataattagggaatgcttttatactcagttttgtaattgagggatactaatcgatcacagcatataagtcgagggatgcaaacacacttatgcccatcgttgtggtcatatatattgcgctctcttgatacttaataaacacgttagtttcttaattatttcgttggcaactttttgtgacaagtcgacaaacatgattgtaacatctaaacgtcttgcggtgatatagagtcaccaatcacctcgatttagccaaactttagcagttttcccctatttcatccctaggtgctaaatttaggtgtaaatacatttgtcatgaattataaaacccactaagaacataaatgctcttggaacttgaaagaaagaataccacttggctctttttttcgcccccatgtagttaagctggcaattaatcgtcttttttgttcgtacttcatttgaaataatgtgtaggatcaacaaaacacacatacataagataaattcatttatccagacagtaattgacaacatgacgctgatacacacaccgagactgaatcgacaaacgcaacctgcaggtgctaggcatgcaccgtgaattattgtctgcataatatttggctctggtcgatcgatcgatggccgggcgatgagatatgctatatttatatggggcaactgaatgaacaatctagccagctctgtcgtcaataagccacgcttacctatcaaagcacggcgagcgcgctgacggcgacgacgagcgaggcgacagaggcgtagacgaagaaccagttgccggcggcgccggcacggcgggggtcgtcggagacccagacgaaagcgataacctgggccacgccggcgaggaaggtcaccactgcaagtgcaagtgcaaggtaggagtaataggcagcgccgttattacccaagtcagcttgcagcggcgtggtggtggtagccaaggtgattgccgcggaaatggtggctaagccgagcacccacagcgccgcgtccacgttggcctccgcttcgtcccgccgagtaacagccaccaccatatcttgattaatttcgaagactaatttgagatcgaagctagaattaaggcccaaagaaataaatactagagtttgcttctatcaaatttgctagagtttcccccttcttcaagtattgcatcgatcttcctcgaagagatatgtatatatataatcacgtattactactagctgccatgagttttctgtgggtcgtcgttgcacaaaatcacggtgcgtttgactgactcggtatcggggtgtacccgggctctactcgactcatctgaccgacacggcggggcccaccagacgtgggcccgcttgtcattcggatggtgcataacatacaccgcagcgacaccggcggttgggacatgaagacagctgcgtataggcgtcgtgagtggtgtttctgtggacggggaggggtggaggtttactgtacagctagcatccgctaagggcaggtacgcggcgaaacgcagcctgcagatattttatgtacttcgttgggcagacaggatcgagtaggaccgtatgcagtgacgcagccaaaaagaaccgccttcggccgcgttcagactgctcatctcatatgtatagttggaccggaacggaggctatgtttagattccaatttttttctttaaacttttaacttttctgtcatatcgaacttttctacatacataaattttcaacttttccgttacatcgttccaattttagcgtggaactaaacacagccggagtgtcggagtcaccaattaaccacgtgaagcccataataatttggccacgttagggatcgcaatatacatgttagggtgaatcagggctgcggtccaatatcgcgtgaacagtcgagggttccattttccccaaattctagtggcacgcaggctatatcgtaaattgtaatggtatttatctaaaatgattaacccagacaaaaacatttagttgggctagaatggatctagttgcaaactacgtggaccccataaggaataagttcacttgaggtccattaactttacactgaatttaatttttatccttgaaccgaaaaaccagatataacaggtccctaacttacaaaaccagtgcaaacgagtttcctcggcagtattgtcctcgattttagctgacgcggcgcctacgtggctcttttgactaggtcttcgttccacatgacgctaatgtggcagtatgacctaaataaaaaaataaaaagtgggcccacatgttagttacatcataagattaaaaaatggtgggacccacatgtcaataatacaacgttatcttccacctcccccacactctcccctctgttccccgagagggagaagaagaggagtgcctcgatcgcatccccaccctattagctaggtttctgttccgcctctgcctttgcctctacttctcctcctcctcaccgtcgccgccgcagaatcgatggagtggcaggcgcagctgacaaggagaaggacaacagccggcaatcgacagggagcagcgcgactggcggtaggcaggagctatgtgacggctgtgacgtccgagctcaaccgccgctgggaggtctaggagcctctgctcccacatcgccgctgcgggcctcctccgtttttggacttggacttggaagagctcgtcggcctctcagccctcctcgctgcctcctcgtcccccttgccggcctcccaacctcctccctctctgtgcgtgcttgccggcttccctgccgcctcctctcagcgcgctctcactggcatcctcatcccccagccagtctgcgccattgctccctctctgcgagtgctgagaagatagagagggtgagctggagaaagtgggatccactgacatgtgggtcccactatttattttatccttttgtttgactgacatgtgggtcccatatattttggtttaatttttaaaattttactcctagtgccacgtgggtgccacgtcagccaaaaccgatgacaatataatactgttaagggaccttgttcgcactggttttgtacgttaggggggccattgtatctggtttttgggctcaaggatgaaaatcgaattcggtataaagttaaggggcctcaattgaacttattgcaccccataataattgccgttagggatcgcaacacaggttcgggccagcagagggtgaaccatcgcgtgggccgcagcccaatatatatacaggtcgtgtactcactgggggtggttttcatgggtttgtatttctgtacattagaagagttgttacgagtggcatgggcaaattccattgtaaggtgtttatagttccttgcacgtgcacgatatctagtagttataaattactaatttctatgccaacatttatattaaaccgagttcacaaatttctgttggttgcgctgaaaaatgtactggttgcattgcaaaactgccgatgtgtagcaaaacatccaggagttgatgctttatgctgccgtgatcgattctgaaagcttggcagcaagagatagggtaaatgttgtgcgtattttttcctgcagctgtgtactagtaggctcttaagagttaagttcggggctaatctctaatatcgaattctatgcggattcccgtgcaaatagcacctccacgtggcgcggccagattcacggattcgctcccacgcacagccgtccgattgcatttcaacggtgagagatcgttgtggtggagcctgttgtaatatacgagaatcgaggggttttcttacaaaagcactcaatccccccatcatccgtctcctctccagcgtcaccgccgcctgattcagcacatccgccgcgtcaccgccgctgaccttcgccctgacctcctccccgctgcaccgaagcctctctatcccctgcgcctccacatgtcgcggctacgcgggcatctcgttggatctatcatcggcggcgaggaggcgtggcgatggtgccgaggttcatcggccggtggaggaacatcgtcgacttgaggaccgtgcccaggttccgcatggtccccaactactgccaccccgtgggagccgccgaggggggcaacaactatggctttcagatgatagtttgatcatgcacacaatgcgttcgacgaaatgtccatgggcattcatgggtgtggctggcgccctgatgatgctcaatcctaccttcctcgttggattactttggtgttggtcgaagcattggccgaccaaggaatgtgctgccaggagttacaatggtggactcacgtcttagagggcagttcccttctgactcatatggtgacataccgtggcgtgccgtgaaaacctgagattggcaaatggcttactaagtgtgatgccggcgtgtctttgtcactgaccaattcggattgcttgagctttccctggattaatttggttgttcttctgaaacggtttataggtgcaaaggggtgcgagcaagactacaatggacaaggtgtgtgcaactatgagctgggataatggagatgctttcatggatatgttggtaagtactactttgtcagctcaattaatgtgttaatcttgttcacacttgattaatgaaattgcgatttcacatggaatttaacaaggttgggttttaatcacactccattttttagcaccatccaaaaaatctttaagattgttttagtaatttatctactccgtacataatatcaagataaataggcatagtttatgaacctttgaattctgcacctgttccatactaagaagcaaataagaaagaaacaaataaatactccagttggttagtgtgtttgctcatatatgccattcttaagaaaaacatcagtttatatatttatttatgtcctatttagtttgctgtctatcaactcttcaaaaattatggataaactgtgctacttcaattctttgcttttgatcaaatgacagcccttgctctttccaacaactctattgacaaagatgttaaacatattttgcccaacactacaacttttgctccttagttctggaaatgatattgtatactctataaaccaagctaattcttcatttgacttatggatataccatcatagaaatagtataaggagacagttgcatattattactacacttattttttgaatatatatttcatcattgtacatatatatatttagacagctcaattatatatctttctgacaattgctaacacaatatttattataacaaagtttgcttggaaataacataataaaggatataatgaggcaataagaactgtgcgtggagggccggaagatgatgtctgtcatggccggcaagatggacgagctctggatagggcgtatggagtggtgcgtgctggaatgtaacaagaacgccatcaacttctacgagggaatgggcgagccacgcaggtgtgctcccgtaatggcacatatacagactcactggcgctgcacactggaaagtacaatgggactaagagaagggcaatggggcgaaatagatcggtggttgattcttagttgtccagtctcaagtaataaagaaaccggagatgtgtgatttagggtattggataagttcgtgatgtcttagcttgatgttctttcaaatgtagtacacaatctttgcagaaggttaagggaaaataaacaaattcttaaattataggaaaaggcaaaaaaagataattcaggagagtcacaagccccattgcataacaagcccaaaactgaatgttggagacactctagatcaaaacgttagcaagcggaaatggtatactgttatacctaattttataaaattattttatctctaacctttttacatttcctttttaccttgttgcaattactgacaatcacccaattactggactttgcagatgacatcgaaaaaatcctaggaaacactaacaagcatccattcaggacaatacattttttttcatgctagcaatggtgttgtttttttcttgcacaattttcatctcaagtcccaacgactatttatttaattcgttattaaggaaaaattgatggatgctttatctagacctctatgtacactaatatcaaacaaatctaagctatagataaattagaattagattggcctaatatcaattgggcgtggcaaagacgcgccattatttctagtactcatgttaacctgtgcaaagctgacaaccattatggttgggaataagttcactttaggtccctaaatttgtacctagtctgattttcatcctcagtatagaaaatcggatacaacgcatccctcaacttacaaaaccgtgcagaaaaggtccctcagcagtattatgcccggttttaaacgatgtggcgcctacgtggctccctttgactaggtcctcgtcccacgtggcattgacgtggcgctcatgtggcaattggatcccgggaaaataataaaaaaccgtgggacccacatgtcagccacataaaaacaataagaaaaggtggggcccatgtggtcccacatgtcagccccctctcctctctatccccccccactctctcggtctcgtacagaacggcgagcggtggtgcagaggggagcggtgggcggacgacggcaggcgacggacgaggaaggaggcggcgggtggccaggcgaggagggaggcggcgcggcggccggaagaggaaggaggcgacacgcggcggccgggcaaggaggggcggtgcgcggcggctgggcatcgcgggcggagcggccgacggcgtggagctgccgcgctcgctagaaaagggatggcaggctccggttcctggtgcggagcccgcaatcgtgctcatcttcaacgcctccgctcgtctgccgtcagcgtcctctccgtcttcgccttcgatgtcgagggcgtagatgtccgccttcgacggttgtcatcgttgccgtcaggaggaggaagaggcagaggaaaaggtcgccgtcagcggttgtcgtcgttgccgcgatgtccagccaccgcgtgccgtccctcctcgcccggccgccgcgcgccgcctccctcctcgcccggctgccacgagctgcccctcctcggggcggagctagcacaaaatgaaggggggttccacttgtttgctttactctagtttgaatcaaatttagcttaatacgagtgcctaactttgaactgacagagtatatatatggtgaaaatagacaaactatagctaaaattttgtttgaaccgggttcctgggcacccccctagctatacatagctccgccccctgcctcctcgctcggccttcgcccactgctcccctctacgccgccgctcgccgctctgtacgagactgggagagagagagaggggggggatagagaggagagggggctgacatgtgggaccacatgggccccaccttttcttattgtttttgtgggctgacatgtgggtcccatggtttactattatttttctgggattcaattgccacataaccaccacgtcaatgccacgtgggacgaggacatagtcaaagggagccacgtaggcgccacgtcatccaaaaccgggcatagtactgccgagggaccttttctgtacggttttgtaagttgaggaatgcgttgtattcggttttttagactgagtatgaaaattagactgggggacaaattgagggacccaaagtgattccttatggttgtgataggctgacagaaatgacgctgtggggaaggccggagaaacccacaacttgaagcccagcattgggccctggacacggccatacagtccacgcaggcccatcgaaaattctagtttcaagtcagtcgcaaccattggttgcgatccaattttatgtgggctgcgacgtctcccggatgcctggcccaagcgagcgcggaatcatttgggtagctttgtgcagttctttttcttccggtgatctgtttgcgtcttgatgcgatattctccacaatctccactactcagtataagctagtttgctctatattttgaattttccatgtttcagcatttcaaatgtgcaatagaataattaaaaatgtttcatcgaatggaagctgttgcctgtgaaattgtcatattgtgcttcatgattatggtttttctgcaatattttttttccggatatgccttatacgtttgcatgggaggagaaaatatgataggtaggcctaccaatttttaaaatataattgttgaatgttgtgcgcaagttatgtaggaccaaaaccactttggattgagagggggtggaggcttatttggtttgagcagttgggtgtgtcaatgtgtcttgtattcaagttcatggcttaattaggtcgatcgcagtagtttaggggttaattcaggcttttttcttataataaaataatatgttgggtgttcagtagttaattgttatgtttttgtggttcgcttatctccataagaaagtattagagggattaattccacatcataatagcagttgggtgaaggattgaacaaacaagaccaattcttggaaggaaccaataccacaggcatcttattggtcaagaaagaaagagataattatcggtataaaaactaatttgaatcctatttaaagatacgccctcgagctctaccaaagtcaaaaataaaaggaggagagaaagagagagcgtgtgttaatttattcccgtcttcacgtacaatctctcagctgatcggtcgatcagaagaaaaaggaggccggcagaaaagcccccggccggggatgacgtcaccaacgtgtcatcctaccggtggtggactgtggagtgtggacgaaacgatttgagagaaccgaagtggagtaaaatactatgtgggccatgtatttatgggaaattcgcggtcagaaaagccggggaaatggcgaccccaacgtgtgccccgaacgaaaaaggaaaaacacgggacgggtcgacgtgtgcccgaaggccgaacgtataaaaaaagccggtgttgaatcaaacggcagaattatgcgagttcgcagaagcttccttgtttaaagacatgatcgtcatttgggcttttcggttaaggccatgtttacttccaaaaactttttcccaaaaacatcattttaaatctttagacacatatatggagtattaaatatagataaattaaaaaactaattacacagttaagagaaaaatcataagatgaatcttttgagcctaattagtccatgattagccataagtgctacagtaatccacatgtgctagtgacggattaattaaactcaaaagatgcgttttgcggtttacttatgaaattagttttttcattcgtgtcaaaaccccttccgacatccggtcaaacgtccgacttgacacccaaaaattttcttttcgcgaactaaacagaccctaagagcaagtttagggggtgtttgggagagaagggctaaaccccttaatagtatactccaaatcttatataaccaatctatcgcgttcaaacttgcagtcgaatggctgacctgtacatgaagcacagtccagtgacagacagactaccgaaacagcccataattagttatcctacgtgcggcagagtactaagagtatctggaatgaccgaatgacaagtgggcccagaacagaaaggtcccgccgtgtcagtgggagactgggaggcccatgcccatgtgcgactttcgtctgactttcttctgaccttttttttaagtgtgtgcacgctcgcgtcctcaagcaaaattttctactgacatttcttgtttgtgtttgcgttgtcatctatatatatttcttcctccgcctatcttctgagcatatgttttgcacctccagctccagcaaccaagccaccccaactccgacggtccctcccacaggtctctctctctccccctcttctgtagttcacgaggagaagatcgggcagccacgaatcggtcgagagatttaatggcggcggcaaagctactgttgggtgatgctcgccgcgaaccggaggctaagatcgcctccgctctgggcgcgctcggcgtcgccgccatctccatggccaccactttggccgcagagttcgagccgtcgccgggcggcctccgcacaaccacctacaaccacctcgctgtcgcggggctcgcagggaccttccttggcggggtggccctggtcggtgcttcagtctgggtgtccgacaacccagctgcccgccgtgcagccggaaagaagttgctctacttcgccgccccgccgctcctcgccgcggtcgttctatcggtggcggcgctgctctggtaagtgccgcaaaggctcatgtactacaagccccccctgtccggccgcatcactatcttgttggagctgtattgtcatcgtgtaatagtgcgtgtttcttctagttctagtccattgtgtgtatcaccaatgtatgatcacgtctccttctgttcttggtctgtcaaagtgttgttcgtatgatggccggcttaatcgacgagtgttttgttaattatgagttcatatctcgcaatttcaagcaaatggggagctatttagtactagttttcagcttaattacatttagggaagagtggattcggagtactccatgcatatcggcgccgccgccggcgacagcatggcgggcgtttctcatcaattgcgccaccgctgccgcccccatagcagtactactactgtctcggtggcgctgggggactgcgttgccctggaggcggcagagtggtggcgtctctccacgccgctcgccgtcgccgccgacgccgacgctgaatagttctggaagtttgccttgtcggccgtcgtgtccttctgccgctaaaagcccatctttttctcctttttcttttcttttctttttttttttggggcaactgttagaagagagggaagggtgggccatatttaagtggggcccacatgccgtatcatatccatgacctttgtccttgcgttgccgccggcggcggcggctacggccatggagatctcacgcgaccatttgccggtgaggtcggctgctccgcctccgcctcggcatctacgcctgattggatccccacccctatctccactgactgtgctatcgcgtttccggcggtggttgatcgaggcggtagcccgtgcggcgcgcgagattccgcccgtccacggatttccggtcgccatcgcggggattcgtcttctccggccaacccctcgctgcgcgatcctgcgccgcccgtcctcgggcaggatctggtcggggtcgcttgtggtaggtgttgggggggcacttgggtttggaggacagcatcgttgatgtgctttgactttgagttccttgctaatttagttatgctgactgttcccataatccctaaaatcccagcagttgcgttgtgtggtaggttatgtaaagcgcattcctgtgatgaaaaatagaccctgggagacatataatcacttgtatcaagcgatccacacactaggcccccaaatattgtcgtagataccattttctcttcagtatgctgcttaaaatgcaaattgtaagcttttcgctgtgctgtccagctacatctagttccttatgtttaaagactgatattggtctttgcctctttggttgtgtgtgatgtgcttctttttaatcgcaacacttgatctttactatcggtgcatatttagttccagtatgtccttttagttaagttgctgaagcattgagcatcttgtcatgttgatcttcttatgagtggttcaagatggtttgttctgttttaatggaagtaaaaaatggggcctgtcccctcctaatgggaagagaaaaggagatgtatttcagcaaccatgtgttatagtataatccaaatagttcgctaagctacgttatatcctgttctgagtatttatttgatttgctgcaaagttattaaatttatggcattgttatacatgatttgtacttgattatatgttgctattggtgattcatgtaattagagctgaatgggatttttgctacatacacattgcttctttcaacaacccttatgcaaacaaaattaaaggactggtttctctgctgtgctgatttccattgttccctagctgaagcttaagtaattgcaaaatttgtaggaactcatctgttcttttgctcttacaataaatgtgaggtttgtattcgagctacactcatgctatgtgcatgcgctctgtctatctgaaccaatagacttttgtaaatacatttgcacaaggcattgaggtcaactaaaattctactatgcccaatggtgcagccatatttcatacatgaatatggctatcgctttgtctgataggttatggactgtgaactctatgtgtttattttgatgtggaatggcctcagggcaacgcaggataactcatacatgcaatccatacactaggtcctgaaatattttcttaatgcccttttctcttttcactatactctacttgttaaacttctaagaaaaggcttatccctctaccgttctattacatctataattcatttgttttgatgtcaaaagcagtgtattgagctgtatatcttgttggagcaattttacattccttgaggaggtaccatggggtaccaaaaaatttaatgtaaaatttggtacctgatagtacctaggtatcaagagatactaaatttacaatagaaaaaatagtacctcatggtacctcctcaaggactgtaaaattactcattttgttgtgatatactctagctcattgtagttagtgttttgacttattgctaaacccttgggagcatctcataatgtttaactctgatgaattgtttgagatgacttttttttttgtctagatgaatagtggcatcgcaaccccaggcaagagcactagggcctagaggtattcctagaaacttaggagcaaatggacaaagatgtagcaggaccagagcagaggacatttggcagctttgaaataccataatgcatctcgtaaaaaatattcaacttttaaaatttgtactatgtaatagactaataggtggttaaattctgttcttctgagtgatagaattgcagattgtaaatcaatatctacttgtacaaaagatgagtaaatcttttgctcattcttatctactccttttttatttgtcaaaatgaataggaatagcagggtgcctttaaagtataatcgaaagagttggtaaattttaatatacttctgaaagaatcatcatccttttgtcattatctttttcatgtattgaacaacagatttgcacatatgtatttttaccatcagtaacagctctttattaacggatagtatattgttctgcttttatgtagggggatgttgagttgtaagaagaccagatgcatctgctctgattttagtggcatgtataactataacctgtcaaagagcagcaaaagaaatgcctcgtagctgtgtgatacataactttgccaggatatctctctgtttatgcacacagactgctatggcatttttaaccgtttgctcagttgctcttacgtgcatttctgctggcataagatggtggcatggtggaggttctgttgttaaaccctggtatcaggacttgatcgagcaatttggtatgttcggtgaaaattcatgctcatttgagtgattgtacagtactccgaagttggtgttttctatgctccggtaattgtggatcactggtataatgaggaaatcaacctaacgtataattgccatggtctgtatttgtgtgtatgtggagactggtgtgtgtactaattttctggaatgtcatttaatcagaagagttgtttagaagaggcataggcaaattctcttgtaaggcttatgtagttcgagtgtttaacatggttataacagtagtgttttctatgacgacatttatgattaaactgtgtctacaattcctgccttttgtgcagaaaaagaaaagcactgataaaacatcctagagttgagtgcattgcgctgctgcgactgattctaaaagcttgacagcaagagttagaatagagcaatattctgcataattttcctgcatctgtgaattttgctactcttgtactccctccgtcccaaaatataacaatttttacttagatgggatgtatcatattactacgaatctagatatgagacatgtccaaattcatagtagtaggatatgtcccatcttaaaaaaatatatattatattttgggagggagagagtaaaacatgtgctcgggtgtgcaaacctgacagccattatggctctgataactcatgctccctccgtctcacgatataagggattttcagtttttgcttgtaacgtttgaccactcgtct

SEQ ID NO: 51336 - DNA, 1695 bp, Oryza sativa
ttttagctccacctaaaatgggagcagagctgggtggagctctcacaaaataaactagagttgtggagctgggtttagacagctccacactccactccagacccaactcctagagctaaatttaggagttggagctctatcaaacaggcccataaagtcaattttgctatatctcactcgaaagatttcttttatctctcactcaaatttacagtgtattttcttgtaatttatgaaatttacatggtaacttttgttttgaaatttatattggatttggtctttttctcgaagatatggtaatttagtatccattatgatgtttcttagttgctttttgctttttactatgtctattggattttaatctaaaaatttaaaatatgtgtgaaaagatttatagctactcccatataaagttctatttttctaacttgctgatcttgagattttttttcatcgaaatttatttttcaacatttgcttttagatcgctaagaacacatataaaagttttatttacaaattattttttgcttgcaaatatgtcgggccctttttttgtttttgtttttatctttataatattcgttgcagtttgcaaaacacgggaatttagatagttatgtaaaagatgtcaaacagacatgatgcggtctgacagtccaacgtaaggaagcttcgtagcgcaactatggggatgttcataaatctaagtgaaaagttttaccgtgtcacatcggatatatgagcacatatttaaattattaaacatagtctaataataaaacaacctatagattccgtccgtaaactgcgagacgaatttattaagcctaattaatccatcaatagtaaatgtttactgtagcactacattatcaaatcatggagcaattaagcttaaaagatttgtctcgtaaactagtcgcaatttgtgccattagttattttttagcctatatttaatattttatgcaggtatttaaacgttcgatgtgacagggcgaaaaattataaggcgggatctaaacatggcctatatcagttggcatcgcacgtttacatcctcgagcagtagcactgcatgtctgcatggcagctggagcatcactcgccggcatctacgtgcgcttgagcgaatgcgtccggcaatattatggagtaaaagattgcttatgttgcccctctttgatcaaaaaatagttgggtgtttggcttaggtaaagttggttttaaattttagaaataattttaaggacctttcggaaaacacaagtaccagaacaaccagaacacaagtagaaaaggccacatgaaccagcttttatagaaaaaaaccaaaacagggtcacaaccacttgaacgttcactggagaggagagattccccatgtaaatttccattaaggtcctgtttagttttaaagttttttttttccaaactttcaatttttcatcgcatcaaacctttcatacaccactggtggacaaaccatctttggtcggtcgaccaaatcccccatagccctggttccattaaaaccgggactaaaaatgatttttagtcccggttaaaaaaattttgatctttagtcccggttggtaacaccagccggaattaaagatgatttttagtcccggttcatcccctgtcagatgtatgttagggggtcgaggatctttagtcccggtt

SEQ ID NO: 51337 - DNA, 6250 bp, Oryza sativa
ttatctatagtcaatttaatagttcattcatacaatagttacatactacactattaatacttgatcccacctatcatatacatactgtgttttgaagtccgtgctacagctggctacaaatctgtagccaactgctcttctctctccttatttactacctccgtcccaaaataagtgcagccgtggatatccgtacccaacgtttgaccgttcgtcttatttgaaaaatttgtgaaaaaattaaaaatatttagtcacacataaagtactattcatattttatcatttaatatcaataaaaatactaatcatagaaaatttcaaataagacgaacggtcaaacgttgaacgtgaatagtgcaaaactgcacttattttgggacggagggagtatcttcttagaatatgtttatagccggcttatagcctgctattgtacctactctaactagcaagtttatagtgtagctaactactgactttgaataatttatagtcaatttaatagccaattcataaaatagttacatataagtatatactacgtaattaatatttggtcacacctatcatatcatacacatgcatttaggagtttgttctgcagttggctacaatgtagccagctgctcttctcaccagccatcttcaaccctccatgtcatcaagtatccataacatttaatacattgacatataagaaaaatatgtgatgcactacaagaaaaatactctgtatagacatttttctagtactgtagaggcacttatcaaatgcctttacaacaatgtagaggcattttaaaaaatgtctaataagtgtcttatggtgaattgtctctacaaacgaagagacattttataaaatgtctataagatggtagaggcattttttagagacactaaattgtaccgcaaacatataaaaccagtccaaaaaagagaataaaatagtttccttgcttttgataagtcttgaactcatgatcttttggttaaatcattttaatcttcgatacactaaccaactcaactccatgtcattacttgtaaacttgttcctttaattacttatatttagtcgtttagtacacattatcattctaaaaagtgtctctacatagtttaaaatgtctcaacaaaatgcctttacatattagacgcattttatagtgccgaaagaatgcctctacaagataaaatctaacaaactgatataaaaatgtctctagagtaaaagttttctaggcaatttttaaagtgtctctataaagtgtctctacactataaaacttctgattgtagaagcaatttacaaaatgcctctacaaaagtgcctctatacgaggtttttgttgtagtgatgagagttaataagaagagaggtaaaaagatgaagatcccatttctcgtaaagaaacatctttacacgagaaccaagaataaaaacaaggggattagatgtgaatttaatttgaagacatcatccattggatatatagactctatatatagtgtctatatgacatggtaagtatggaatatagtttctgctattgtgtcttctctaactactttaccgaattattattgctggtcgccaacgcgcggatcattattattgatattgtatactactccatattttaaagtttaatatatgttgaatacataggctattttctatactatagcgatttagattactaactgttttcagtttttttttaaaaaaaaatcgtaattaaaataataaacatcatatttatttaatattgaattttgcagttgctacatttattaaaaaactatatgtaattaatacctaacacattattacgatctacagttgtgatattatgatttattagatcaatgactagatttttctgattaatgtgagagctcatagaaaatgttaggttagtataggtatagatatagatagatagatagatagatagatagatagagggttaaaagctatttttctttgtggtggagttacggactgcaaatccatgtcttagctaaatacaaaagacgcccatttttttttaaaacaacggcagagcttgccatttcactgaataaagaagggagcaatatttacatgtaaggagaaaagtaatatttacaaaggcgaccgggcactaaggcaacatctctgctgagcgtttggcttcccgccgtagcccaagcttttgcctcatcctttatctttgcgatgaggtcgcagtgcttaactctttgtttcggaagatttgtcggtttcactcgttccaaatttcccaggagattaggaggattaaggatataattccaagttttggtacagtgtggcatgtggcaagaaattcccaccattcatgaaccgtggtcgattgtgtccagcttaccggcgccatggatgcacaggttatccaactggcaatggcatcccatattttcttggtgtatctgcattgcattccaccaacaggtgtatagtaatctcgtcggtgtgccgacatagcgagcaaactccattcttctgtcagccccgggtcgctagtcggtccgccatccaaaccctattttgaatgattaaccacgcaaatgtccatatctttgattttgtgacgaacccgtgcaccatccaaccgtgtcggtgagaaaggtcgaatggagcccgtactgacgaccctgataggtgaacagttgcacggggttgcacccgcgcggtcagttccaaaccctctagttcaccttctcctctataagagtatatacacatgtatatatagtataagagcgcacgcgcctatatatataatttttttagggtgaatagctaatttagtccctcaagtttcagtgaaggcttaatttgatccttcacgtttcattttgtctatatagatccttcaaatatttgttttagcttgaaatcattcttgggtccacttaatatgccatatggctatttctagtcaatatttctattagaaaatgtcctttttgcccataatttatatacatctatacactagaaaatagaaagccaacatgaataaacaacattacagatctacttcccattatttcaacatgtgcacatgaaacttaagcaattgctatcgtatacacttgctagtacataatttttttcgttttacataatatactatgtattatctataaaaaattcaagcatgcaatttctctcttatatatgtgaatgatgaggggtataagtgtcatttatgaagagagttgttggttcaaggataagtttgaactaaaatgaaaacttgaaggactaatatggatagattgaaacatcaaggactaaactgagcctcagataaaacttgcaggacactttggctattcaccctttatttatgtataaaaaatatacatctatacagaagtttatatacgacatatacaaactttgtatatgacgtagacaaaatttatatacatgcgcatttaaaaaatttaaaaaacatcacgtatacaaagttcgtatacatatataaaaagtttgtatacgagtgtaaacaaactttgtatacacatatataaactttgtatctcgtacgtatagaaaacaaaaaaaacccaaaaaaggaaaaaataaaaaaatactgaaaagaaaaaaaaccaaagaaaaccgaataaaacaaagaaaaaaagtgaaaaaaagtcccacgcgcggcgcggcgtccgccgccctcctctccgcgcgcgccacctgtccatccgcgcggagggaggcgcgcgcggacatccgcgaattagcaatctcttaacctggcagccatatcgcccgccggtcaaacccgccctctttgttcgtcgacggctcgacctcttgttgcttgtgtcacctccttttgtcttctacccgagattttccatagagaaaacggccctcacccacggccacagccacgggccgtaggtgtcagtcgtgtcacacacaaaaaaaaaaaaagttccacccacccgttgtcttcgcatttcaacccttaatatccgtttgcctataaatactctctctgtaggtacatctctctaccatctctgtcgtccaacctcttagtttcctgcttggttttgatcgattcaagctagtaaacgctgatcatggtgaacgttgctcgcttggatcaggctgacggcgctgcgtccaagatcgccacggcgcgggcgctgggggcgttcggcctcgccacagcctctctggccatcaatctggccgcgacacgcggggcaccgtcgtgcttcggtgacagcgcctggtactaccacctcgctctcgtgggttccttcctctccggagtggcccaggtggccgccgccgtctgggtcgccgacgaccctcgcggccgccatgccgtcggcaagaaaatcatgtacccctctattgcacccctcctcgtggccgtcggcctcaccggagcggctctgctctggtaatatttccagttttccaccttggttcatctacacgtaccaacaccgacatcgccgcctaccgcgccagcttctccccgcaggatcggcgcgaatgtatctgttaacaaccctctccttccaaactcggtaatctcaagaacaatccaattcaatacaatctcaggaaaatagaagaggaattgaaggagaagaagtagaggatgcttctagaagtggcagtgaggaggaccatggagagagagaaggatagagatcgacgaggttcaaccgaaccaagccgccgccgccgccgtggccgaagccgccgattcctgatctgttcgattcccctggtaagagttgtcctgttgttttgtagcttcaccttggactggcctgggccaacattaggagagttgatggactggcccatttggcagcccagccaggaccttaacagtatcttacctgtttgatttgtgtgatgttgctttcttgatgtttgctgtttgggtcatcgatcgtgcttttgtgtatcacctcgagtatctagtatctaccatcaatcaatcacgctgtttccctccactgcctgctgttgttgtgttgttgatcaatgcttggattgatgaatatgtgatgcaaattttgagtcactacggtatactcaaatcaaacaaaaaaatcagctaatttgcagaagagtgtatttggaatgttggagtaccccgcgaattgtgaagccggtggcggcgcggcgaccggcgattatggtgtttgtgatcactaattcaacatccacttcatcgctgccgctggcggggctccggcgacggtgcgcaccgtacggccggcccgccgccgccgccttgtcctcccttgccccttgccgctgtcatgtgatggccaaaagggttctttttggtgatttttctatccagttttttaatcaagattctgatccaattgtttcgattttggctgaaaggtgggccataagtggaccccacatggccataggagagtactactaatagtaggagattactggagaaagagaggagacatcacagggtccccgagactgggaaatttaactatttgtaactctcacaattaacgatttgccacatcctatctatcacatgtagactcttatgtgtctatgatatgtgggtctaatagtaaattgttaagctccactggtaagagtggcaaatatttaaaagccccgcggagacttgcggctgcggcggccgagagggccacggccatggcgacctcgccttcgccctcgccctcgcccaaaaagtctctatctcgctgctccggcttcctaactacatcctcttacctcctctctgcctcaattcgctagatcttgtgcagcggtgaggaaacgacggcgcgccaaattttgctcggccacgatccgatcactgtcgccggaagccgtcctccggccaccccctcgccgtgaacctgcgccggcggacctcggccaggatctggtcggcatcgcggctgtggtattgcaaacagatttgtggatgctatgatggccgtgcgccgttcagccgttgacttgtaagaacacggcagccacctcttctgattttagtggttcatacaggttatcatctgcttgccccttacaattacatatggttacatacttacatgcattttggtggctgtggtcatgttgtgaaagaaagacatcagtcaacaggtgcttaagggaatttcacagttgagcgataacctatcaaaatttgatctgatagggcagtttggtatg

SEQ ID NO: 51338 - DNA, 2467 bp, Oryza sativa
cccaacttttgtatatttgccagtttctgtatttttcacatgtggagagactggtgtgtatgacagttttcctggcatgtcatgtaataatcggaagatttgttattaggagagggatgctcaatctcctttctaatattaggcttttaccgttgcttgtgtgcaaccatcagcccttttcagactagttataaccataccattttgtatatcaaaatttatgactaaattgcactaaatattcgtgatttagtgcattgtgatgctgtgactgaatctgaaaatttggcagcgagaatgaatatcaagtaatgttgtgccgattttgctatagatttgtcgtgtgattttttctcttggatttgtcttttttaggctgttcgataagtgacaagattcgtgcacatatagcgctgggaatccgcataggattcagtcgggcgggttagaggcgctaatttcttttttttttgcgctctaaaaaattgatatgcacgctgttctctctcgttctctctcaattgaaactaaaataaaaataaaatacaaaattacagtcctatataataaaaattacatttgtaaattcagttgatatgacatgtaagtgcgtactgtaatttttataacaatgttgtgtaagtaaatatttatttgttatttttaatatataaaattacagtcctatataactaaagttatatttgtaaattcagttgatatgacatgtaagtgcactgtaattttgataacaatgttgtataagtaaatatctatttgttattttctttaaaatataaaattacagtcctatataaccaaaagagtaaagtccatcaccggtccctaaacttgtaccgttgtgtcatcccggtccctaaactcgcaaatcgaccgttcaggtcctcaaacttgtttgactgtgtcatcccggtccctaaacttgtagatcacttgtttaggtcctccaacttgttcagttgtgtcaccccggtccctaaacaggacggtctaaaaactttatatcaaaaaataatttataactttttcatatgaactctaatgaagacaaactttatatcaaaattgtagccttcgacgtgacttacaactttgtagttgaaaagtttttgaattaaaactgttttagtcccaaaataatgttgcatgtttatatattttgaaattttaattttaaaattacattttgggacaaaaaatgacttagaataaaaaaactcaactacaaagttgtagatcgagtcgagggctacaagtttgatataaagtttttcttcattagagttcacatgaaaaagttatgaattatttttaaatataaagtctttagactgtcttatttgacccagatgatattcaaatccaagtttagggaccggggtaacacaactgaacaagttggaggacctaaacgagtgatctgcaagtttagggaccggggtgacacagtcgaataagtttgaggacctgaacggtcgatttgcgagtttaggaaccgggatgacacaacggtacaagtttagggaccggtgatggactttactctaactaaaattatatttgtaaattcaattgatatgacatgtaagcgcactgaaatttcgataacaatgttgtgtgagtaaatatctatttgttattttctttaatatatataattacaatcctatataactaaaattacatttgtaaattcagttgatatgacatgtaagtgcattgtaattatgataaaagtattgtgtaactaaatatgtatttttattttcttttgtagtctgttggatgtaaatttaagggtagaaaaaatctaggtgattttttcaaagaaatcacccgacaaatagatcatgttgtgcatatccccgcagtctggacatgatccaattatcacagtgagctcggcccaactaaacttgggctgacttgggcagctatccatattttcatgggctgacttgggcttacaaaaatctccaaaaacgatgcccaaagctttaatggaccataaagtggcgatccagttgagcacgaataaatcgcgtggttgaggttcggagtttaattctccgacccctgtctatgcaaaacatttccattgtttgtttcaaaaaaaaaaaacatttccattgtttggaggcaataagaagagctccatgatacaaatgatttcttttttttttgagaaacacagtataaacgcaggcgctcacaacgtgccggcatatcttgagattgacgaagtcaccacagcgagcacccgtgtcaaatctaggaggctgtcgacgggtacgtcgcctaactaggaggctgtcgacgggtacgtcgtctaccactgaaagaataattagccgtaaatgcgagcacccgtgtcaaatctaggatttgaacccaggtgggctggttccaccacaaggaacctaaccagttgagctatactcacttc

SEQ ID NO: 51339 - DNA, 2059 bp, Oryza sativa
agcagtcgcgcgaagcgcttcccaaaaaccttattgccgccttctcccggtgcagaacgtcgaagacagaggttccacagacctgctctcccgatcgccggtgcacgccggcaagcgggatggagtagtctacgagcgacggcgcagtacagagtaggaggcaaaccctagattgatttcgcgtgtgttgcgtgaagacggcaggtcggtttatatagagaagggtcgcttgatcagggcgcctgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgtaagggtgaagtttcaatttttcggaccattcgacgcgtacgtcgtgcacgcgcgccgcctgcccggccaggcgaggcgagcgagcgcgcgcgtgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgagcatccacctagaactccaagctacacttactcacaacttgaacaatggactacgccttgaattgcaagtcttgtgcaagcaagtttcactcaaagtcttacctggtactagaccgtctgtagactacccctcgggtggagcgtataagtcatactcctaggtctttagtaagcttcctagaagattcacccaaaatctttatagactgcgaccaacagtcaagctcacaaaggtgagttctttcaagaatgctctgcaggacaacatcttcgctaattaaaaccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactcctgagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctttgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggaccgcaagaggggaatcc

SEQ ID NO: 51340 - DNA, 745 bp, Oryza sativa
tgcatatgcttctgaaattacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagttttaggtccaagtttgcgcttcttcgttattggtacattgactttcgccaagcacccccatgtgcgcaaataagaaagtgatggttttctaccaatccatatctcatatggtgttttgtccttatttctgttaggaactctatttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttc

SEQ ID NO: 51341 - DNA, 1145 bp, Oryza sativa
ttcttctttccttcatgtatttcgttttcttttcattcttgtttttttcctttcttttgcacggatcacagagaaaaggagaataaagggaaaaaaataaaaaggaaaaaaataaatgggtatcatttatcagtcaaaataatgccacgtcatgtctgtgtggcatgccacatcaacgccacataggatcatgaaggggttgtggcaatttgggacctagatgacacactatgacaagttctgtgacttggatatgcattttgagagtttagggatccagatgacacacccatacaagtttaaggaccgctcatacactttacttaaaaaaaatatatatggcttttggcggaacgcaagcttccagatataagcttttcggcgtcggcgtcgatggcgagcggcgtagagactagagagacgccactgctgctatccatgatgagaaacgccgttcgccggcgacggcgtcaatacgcatggatcctacgatgtactcaagctgaaaattactacaaaataatctgttttttttttcttttgcgaacaccatacaatacaagcaccatactttcaacttgggatatttgaagtatcaagactcttgacaaacgctcgtcgattaagccgaccggtcattaatcgaacaaacacgacagccaaacaaaacatacagaacgagacactcagacactgatatgatcatacgtaaggtgataccttcaaagcctgggtgatacacacaaactctacaagaagtagtagtgcacacaatttccagggacacaaacacgagcaacaagctagagatcgacgccagcggacggtgatgcggtcggacaggggcttgtgcatgaacatttgacggacttaccacagcagcgccgccaccgatatcccgacggcggcgaggagcggcgggacggcggtgtatagcagcttcttgccggcggcacggcgggcggccgggttgtcggccacccagattgaagcgccgaccagggcgaccccgccaaggaaggccccggtgagcgtgaggcggtaaaaggtgtcggcgacaaagctaccccgcggcggctcgagcgctgcggccaaagcggcgggggccgcggagaccggggcgatgccgactgcccccaacgtgg

SEQ ID NO: 51342 - DNA, 1504 bp, Oryza sativa
ccttgtgcacaacattggcactggactgcccaccatggcccttagacgcggcatctttttcccgagctttctcctcaacatcaagagacgctatcaacccctcaacggagtattcctgtctcttgtgtttgagtgcagtaccgaacttctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggctcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtacctataataaggtttttggattgttgagattatagacatataatgatttaatctattccataaataaatcatgacattacagatgaaaactagcatgaacgcaccattagatctacacatgtaaactacacagtataacaagaacagatcaaatatgcgcaacatattgaacacgtaccgaggtgacggaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcgaaggcagaggttccggagacctgctctcccgatcgccggtgcacgccggcgagcgggatggagtagtctacgagcgacggcgcagtacagagtaggaggcaaaccctagattgatttcgcgtgtgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatctgcgcaagggtgaggagccaatttttcggaccattcgacgcgtacgtcatgcacgcgcgccgcctgcccggcccggcgaggcgagcgagcgcgtgtgtttcccctcttctctccaccacacatgcttcaagtgactaggagggcatcctcccttttaaggaggtccccctctcctagaataagcaaggtggtactaaactccacatgcatgccatcccatgag

SEQ ID NO: 51343 - DNA, 1541 bp, Oryza sativa
ggtgctcagaagaatttcatatcactacggcgtatcaggatttgatagagcaatttggtatgttcggtgaaagtcatacacatttgagcgattgtacagtactcagaaattggtgttttatatcctctggtagttgtggatcactgtattgaggaatcaacctgacgtataattgccgggtctgtaattttgtatatgtggagactggtgtgtataccaattttctgctggaatgtcatgcaatgaggcatgggcaaattctcttgtagggctttcatcgttcattgagtttaacatagctataacagtactgttttatatgacaaaataacagtactattttctatgacaaaatttgtgattaaactgtgttcacgatttcttttggttgtgcagaaaacaatgaactgataaaacatcctagagttagtgaattttgtgctggtgtaactgattctgaaagcttggcagcaagagttgtcaattttgctaatcaagttaaacttgtgctcgggtgtacaaacctgacaagcattatgcttgtgattaactgataagtaatgtaggcatgtagctatgcatatagtttttcgggtgagttggtggtggtatgtttggtttagaactgactcggtggaacattttcagacgtcgcatcagctgtgcgtttgttgggccgtacattgacgtacttgggccgtgggccgtgggctgatctgtggagagaacatcctggtcacgtctatctcttccccctcggccaacaccgagtttttttaaagagaagggtattttttatccggtctctacatctaaccggatatatacgaccattgaaataggaaacttatccccacaaacaacccaatctgaaattcgcgggagctaacaacgagatgcaggggccggggttggagctcggtggtgacggggtacacgtccatggcgcaagctcaaattcagcggcaagcaactcgtcgttgatgatctggtacgtacgccacaccgcctcctttgagattgactgctccggtatccgggagggaggtgcggacgtagcagggggagaggcgaagaaggtggagtggactgagtcgtcattgcagcccgattgagccgccgtggtagagcagccatggcgatcgatcgccggccgggagcgatacatgcatgatagtccctccgtttctaaatattcgaccccgttgattttttttgaagtatgtttgaccgttcgtcttatttaaaaaatttaagtaagtattaattcttttctggaaagctatgttacttccttgctggaaattaaacagtgcccccgagcgaatacagagaaaggaaaacatgtggtccacttagtttctaataagtccaaactagctaagaagaatcaagggtgcagccctcgtcgctgggagaaaccacacgcggggtggatgaagctgaatgtggatggatcctttgacttgaattcaggttcaggtggtttaggtgtgatgctaaggaatagttctgtcaaatctattttttctgcttccgga

SEQ ID NO: 51344 - DNA, 734 bp, Oryza sativa
ttatatagggggtaattttgtaaattcgcattttctcagttagatccggtcgataggcgtccagtcaaagcagccgctgccggcgcgcagctgcggcagctcgcagcggcaagggcagccggcaggtggccgaagcagcagtgcggcatgcagcagcagcaggcagggaagccccgcggcggcatgcgacaacagcaattttaaaaaagtgaagaagaattttataaaaaaaacatatgtaccgattcacaagtgtttgtagagaattagacttgttaattaacttaattattgcttgtatccattgttattgaagcggatgaagcctgaatcatcaaacaagtctgatgcaaacatgcagtagttatatattatcacgggctcaggcttttaatactcaagaacttatatcgctagagagactgacggaagcaagttcctggaagcggacggctgctgctgggcccgacggcggcgatagtgctgcgcacgagaatggcagtatgttggctttgctcccggcggaggctgtatcgcttccggcgatcggcagcggcggcggcggtgacggcatcattgcgtacgacagcggctgggcggcgcttgtgggactgtgggagccacacgcgagacaacgtacggctgccggcgacccgacgtaccgcgtacgaagtagactgaattggtatcacgaacggatgacgagatccgaaaaataccaccgatggaaaaaa

SEQ ID NO: 51345 - DNA, 38414 bp, Oryza sativa
  unsure (1)..(38414): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttatccactcaaacttgtgtcttcaatcaagatttactgaaagctataaatcagggcctaacgccatgtgggatgcacatcccgaagactccaccatctaagtggtaataagcatatgttaactgattatttatttatttatttttcataccttggcaataatgtgcatatatagggtgtgtttggttgcaagccacactttgccacagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccatatgttatgtgtttacaggaacatggaaagatcatatgagtgctacactgctactacagaaaagaccttcatggtgctgttgtgattcatgaattcatgatgcttgctgccagcagccacccatatctataatctatatatgaagctcaatttgtaataatttattctaagagcttttgttacactttgctataaacttgagttaagtttcttgttaaaaaaatcattgaaacaatattcttgactaaggttccacgttccatgctatcattccaacaaatataggaacatgttcctctagtagggtataccgttccagataatcgttccgaacaaccaaggaacacgttccatccatagttccgtagagttccggattatcgttccaaaaaagctaggaacacgttccacctatagttccgtacttttggaagaggtataccccttcgttccatgtttttggaaaatggcgtcccgcgctccacgttctagttcctcgttccatcgatccgggaacttttgtgacttaggagccggtttgagagttgttgtttctgatttcttcttcacagcaattctttttttctacaaagacaagattagtgaataatcggctgaggataaaatagttataaaagatggatcctagagaagtgagctggagcagagggagtcggaggagtttgtttaggtgaagccgatggagttctttcagtatcacttacttcatctgcggcttgatcaataccctctccgatctcttcttcatccagagcttgttcaatagatggatccagggcaggcagatcatcggttggcttagtcttctttaatttggccttcttctttggggctggagccgatgtatccacagccgatgacctggttcttctgtttttaccggcatcggctggttctctgatgagccattgaagaagagttgaagtcttgggggcattatagccgatgacaggaggagatggcccacctccatttggaattagacctagggcatattcgatatctctaccactattgctttgatgtggaggggaagattccattctctgcaaaacagaagagaagattagtcaagttatgaatcggctgataattgttcaaatgaaattaataagatcaaggtttacctgaggtataacatcaggaaagagatctgtcatatacattgaggccggttggtggaacagatgcaacttccattcaccccaccatatgtcaaatgatctgctcctgaaccttgccaactctatattctcaatactacccaaaggaggcccttggagattaagcagtcgatccatcatcaaggttgatgaaatttcccctcggcattgaattttattggcaaagaacaaaccgattggtagttgtcccatcccaagttgtctgacagcactcatcggatgatagaactcataagaaatttgaatattccttccttgatgaatgccaacaaggaggatgcatggactgattgcaggcgagaaaacttctctggacttttgatatctttcatggttgatgtcctcaaatctaaagtccgatggattttccaggagagtcgagtcttcataggagaaccaaatccgagcgtctttctgaaagccatcataaaaactgcagaaccagtccttaagcagttcagctgatagctttgctcctgcatcggctggtgtggcatattctccataagatgtgcatctacgatgggtgcgttcctctccatcatcttctacaatcggctccagtcttgggaattcggcttctgtcacagatggccgattgacgaatttcatgaccatcagattcaaccaggattgtaataaccaccatggtccacctgccccaactactgagccgatggctatcttagccgatgcattattcagcatttggtacaaatagccgaagaggatcttgcctaaggggaattgtctctttgattccaaggcctcggctacaaactgccagttggttgtagggccgcagcttaatccacagaagagaaattcctccagccacatcaacagaaaggctacatgctctcgaggagtgacagaaccttggcccacatatgctgccacataacctgaccagccgtctatgctcttggtcctaaaatcatactgattcttcatgttcagactcatagagttggccgatgaggtgacatctagaccggtaatcatggtgatatctattagagttggggtcatcggcccttggttgaacaagaaagcattgatggtgttggaccaaaaataggaggcgacagccattaaaggttcatccttgtcagaattagctatggtaaggtcaagcgcttggccgattccgatttcgtcccaatgaaccctcttgctagccgacatacgcttgaaccatgtaatccaactcttctcgggtgaagttttctcgagggatggccaagatttaaaggtgttcttctagtgacctagatctgggttggccaatctgaaaggaatcctattggtttcgccgatgataaactcggtaggatcagggttgccgactgggccgaggaagtaataatttccgtgcgataggcttgtaattgcaactaggttggagagatgctacaaatccaaaagaaccgagaaggggaaagcgggataaggagtaggaaaatcaatctgttgcgagaaaaggagatctagccgatgagaacttacctcagcgtactcggctgatggcgcggcaggcgggctggcggaggatgacatcgccgcaggcggagatctggccggagatgagatcgcctagaaatcgcttcgtgcaccgaggggatcgccggggagagagaagacggagcttgcttcggtggtgaaaacggaggaaacggtgtgagatttctcggggacaacggttagtatttaaagcactgactaacggtcagaaaacggcacgagaggatttctctcggagtcgacgtatggcaaatccgaaacattatctaatattccgaacttggggggcatgtgttaacgaccaaatttggtaatccaaggatcggagatgaagaagaaaccgagatggaattcgagatggaaatcgtcccggaaacagagtgaggatcggctgaagtccgaatcggctacaactaaaatcggcagagttcgagtcggactgggttagtcgattgagccatccgacaatatgacgcaacatatgttgttggtttaggttgacgtgcttcaagatgattgccacagatggatagagtcctaagaaggcaattgtatctattaattaggatattttatgtaatttccttagagatatgtttgggcaaaagtctgccgcaaagacttatggtattttagagtttgttagagataagagtcatgtccgatatggacatattttgtaattctcaggtgtaaatagaccctgagccccatgtaatcaaactaacacacgttcaatacaatctcggcgcatcgccaccctttttactacgagttcttgttttcgggttaagctgtatcggtttcgatcttcaacaagaggtaaaacttgctatggcggcttgcgttctcgggattagtgcttccatctttatgatactctaatcttgtttatgtaactcgtcgagttatcatatatcctacataatcttcgacgatatcgttatctaacctacaatcggctaacatctgtcagaagagggtagccgattaggttaaataccgacgttgacttagattatatatgatatccaccactctatgaaatttccaacggcttgattgtctagatattttctttcttttcatacttatagctgcatcagttgagtttgatcttatgagtcgtgattagaatctcaatctctagcctgtctttggttgccgattagggtagtatcgaggtttcagccgatcttacctgatttaactacatttatcttatttgccttattgacatgttaaatctgccctttatgttaagatcttgttacatctaagtatattaggctttttgtttggtatatcttacttactttaatatcttaatatagagtggtatcggagtattagccgatatacgctagatctatctgatcggctttgctataaacacatatagtcttgttattaatatatatttcgatctaagtgatttatactgtctcggcacggtgaccgatctatctcaatcacttgatttaagtatatatcgatataaggactatataccgttaatatctacagccgattgagcagatctagttcttattaatgactgtcgatcgatgcatttatgacatcggctcaaagataaatgatatgtcatcggcacttagccgatcggctatcgtttatggatttaaccgcggtttttttttgtctttgtttcttgttgaatgcaggatcaaattaactggtacgctagcatacctaaagacaagtttttgacctgcactggagttaagcagatctcccaggcctcgtattttcacatcaacgagaacgagaaaggagagccaccgctgccgctgcctgcggcggcagcgtgggttcatcccctggctcggttacctagagtatcacgatcaggtggaccgtacaggtgcaagtacgagggttgcggcatggagtataagacacaccaggggatgggtggccacgtggctggccacatcaaacagggacaagctggctgccgccggcggcagtggcggcgccggtgccggcaagacggagggcaagcacccgtgcaatgtgtgcgggaaatagtaactgacaggagtggcacttggcggccacaagagggagcactacaataagtaccttgaccttaccctctcctcgcgccacgcggacaacttgcggcgccgcctacacttgctccagcttcggcggccatcgccgcggcggtggcattgccactggctgagacagaaacggaggtggctaaacatggagatggagcagggacagtgttggcgcctccatcaatcgttgtgcggatttttggcgttgatgcggaggaacaagacggtggaagcgactaaagaagattaaaatatacccagtcaaacagtatagtagtggtgattttagatacttgatgcagctactgctcctttgttatttagatagtgatggggattatgtttatactttaaacaacgtactgatatcatagggatattatttacaaagagaaaatatatctttggttgtgtttagtccccttcaaactttcaaaaattccgtcacatcaaatatttgtacatatgtatgaagcattaaatgtgaacgaaaaaaactaattgcacagtttacatgtaaattgcgagacgaatcttttgagcctaattacgccatgatttgacaatatggtgctacggtaaatatttactaatgacaaattaattaggcttaatagattcgtctcgcagtttacaggcggaatctgtaatttattttgttatttgtctatgtttaatacttcaaatgtgtgttcatatacttaaaaaaattttaaaaaggaactaaacaaggccttcttttagaagttcttagagattatgtttttagagagagatagtatacacgcgcactatattgccgagtaaggaaggggatgcatttatctaagataaagaagtggattctaaactctcgagaagatatcccaaatagttatattatttttttaaaaaaatagaaagatatattaatatgtgatatatcactctttaaacacgtaagttaaaattcaacttttacaggtcttagcgaaaaaaagctatagcgttaatacaaaattatgagaaagaatcgtaaggttccattcttaggaatttggactagtaagcacactttccaaaagcccatagtgctccgatttttttttttgcaaaaaatctttcttcattagtatttcttccaatactttttcaaaacaatatttttaaactctgtaatactccatccattttatattataagactttctagcattactcacattcatatagattttattgaatcttaacgcacatatatatagattcattaacattatatgaatgtaggtaatgctaaaaaatcttataatatgaaacggaggaagtagttaatttatccatttgtgcctttgaaaaattatcatacacataatcatgtattcaaacattttttttaagaattacacttatagatattcctatctctttgcgagtgtaagaaaaatattaaagcataacaaaaatcccaaatacaattttcaaatcagagtgaggtgccaaacgcaaacttgaccagcggcagtgccaagcgcccaagcttctaaaaaaacaaattagactgcaaacaaccttggcacccacggcgattagccaattgcagccttggcacccacggtaattctaccgtacctgcccatgctgtcgtcatcccaccgaggggagtcaaacgcccaaaaccatcaaaaccctcttcggctcggcccaaacccctatctaccctaatccatccgccgccgccgccgccgccgccgccactttatgctcgtctgcctccggcgacgaggcctctcgctcctccggcagcgcccgccccgccccttcccccctctcccgcgcccgcgcagcagcccaccccgcgtcgcctccctccgccccctctccgccgcggcgatgggggagaactccgccgccgccgccgggaaggggaaggaagcgaaggggaaggcgacgacctcggcctcggcctcggcaccgaacgtcgagcccgacgtggcctaccttgaggcggtgacgcagaagcggatccggcagttcgaggagatccaggccaagcaggccctcgagcgcctcaacatcggaggcgagcccatcaggtgagccccgttctgcgattcgttgtgaatttgatgtagttaagaaactgggagggctttgattcggaaaccgtaatgcttgcggcgcgttatagatgaaaatggagttagatactacatggatggcagatgtctcaggcattgagatgtagatataggcatatagcacaccaagggaatatcctcgatagccatgctttgtgctgcataatttggagtcggattttgagtgttgggaatatttgaatgtcgatgcgacgacaaaatgggcgctgcgcaaactgcataataatgccataatgttattcaactttaacatccatctgtctttaataagaaaatagagacggcaagcatttcttctgcctaaatattctaatatagaaaacccttgattatatggtgcttaggtttccttttctcaatgtacctttgctagttacaatacaaatgtggcacactgtgacctgcaatgtgcagcacaatggcaatggcaattaattcttctcatgtgatttttttccctgcaactttcttcaggataactttgccagatggtgcagtcaaggacggaaagaaatggatctcaacccctatggatattgctaaggagatatcaagtggattagcaaatagctgcttgatagctcaagtgaatggaacactgtgggatatgacgaggccactggaaggtgattgtgaattgaagttgttcaagtttgatagcaatgaagggcgtgacaccttctggcactcaagtgctcatattcttggagaagtgagttaaagcttcataatttccttgtatcatgtttttttctttaagcaagttgtatggttgtctctttttcttttttgtttacacatcgagtgattttgcatgtctctctgctataagtccttttgaattcagtattttctaattgaagatgcacttttgcagtctcttgagagggcatatggctgcaagctgtgtattgggccatgtactacaagaggggaggtattgaattaatcaaaaatcgtgttcagtgcaagaaagataataagccctcttagtgattaacataatgtttctacttttacctgttaagggtttctattatgatgcctactacaatgatctgacattgaatgagacacattttggtatcattgatgcccaagcacagaaagctgttgcggtatgctcttattttgaactcattttaaagtttgtgtttacccttttttgtggacgctacttagcagttttactctttgacttatttgatattaatctgtcatgaagtgtgatatcgttattggattccatgattatgccatgttttctttgtaacgtaattggaatcatctatctgctaactcttggtttttaacccaacatggtgcaggaaaaacaaccatttgaacgaattgaggtctccagggcagaggcccttgaaatgttcgcagaaaattaaatttaaggcaaaattcctgatttatgcttgttcttgatcttttcttgtactctaacagtcccattggttcgcttattcatatgcttatccgaattgcttattaacaaacaaaaaaaatcatttgtgactaaaacgactcaaaagaaaatgctgtaaaataaactataatgaaagaaacaagaaaaaaattaaattaaattaagttctaaatttcaaaacttgacttataagcataagcataagcgaattaatgaggccctaaatatctatttctgcttatatcacatttgagattttattaaattttttatttgtttgaattgtgtttctaggttgaaatcattaatgagttgcctgaagacaagaccattacagtatacagatgtggtcctctagttgacctttgccgtgggccacacatccccaatacttcctttgttaaagcttttgcttgtcttaaggtaattctttggttgtcttaagcttttgcttgccaatatttttatggaactatccaatttgtacttgcatgtaaatatgtaggcatcatcgtcgtattggagagggaaagcagatcgagagagcctgcagagagtatatggaatttcttttcctgattctaaacgtctcaaggtatagcatatgattttggctattgttcagatatgggcgttcattaattaatgtggagtctgtttttgtgctatcatgtctgtgctactggacacaataatgtaccctctatgtttgcattttagacactagagtattaatatttcattgtgataagattggagttgatttggcaggaagtttagcgtgcactacatggcatgtaaattgcacaaaatatacaactatatctcaaaagtgtatctatgggctctgtgctttggtggaggttggggttgatttgcccaactgaacaacaattgtcattacagaagtatatggtttctttttattagtcagttattacgaatttcttcaattaatacatggttaggttcagacagtgcaacccttgtcagctattttacaagttactaattcctaagttcttttttatccatttgttttatcactggtacactatggttttcatatatgtttcctgctcaataatccataggaatataaacatctgctagaagaggctaagaagcgtgatcataggctattaggacagacccaggatctcttctttttccatcaacttaggtaactcaaggttttcggtttgactttttcatatcttaatttaccttggcttctattctgcctcaggatgtttgattcactttgactgtgcagtccaggaagctgcttcttccttccacatggtgctataatatacaacaaattgatggattttttgcgacagcaatacagagatagaggatatcaagaggtgggcattaatttgattggctggtcaatcttttgttcagattatgattagattactagatcatgggcatgcatttccactgtttctctctgttcatgatgtctgtattttcaggttttgagcccaaatatttacaatatgcaactctgggaaacctctggacatgctgcaaactacaaggagaatatgtttgtttttgaggtaagtctagtgtgcagaggatttgctctgtacatattatagattacattttggatgaattacgatctttattactgggtgcttgttggtcttattcttgcagattgagaaacaggaatttggtctcaagccaatgaattgtcctggccattgcctaatgtttgagcacagggttcgttcatacagaggtaaatctccttcataatggcatagttgtatcacaaaatgtatctcttttatcaagtgaaaattcctgctgtcaaagtaatcgcttcaaccttctgcctgtatgaactgtttttcttctatgatttaattctccctctatttctttgatattgtgcatgcacatttattatctagtggcttgtgctttctcattaaaattttcataaactgaaaatgtaggcagcaaaaacagttccttagttgtctggcaattaaactaggggtgggcataattaaccgtgacgaagaactgaacccgaaatgacccaaactggaatccagtaaaaatatcgggcttcagctctcaataactgaatttagtcctgttattttggttattaggctcgggtaattgagaaatcgaaacatatcaataagccttgtccagttcagcccaagagagaaaaccctaacttcccctcacctccccactcttaactccccagtccccacttctcctaccactaccccgactcctcccacacacggcaaacgctgctgttgccgccccgccctggctcccgcctgtgcccccacagcatgctgctgtctctgcaacactctgcctccgttgccgcaattccacgccatcaacagtggggaccaccttcaccagagatctcaaggaggctctcggtgctctgccacgccggagagctcaaggcggcggttgctggggaacactggtgtcgccaccgttgtgaacatgcggttccctgcccatggtcccctgatggcagcggattggtggacacgtctatgcccgctggctacatctcgtgctctttgctccaaattgtgttgatttgaacttcatctatgtagggtattgtgcatagatctaatttgtgttgatttctgttgattctgtggctgattttgggattatatgagttgattctgtggctgatttgagtattctatgatttctttttggatgtgtaaaacagcagttgtaatatcttggttagtttggtcacaaccggagaccgaactgaactagccgaaaccgaattcgtcagtattcatttttttttccaatgtgtttcggtctctattttcagatgaccgaacttttcaaaacaccgacgaactgaaccgaatgcccacccctaaattaaattcctaattcggcaaaagtaacggctctagaattacttagtgaattgttttttggtgaatgatgtagtactgaaattgttgtccacatgtacattttgaactattggcttttgctattgatataaatgatgaacttcccttttctaatattatagcaaggggaattttatatatgatgtgttgtgtttttgtgttttgacaacctttttcttaacactaacaacttaattaaaatgctgcagaattgcctctccggatggctgattttggagtccttcacaggaatgagcttagtggtgcacttacaggtttgacacgtgttagaagattccagcaggtaatgctaatgttgttttgtgggttgttaatttctatactaattcaatccagttagtaatctccttgttttaaccacttctgatgcattttccctgtagatgatgcccatattttttgcagagaaagccaagtaagtttgaattctgcaccattctgtatatctgtttttagtagggaaggggtgccattgcatcataatgacatgctactgaacagtgtatttacactgtgtgacataaattagtttaggcaccagaagctcataatatttagatgttcatgacttgcatactgtatggatgctagtttgtattcccatttgttttcacaatgtttcagatggtgttaatcacaacctccttttaacagctgcactgtgcttcggataattttaaatagtgtcccctgattgtataagggcctacttttcttaagagttctttctttgttgcagatcaaggacgaagttaaggctgttttggacttcatcaattatgtttacgagatatttggatttaaatatgaattggagctatcaacggtaatcatctcgttgttgctgtatgattaatagcatctagaaattcacaggaactaggattcttggaacttcaatatgtattcgagaagtcacataaatagatgcttagcaagtgttaggttgctgttataatctggatgaagttggttaagtatctttttaccatttctgcttcccatgtctactcctgcctaaatcccaacataccaggtaactttgtgatgattgcatttaagagaaaaaaaggttatctctatacaaatttttaaaggttaacaagtcatttcatctcctatggtcctactggaattcctgtgcacatttcttgaacaacgtagaaggaaaatcgaactggctatgaagtataactatgttggtacgatacaatccatttttgcactgtgtattgtgaacctgaggttggtgaggtttatgaaaggcctatgaacctgctagtctctgttttggcatcgtagatcatttcatactttttgtttaatttcaatcgttgtaggcgaatcataatttatcattgtatgtgggctttggacatgtgctgagaaaataagcatgccagatgttgaacatgttacttgtattttgcatctatgtactccctctgtccacaaatataagcattccatgtgtttgatatttgttcacaaatataaggcattccacagtactaattgttccattcctcctttaatgaggggcaccaaagtctttctcctcaaccttaatatctgctgaacaacctagaaatgcttatatttgtggacagaggtagttgttttcccattttcctatcactattgtgaactgctaatgtttgggaaattctcagcatcctacggaacaatatgtgaataactgatggttatggcttgatcctcagcatggttgtaatgttgcatatctttctcttttttttttttttgcagagaccagaaaagtacttaggtgatattgaaacctggaacaaagcagagcaacagctgacagaagccttaaatgagtttggaaagccatggcaggtactatgacagtcactcccctcagaatgtttgtttcagtctatgctattagaagtgcatttccaacattcattattttcacaatatggttaacgagagtttgcactaatttcttccactatttttaattttacctgcactcagcattatcactagagtcctttgtcaaaaggtattatgctttatttagttttggcttaactctaatgtcgttttggtaacaacatgtactgtatgttgattactattgatagaaatatatttttttaatactgatttctattgatacaaatatatttctttatgccggataatattgatagaaatataatttagtggtaatgttttcagtaaacatcttaggagagattattcttctttgactcaattggctggttcctgtcatttttaatttcaaataatttcatattctcaatctgaagtttggatgtaatactggcggaatacccaatcttgaagtctggctcgcaagttgtgattactggtgtttcctagcagtttttttatcccttatgggtgtacttatttagatgtctacatgcagatcaatgaaggtgatggtgccttctatggtccaaaaattgatattggtgtgtttgatgccctcaagaggaaatttcagtgtgcaactctacaggttatattgaatgtcattttgtttttaattgtagacagaatagaaggttatttatctaaacttcatttcctgttacagctcgattttcagctgcccctacgcttcaagctgacttactctgcagaggatgaagccaaacttgagaggcctgtgatgattcacagggcaatcctaggttctgttgaaaggatgtttgctattcttttggagcattacaatggtaaatggcccttgtggttgagtcctcgccaagccattgtttgctccatatcttccaattcagtggaatacgctaaacaggtaaaaggtccttgtgtcatagaatttactaattactattaattagtagctcttctccattgatcaaagtgtgaaaatcttctagtaccttctgattcgataggtggtgctttgtcttagttttccgtggtggtccaaactatatttcttttagttcaataaaaactacttgttaaatttgagttgcctgatgggttttaaacatgtataatttttttatatgttactattattttgacgtggaatttgtctggtgaacctatcgctacaacccccagctgtgaaatatttttaaactttttgtactgcatgatgcactgtgtcaacttatttcatagaatacttatgtaccgaactaaatgccaaacaatttacacgtgtcattagactgtagtatgcatgatgcaggtttttattttaaattatagcctgatgtcgttcgaatgcaagtccaatttgatacagattatccacagctaagggcttctttttgatttatcagatctcacacatttgtctgacataagttttttgatatgtttgcatgagtaactattcagctaattgttaatttaagtcccagacaacattagctttctttttgcaaggtgaggatggcttttaaaaagtctcatgatgaaatgataacaacagtacaagattgtctttggtttcttatttgatcatatatacttcctcgatttcttgatggatataaacatccatgcagtgctggaaatgtttattccttattaattaggcttcgtttttgtattgagtggatttcatcacacagcattggaagtctgtctagtccattattattttaattggctcaatttatcttaaatggattccagatgacacttgggtgtattagtaatgtactttttataaacataatacattttgaagttcgcccactaattccacgcatggtcaaatgaaaccttgcttacagtggagtaagaattttggtaactaatcagttctcttctgtactcaggtccgtgctaggatacatgaagctggttttcatgtagccatcgatgagacagacaggacaatacagaagaaggtagttccatcatgtcatagtgtaatttatgtttgtcctttattattgtttgctttcaactctttgaatagcaaaacggaggtatgcaacaatatgtggtatgcattgttctgattttttgttgcagggactgttccattttggttttgcccatgctgcaagaaagttctattattttagtaatttagtttacacggttctcaacaatgtaatctgtgaattggtcacgaccatttttcatctttgcaggtacgggaggctcaattagcccaattcaactacattcttgtcgttggtgcacaagaagcagagactggacaggtttttaccctttgcacccctgttttcactagagatgtggaataattatttctttctgccatccatatgtacaggtgactagacaattaaattcaagagatgaagtagtcatcctcagataactaaaaaaaacagcccactggttcatatgaaatgtgtagtcctatattattatacggttgccttatcattatggcttacgctattgcaggtcagcgtcagggtaagggacaaagctgaactagccacagtgagcattgatgacatcatcacacgttttaaggaggaagtagcagcttacaaatgattttgatttcacacccttttgctaagaatttactccaaatttgtgattttgatggtgtagcgggcagtgtaatcttgctattttatttcttgacaaaagtacatctgattgtcttttcttaataacgaaagtgtgctattcttcatcagcgacatatatagggatgggtgtttgatcaactcttgctaacatgaactgcgtctctaattggatttaccccaacttagcgtatatttccacttaaaccatttgcagatcttattttctcataatgttatgttttggagtaaaggacacaacctgtctagttgtgtcatctaggtgggtatgacttgtcaattggtgtatggtttggtaatgatgccacataagcgtccaggtggcatgcaatgtaggatcctagagcgctagtgcgctcgtggtagtttgggaacgaaacgatacaatttaatttaataagttttgtgtattttatgagtttggggatatagatgatgcatccgtcataagttaagtctaagaactagttgagcagtttactttggctgcctttgttcaagccggttcttaacccctcttccttgttttctgcgtgtgtgtttttcaatcggataaacggtgcatttttgtaaaaagtttatatacgaaagttgcttaaaaaatcgatctattttttaaaacaaaaattaataatacttaatcaagcgctaatggaccgtttcgtttttcgtgctagagagtagcgttcccaacccgtgaaatgaacgcagcctttgtatattacacatcttaggagacttaacaaaaattgctagttatacaacatcttaaatgcgctaaactcattctcatgtatgactagttcctaagctaaggcctcgtttgattcagcttaagattattataatttggattataaggagtaagctaaaacaaacaaatagatcattataataggttattataatctgcaagccagattactataatctaataatctcctctagagaagcttttttcacattattgagtggctaaagacccactactctcagatgtcttcaataatccagagaaacaaacaactcgcagcttattttatgttagcttattataatttagcttagagtaatctgatttagtaatctaggttataataatcttaagctgaaacaaacagggtctaagtattagtcccgcactttcatctatactaatattacacaaataaaaaaaggtgtaacttaaataaaatttcatattataactagatatagttacataggccgactagccagatataatcagatccaccaaagcttggctatccaatccacaagcaagctaataaggggtagacctccaatagagaagtcctaaacaaaagcaacagttctcgatcactcaaaataaactaagttcaacaccaaaaaaaacaaaggtactacctccgtcccagaatacttgtagctttgtggtttttttttgtaacttttgatcttttgtcttactagcaaaaatgcccgcgcgttgccatgggtgaaaaaattataatgataatatacatttttcatgaataatcatttcaatgacaatgtttgtattttaaagagcagcttgtttttttataaacaatgtttttttcttgcgcgattttctcaaaccattcagaaatggcgcatttcattctaaagtttttttttctaacatgtttttttttgcttttttatttacaacgaaaaccatatttttctcctctttttgcttttcttttctagtgtgtttttgcctttttttacaattattttctcgtgcgtttttttgcttgcttttttcaaatgttctttttttgctttttatcaatacaggagaatatatgacgaaataaaagccgtgtagtaggtggtaaaaaatcgatggatcctatccgactcagagcgatttttttaatagactatgtttttttcttgcatagttttttaaaaccattttttaaaatggcgcgttttttctgacagttttttcctcgcatgttttttttaagaaaatcaccgatgatggaaataatttttcttgcgcgtttttttatttttttatggaagatggaaaacaattttttagcatttttttgcgcttttttctgacttttttctcacgcgtttttttgaattgtttttattttttttgtgcattttctctttttaaatagttaaattatattagagatagagaagagatatatattgattagaaatcagactttgtttcgtcctttccatttttttctcgtgtgcattatttattttatacgaaccattttttcgccaatttcttagggaatcggacgaacttttttagatgttttttcggttttttcgcctttataggaatcagacttttttcccgtttttaaaggaatcgaatctagtattttttttcaccacttttttttttgccttttataggaatcggatttttttccgttcggatctacggtttttttccgccacttaggggatacagaacttttgttgttgtttttcttttttttttgtgcacctttcctttttttatgcacctttatgcttttgttctctctcttttattattacttttaacaaaaacaacctcaagtaccttattgcaagattatagggatttaaatgtaaatataaaaattatagggactcaaatgcaaaagtacaaacccaaaaattaaaatcatataaaaatggaatgccctccacctgtaggttcctttttgtaaacagatctttaatccggcacatcattttgtttcaccgagatatgtgagatatcacggtatagattgatttttcgtttttaaggaggaatcggatctatagtcggacttttttttcgtttctagagggaatcggataggagtcggacattttttttttatttttttgcttttttttctttcgcccgccggttttttttggataggactattttggtttttttttcgcctcttttttctggacgtttttctttcgcccggtttttttagatgggacaattttggtttttttcgccggttttttcgcctcttttttctggatcggacagttttggtttttctttttttagcacttttttcgcccggtttttttatcggataaatttggtttttttggtccggtttttttgacggacgatggaagcacctcttatttttttaaagtagtagagattaaaaaaatatgaaattattatttattttgtttgtgattttctttattatcaaaagtactttaagtatgacttctccgtttttatatttgcactaatttctcaaataagatgaatggtcaaacgttacaagaaaaaagtcaaagcgactactaatttgggacggaggtagcaaatatgtatagcaagagttagtacattggcaagcagtcaaacctagcatactaaatgcaaggctaaggcctggtttagttcctaaaatatttttcccaaaaacgtcatgtcgaatctttgaacacatgcatggagcattaaatatagataaaacaaaaattaattgcacagtttgtatggaaatcgtgagacgaatcttttgagctcaattagtacatgattagccataagtgctacagtaacccacatgtgctaatgatggtttaattaggctcaaaagattcgtctcgcggtttccaggcaagttatgaaattagttttttcattcgtgtccgaaaaccccttctgacatccggtcaaacatccgatgagacacccaaaaattttcttttcgcgaactaaacacaccctaatacttaaaggaaagctttatatagttcatttttagcataaagcaagttttagttcacaaacgtttgcaaggaagtctttaaagcatttttaaagcgtgaatataagtagataacatgaataatcatagcatatcatattattatccttgctgccctcctcaacaacatggcgcaaattccattacaaaatcatcaaactcaacacaaatctgcaattccaaatccacattccacaaacataatttaaaagcataaaactatactcatgacacttcaccaagtcgcttatgaccgcgagtacgactaatcgattagttttagactctacagagtttgcacaactttagtcacatgaaatgaacactctagtttgtctcgtactcgtgaagcactaccgcactttagagattgaatgtgatctagaagttgcaacgaagcctttacattacctaatgcctagtcttgcactagcacgataagtgtgaacccactctaggaatgacctagagtcgttaggtgacgggccaccaccttaaacttaaggccgtggcggtaaacgcatctgtttccatgaggcattgtactgtcatattggacaaacttagacacctaaactactcccagtgagcaaataggtagctcctctagatagccctgctataccattaacgggtcaataggcactgcccatactttcccggcctaccaaaatgcaaggctagatattaaataacttatttagctaagtccacaccataaaatagcacatgtcaatgtacgataaaacattagttagtggcacgaagttcagtccggacattccccctattagtgtacaactaccaccatttgtacaccacttgccgcccaagtctaaaaccattctatacacattttagttcacaaatacttaaccttttcacttctgtccagaaataaataaataccaaaactccatttgtaaagtgttaagaatgattatttgtatagttttaggcttggctaagcaaatggaagcatataaagcatttatagacccaatcgagcatttagaaaaaactcaaaccaaagctatggttacaaacagagggttgtcaatatttcaaggtggatcatgcagcaaataggttatatctaccattttaccaaattttaaatatcggtattaacaaaatacacgtgcgattttgcaaacaaacaatttcattcgcccaaatcatagggttcaaggtgataaagggaggaggggagaacctgcacgtaagtctctctttcaccgttatcgcaattatctatacaatttacacggtatgcaattaaataccaaaatatacaaaaaaaaaaacaaaatgctctaaaatgcatgatttgtgcacagtaggtaggtgatgaatttagatgaagaaatttctattttatctctttttatttaagacttatgaatttctaaagtttgtgctgatatagggtactccttccgtcccaaaatataagcatttttggactttgacacagtcttcgagatgctactttggccaacaatatctataaaaataagatgttttaaataaaaagagtagcatattatgatagtttgtttaatgataaatttacatgattgttcttttttattcttttgctattaatagtctaagttaaaaatgttttacttgatactatgctaagaccctctttgtttaggcttagacttattggcttagacttttaagtcagcttattggcttatatgatttataagccggtgaatttaatgtcctaagtttaatggtggagtcataatctacctcacataagccaaaaaaaaacttctccaatctagcttttggcttaggccctctttgtttaggcttataagccaacttataagtcgaaaagtctaagcctaaacaaacaagcagcttttccgtttggcttttttgaagccataagccactctaacactattaagccaaaagcttggttggagaagcttttttggcttatgtgaggtagatgtatgactcaactactaaactaggacataaatccaccggcttataaatcatataagctaataagctgacttaaaagtctaggccaataagcctaagcctaaacaaagagggccttaatagtgttagagtggcttatggcttaaaaaaagccaaatgaataagctgcttgtttgtttaggcttagacatttcggcttataagctggcttataagtctaaacaaagagggcctaaaaatgtttatattttgggacagagggaatatattatttatctaggtagtgtcgtgaaatactttttataggtgatttggttaaagttgactttgcagaggtcaagataattgttttctaagactaacccatttggtttcataattgttggagtttgtatgattttctgatgtattttacaatttgtagcgtgtccaatgttagtaatttccctatatttttaggtgtttatttgtacagaatgtgttactttatgttcttgttaaagaaagataatagttcttaacctaacaaaactgagttcacaagatttggagctaatatgaattttctacatattttacaaattgtgatgtgctttatgttgataatttgttataacaacttgagaggcattaaatgtactaaagctgagttctttccccaactataacaacccacttccctcgttttccacgcgcacaattttcaaacagctaaacgtcacttttttgcaaaaagtttctagaaagttgcttaaaaaaaatcatattaatccatttatttaaaaattagtaaatacttaattaatcatagaaaatatgttgctccgttttccgtgcttagggaatgagttcgcaactcaaaacaatgaacacagcctaagtgttttgagttttgggtaacatgaataatgttatagccttgctggcctaaccaagtcttattttagcttaattggagctatagcgtattttctataaattgcatcatttataatttgtgatttaatacttatttcacccattaaggtttagagatgattttcatattaaatgtactactttttattatttttattttactgtgattaaggagtacatgttttgtgcaactagcaggactccgttcactttattttgagttcactttactttcgtcgacgatgcggaggaagcactaggcctcgggggtgaggtgagtggctggactggctgggcagtggagacgccgaagtgcctacacgtgtttccccaggtggcggagtcggtggccatcgcacacgcgcaggccgtgtgcccctcctgcttcatcatgttgccgcccttcgcccgcgtcgcgttcatcgagtccatctccagcttggatgcctcaggcttcagctccgacggctcagacccggactccttgcttccatagcagcgatgggatggcaccaactgaggggaggaccgcagcgggaagacattcccactgaggagccgaggaggtcgacgatagaggcgacgctaccttcgcctccgatgtgtataggttggaggggggggtcctcttattctaggagcggtgattgagatcaatgcattgttatttctccacatgcactgcttgtcattggctcattgttgatttcatgtctacagtagttgttgaagctgttctgtaagttcgagatgatgaaggagaagatgcgagcaataatgaacctacagcacaacgtgtccgtgtcttgcctccacaattgttgctcaagtggcccaaggaagcgtcattctgtcagttgttgacgcaacttgtgccaacaacccgatcgaatgaagaaaataaagggggatgaggaagaagatgaatatgacaggtgggttccacatacagatgggaaagaagatgggaaacgtgacggtgatgccatggtttcgattttgtaaaaaaatgagttgcacggctacgaatagacgaattataatggcatttatctaaatagacacatttgcaatggcacgaatcaaattaacccaacttttttaggaaaacgctggggatcaggcgcccgacggtgccagaaaaattgcccccctcacgcgcgcctccgcctgcctcccacgcctccccaccactagggccccattacaacaaatccctcacatattacggaaacgctctattaagggatttcgtttcatttttttccactaacaatgtttcagctagtgtactcgtaatgtttcactatgtatagataaaatgttgcagtgaattgaattattcttttacaacaaatcacccacatattatagaaaccctttattaagggaatccgtttcatttttttccacaaaaaatatttcacatagtgtactcataatgtttcactgtgtatagatcaaatgttccagtaaattgaaacattctttcgatatttgctaaaacattgtttttatatagggtgaaacaacgcttaattttttttggaaaccgttgtttcatacgttgtagcaaaatgtttcatgagatgatttggttgtgtttcagctttttaaaaatactgaatttttttcgatttgtttagtgaaacatgttcgatctagttgatgttcataaatcgggtgcccgatttagaggcgcctccactttttaaggagctatttgtaaaataattttttaaaaggacctagaggtgaacaatccatggctaaacccaccgcgcggggcgcgcccgcagcgaaccaggcgcgcattaggcgccccccgagtttctccccccttcccttgttggcgtaaaagaaaaatctccccgtctcgtctcctccgctccttgcgccatctcgcggctgaacaggggagggggaggggcgccgatctccatccgacgagcagagcaggggaggggagggggatcctggtgagcatccacatcctctttctgattcatctctgtcccccaccggtagtacttttgtctggaatttgcttgcgttaaccctagcttctcttctagatctggaagaagggattaagagaagcatttcttaattccagagccttaatcttaatacaagtaacagtttgtttgttcccctaaaagtttgggggttcagtactgaacccccatgtcccaagttggatccgcccctgtggggagattgaatggtgcccttagggatctgtgtcgttcgtggacgaaaagcggttggtggtcgcaaagattagtttttaggtttctttttttctcctgaagtgattgcgattaccgtgcctgtgatgaagtggcgaagagaggtaatgatggcatagattttgcattggccgttcggggtgacgttcctgtattggggctcaatttgttgtttctcccagtaactaggtgcttcctggttgctgagcacgccgaggtgtagattttgagatatactcttttgactctttaactttgagtaattttggaaattatgatggttctcttgcctaaatgatgtttattattcaaatatctttatgtacttctcttttgaacttttattttttttccacattttgtttcgctctcaatacaacaaataagcagttctggtaattcttttattttcccatttcaggagatcatggagagtagttcttcagatgttcaaatgtcacattgtgctgaggacttgaatagtgagagtacaatcgagatcaaaataaagacattggattctcaaacatacaatttgcgtgtcaataaacgcgtaagtggataacaaatgcccatgccagagactatacagttgctttttacagtgctcttatggttccttagaaactattggctatttgcatgcacaacatgttgcaattctaatgatatttaattgccttctttcccgggaacaaaataccactcaatccctttcgcatagtttaattaaataataataagtgaatgtatgtcaaacttgcttaaatttccccaagtaattttgacaacccactactatatctcatatttttaccattttctgatagtttattgtgcagcctagttgcaagttcattttatgttcgaatgatgtaaattgcctttttctcaattttttctgttaatggtagttttgaatgtataaatagcatctaatgtagagcatgttgttatatgtatgttcttttgggcatgcactcacttctgatgcacaacttctgatacacatatggtgtgcatttagattcttttgagtagcagctggtctagtgttgcattaccataggagccctggatgaaatttatgattatataagattgttgtttgctagcagtgtttttcatagggcctttatgatctgtgaacgttggttaggtggctctagtagcactcctcaggtcctgggttcgactccttgtgggagagaatttcaggctggggttaaaaaaaatccccttgtctgtcccacgccaaagcacaggtctaaggcctggcccaggtcattggtcgttctcacacgggctacggtgctgctgtgtaagggtggggctggggttcgggggttttctcaacttgcgtgagaaggttttctatgcaaaactcccaggggctgtcttacccccccataggtcgattctttttagtggtctgcgaactggaatattatctttgaactccattgatcatttttagaacctgctcagaataattctatgtaccctttaattttcagaattaatgctgcattagtttgttcaatattttgttccagttctattttttgggtggacatgccatttattgttaatgctttgtcttttatacaggtgccagtgcctctgctaaaggaaaaaattgccactgtaactggaatattgtctgagcaacaacgtctgatttgccgtgggagagttctaaaggatgatgaactcctctctgcgtatcgtatcctcatctatttttggcttgtagcattttagttgttttgtcttccaaaatttgtttctccatctacaatgccatatcctacagtttcaaatgttagatgtcattcgacaaacaatattctagatcaagaaaacaatgcataatttttatgcacaattaaaagcataatattaatatttacaaatgatgatggtcccattgtttggaatttcggatgacatgttggaaataatggtattatatttggaaggtgttgtgtttatggtttagcaatttctttctcttctctttgtatggtatgtacactgatgttgctttggtgatttttgtccttttcttctatactatgaagaaagggttcagatatccctgtttactatgaagtctttgtcgccttttgattcctcccaggataagtcactaaaacctaactggtttgatcatattattggacagcacctgttttacatttgaagtacgtacttggcttaccttgtaaatggtaatccttaactgaagtttttattagacgtggaagatggccatacattgcatctcgtggttagacaaccaggacaatccgctacatcaggaaatgctggaaatgaaggtttgtaaactcattgtgtgtagttaaaaattgattgggaagtttaagagagcattctttggacacctgcattgtgtgatataatttatttagtttcttgggctgtttttcttcttggtttcaagatcgtgaataatttttattgaagcaaaaatcttccgcatttgcagtagttctaatggtagataatactgttatgaggtttgtgagtattatttaggttgtcagttttgactctatattgctttagttagcattctgaaagactgctgtaatggaacagatgctcgtatgttgtgattgcatgtcatgaacatcgaatctgatgtgttagcagcatactgcacttggtctattatgtcaactagttgctttgtacttgtcatcattacaattactttctatcctttccattccttttttatgtacccatataaagcagagaaatgtaccacagaccttctgtgttcccaccatcttcctaataaggattctatatgctattcttgttaaatacctaaaaggctaaaactttctgacacccatatgacttgttttgttgctatagaggcctttatgccttttgatgttatcttatacctatagccatgtcaattttgtattttgatctgttttgcatttgaaaatttaatttgtattagcttcatatttctgtaaagtcaagtcaagcacactgcagttaccatttggccactttgaactatgagctttattatgtggcatgcctagaccaaaaacttgtgacaacagctgcatgttttctatattgcaccatagaattcattcttccattttctccttccgtatttcttcattacgcaaaaactgtcaattttataggtaccacatcaaatcctgctcgtcgtcgtggtcccactatgactcgcagtattgtacttgaggctattaatgtgggtcaggggagtgaactcagtgttgcacaggttttccttgttcctatgcacctctatatcttctcttactgtgttcctttggttgacatataacttatttttcacttattttgttcttttggtagttgctccaaagcctgcttcgagctcctagtagcacacaagtttcggtaatccagcattctgaaagtctttggttcagattggaactaaaaggatcttatttgaaaataatttcccttgtgttagagtggaccagcaccttctgatgccagaccttcagaaggtgcacaatcttcaacgcaaaatggtgtcagggctgtacttgatcaaatgctggttcctccacttttccagtctgaaacgtcagttgggttatcagaaccaaacgttagtcttggtcttgtatccttcacaactcacatgccctgatgttgaaatattaataagatatatggctaataacatgttcttttgcaggtcattcctgattcgttgaccacaatttctcagtacattaactttttgagagactcctttagaagggaaggcttcctcgaaaatggtcttaccttgacttttatctgagttgcccacattctgaatcagtctgaaaatttagttatttacttccaatactctttacaggacaaactctgaataatgctgaccatggaactgcaggaagtgcccatggaggtggtactcaaaatcatgaaggcagcctgattcagcttcggcgcatgggcttcctactgcagcattgcttgctgaaactatgcactctactagacaacttcttgttgagcatgctggagcattgctatctgtccgtgccatttttttattttttctcgttatgaattagctaatataacagttatgttttagcttcatgaatagtttgatctcttttctgtttgttcttgctgagttgagaatactatgcatgtagctattattcttcaatgatagggaaagtattagtgaagttagatatatcaatttgagctatttgattgagggtaatatggtaaatgtttcattgggtacaacatatgagtttggcaggtccaatcaccctccattgtctcatagattccgacattcatagttgcactcaattaaaccctgtttcttataaattatccagctaatgttcatactccccaccaagagtcatggtactataaccttgtaaaatgtacaaaacgtgtacacatcatgtctgttgagtttttcatttctaaactatctttttttttgtgttagtatataacataatattgaggaatacgcggataccattatactttattttgttttaagtggagaacaagtgaaatggaaatttttgtaaccattcatgtatgcaattaaaaactaattgcaggataagttcatttcctgtgttaattatattattgtgctgtgatcacttcattatgattacttggtagtcaactgactcccatagatgctgaaatttgtttctttagtttggtttgctgcttatctgctttgttgagttgttaacttcggttttatacgttactagcgtgtctgaagttaagatgagttatttcaatgcagcaactaccaaaccagctaggagatattgtgaatgtaactgatgctacaacacggaggaaccttcaaaacagtgtagtcagatatggagttctcatccaataccttggttcattacttctagaacttggccgcacgacaatgatgctgcgtataaatcctgcaactgtaggtttttctgacagcttttttttttacctcgtttcacattggaatgattctgtactgctgtactgaccagtaagcattttactttcagtcagaagcggttgtcaattctggaccagctctttttatctctccatctggaccaaatcctcttatggttcaagtgagtaatttataaatcttataattttaatgagtaaatttcactaaacctcacctattatgatccaagttgcacaaagccacgggtattttggcacatgccactgccacatatccctgggtattatggtcctaaagtttcacaaaatcacactgttaaccattttgacatactcctatataaaaaaaaaacggatgtaacatttatatggtggatacaatgctcaaaaatttaagatgtgactgtagaactaaaaaagtatggtagaacaaagtcaaaatgagaagtaacgtagttttatgaaacgtttggaccataacacctagggttatgtggttatgtgccacatgccaaagtttctgtggtattgtgaagcttggaccataactgggggggggggtattatgaaattttgctcttaatattaacaggtagagaacccatttatcctatttccgtcgttgctaactcattttagtccagcctgctccttttgttccaggaacaggatctgttcaagtgggcccaatattttctagtcttacttcacatcgctctgttctgcacccaagagatattgacatccatgtccgcacgagtgagtaaatgttgctatattttgtttcttcagtctgactattgtagtttgaccagcatgggagttggatgtcacatttatccatctaggattgaccagcatgggagtttggatgtcacatttatccatctaggattaccatgtctattgttagctttgatatatacgattagtctgatcaatgatcaatgctctgatcttatcatgacaattaattgttgaaatacgagttgataagagctaatttagattagaaggttgtttgattggaggcatagtccagcatactaaaattaatcataacaaactggtgtgtcaactgaaaccagtttgctaatacctcagagttgatagtttagaatgagtgcaagtcccagttggtaaggttggtttagataataatacatttgaaccaatgaatgccgattgaatgctagaacgtgttcttttttaagcttctggacttatggattttgcacctttctacatcagcattacttagataacttgttctaagctatttattaggtttataattataattactcaattataatatttacctcatccctgtaagcaactgtccattatctgtccaatcatccatacagaacatgtcttaaacttattatggcatccatgaccacacttagtttgagtgtacatttttcctactgttactttggttgatgatggttaaatgcggtcctttttggttgttaggtgggtctgtgtctttaactggtactaacccacctgagcgggttgaggaacatcaaacacaagatcgtacagatagaagtgcaaatgcttcacctgcaaacagtagtgaagcatttgcaggggttacagctggtgctccattttctgttgaatctggagttaggctggtgccgcatagaacagtggttgctgtgcctgctggcatcagtcatcctccttcaatgtcttctagtggagttggtattatctacccactgtttgccagaattcaacaaagagcatacactaacgctcaagttgcccatagtgctaatcagataccgaatccacagacatctcagtatcatgaagcaggtgaatgagttttttttttttcactctatctgtattgtttgcccccttgctcgagtattttctgtttgctcactaaactgctatctactaggggtgcaatctggttggatagctcttgactgatcttatgttgaatctgaataagaccagattaggcaaacggtcacatttatagattttttttggataggtgttgtaaactagaaatgcagatttggatgagagatgtccagattctaataaaatctgaggtccaagattgaaatgggaggggagagaagtgaaatggatttatcaccgttgcaggaagtctatggcacgtttcttcaccgtaggttggttagcaatgccttggttggcctgccagtgttaagccagaggaaggagaggatgaggctagagactgctttccctgtttccttgtttgagttgtatgttcaatttgcctttttgaagtgctaagtagtgttcctccaagtgatgaggaacttgccacattcaggtgcactaaatatcacttttatttgctcaaattcttataagtattatttaagcatttaggctagcattttacatgcaaacttattgaacttcaatatatttgcaattgtattagcattgatgcctgtctggattcgtatctgtttttttttttaattttttacatttaactcattctggaatgccttttgcgtacttcatcttctagaatttgtctaatgatttctgcatgcctttgtttcaatgattcttcattctttttacgtatgggtactccaggttgacaggctcatgttttttgcgcatcaaaagaatgggttaccagttatttgccactgcaaatattggcatctgaggatttgccacttgatctgtcatggacatgtggtcactaatgacaaatcagtggcatattgccaagtgcataaaattcatctttctgtggcaaatactcatgtttcctctataacaaatgtatggttgacatattattccttttcttaccactgaagtatttgtctaataggtactctaggatctcctgttgatatcaatgcggaaaacggcactcagacttcccctggggagcagaatggccaggggcctttttctcagttgatggatagtatcccttggattgcatcactcttttctggggaaaattctcgagtaaatggcacaaatcagcatgcaccggcttctgctgagcaggtagatggtagaaatcatggagcaccagaagtgtcaggagtcagtgatgagggtctacggttcgctagcttagttcgccaaattatgccatttatttcccaagttgagtcacatcatcaaagtgcctcagcagtcagtagcagcaccccttcacaggtaactgcaatttcttcttattatggctgtaaatacagttaagctcatgatggactaatcagtactggcaggctgcacatgggaacttgaatactgcaagagctggtccaagtcattccaggagttcacatcaacataaccgtgatccagttgatggacctaattctaaaaggcaaaggtgtgtataatctgactgacaaatatactagtttcttgcattacgtctggtactgtaggaggttcaaatttagtcacaaattttatttaagcatatttattcggttaggtaacctcaacatgcaacaaacgcatgtacatgtttcttatgataacatactaccaattaatttcattatgttagtccaaactatctcttttttggtagaaaagtaggggtgtaggggaggacaaggaatcagatctgtacttttgctttctgttttgttatcaatagaatgatatgtgaattaattgttttacatgccttggaacatttttttttcagaacaagtgagtgataaagatcttcatgtcctccggggtcaccgttttgcaagataagccgagaattttgccgattctcactgcgaggatggactgtcatgaatgtcttgacagagttgagggcagtggattattattatttggcagtgtatagttggcatccggttcattagtcaaggcaccatctttttttttttgcccatttcctgcggatcggttgtaatgttattttactatcctatctgtagaaattcgattcaattggggttaaattatgcctgcaattaaccaaaagcttcgtttggtagtaattgctgtagcatgtggagaatttttgccacttaataataccctctatgatttgtacatttgagttccctttgttccgtatagggatggcaacaggccgggtcggccacgggcagagctaaaccatgcctgatccagcaccagagaatgcccgcttgaatcatgcctgatagggtaagcgtgtaaaacttggtgtccatacccatgcccaatgtacatgggcatgcccggtggatacccagtttgcacccgatggtcccttgcgtcgctgcccgccggtgttggccagagctgtgccacctgccgtcgtcaccttgagccgcctcgccgcttgcgttgagctaagccgccgtcatcggcctgtgacgccatcctgctcgctctgctccccattgtctgttgcctgtgccactaccgtcgtcacatgcccatgctgccactccttgcctgggccgccactgccttgcctgcgctggcgtcattgcttgcccacgccctacgcagccgccactgccgtggggatttgggtaggagtaggagaggtgagtgggggaattaggttagggtttctattagttgagtaagtgtgtgtattgtcaagagaaaagggtatgataattaagagatgagccaaatttagttaatacataggtaccgggttggacatggacatgtgttacctataggcaaaaatattacccaactgctgctcgctacgttctcgggcctgtccataggaaaaatattacacccattccctagctatgtagtaatatacactaatacccctattgaatggggccaaacattcctttttttttcagttataattttttccgtaattcagaaatttagatcagagtttatttgtcaaagcttagattaatgaaaattttgaaataaaaatgtctatgttttgactatctatataaattctgttttgttgtcgtttgaattcagtttgtgtatttctgggatttgagtttttttttctttaggagttatatttgtccgtgtttggagcatgtacttaatattcgaattccttttattcggaatttatattttttaataatggaataaaattcggaattatatggctacatactgttgatttagtttttgcgaatgtactactaatattcttcgttttttttcttgttacctgtcctcccgttatcagggcacaaaaccgacttgtcaggaccgctcccatcctccataagagaacaccatttttaagttggggcataggaataattcccttgaatcgtcccgtgtctttgctcactgcatctttccaaatcaccgtgcgctccttacatttgtttcagtcccctaaatcatagttgtctgacaattattaacgactaaatttggtaaggccatggatcgggttcaaagccagggtcaaaacaaattaggaggaattctgtttaggggaagcagaatgcgtatcgactgccatatgcatcggctgacaccaaatccgacgaagacaagccgatacaaccagtctcgaacagacggtcctgcaactatcgtcgggatcaattaaggcacttcatagacattgccacgcagggattggagtccagaaaatgtaattgtatctattaattaggatattttgttagtttccttagaaatatttttgataagagtccgcctaagggacttgttcgtattttaaattgtaatagagaaagagttgtgtctagcaaggacatgttatgtacttgggtataaatatggcccgacaccttgtaaacaagggacgacaattcaataatacttcggcgcatcgctacccttttctattttcattgtttcgacatgtttttgctttcgagttggcctgcatcgagttcgatctccgacgaagaggtaaagcttgttatggcggtttgcgttctcggaattagtgcttacatcttcatgacactctaatcctgtccatgtgaatcgccgagttatcatatacgctgtataatctagatcgatctcgtcatctaacctcattagctagcctctatcatcgaaaacggccgatagatttagatatcgacattgagttagattatacagagtatctactatataaaagaccagaaactatgtatacatctatcatttacctcaatcctacgtgcacatgatggaaaaaagaggttatagtagatgttttctctcatgtttttcctgtgaaatgagttgcaaaggaaaatttcctccaacttccctatgcctggatccaatgaatcgaaggctgctatagtgccaaatcctgaatacctacatattcctatgaaattcctataaatcaaaggaggccttggcagttcaatttgtttcctatggattggattaagccacatatcttcttcttccgtgctttcttgcatccaggaaggcttagggcatccataatattgtaaattaataaccataattaaaggccataagttggacgataaccattgtggctttaatcataagctgggccataacaaaaattaagcatatgtttgtgatcagtcacaagcgaaaaaaaagagaggagaatctctcttctcgctccaccgaataaaaggttggtttgaaatctttttcatttgtcaaagggttcacgtctattgttaactggcatagggttgagggttcaccttaaagttaggttggcaataaacattggccatatgcgcttagttgagctattaccttgttttctgttggcacgatttataaaccattaaacggtgtatcaattttgtgcaaaattttctgtacaaaaatcaaataaattattttttgaaaatttacaatagttaatacttcctccatccgaagttgatcatcatataggtttatgcatcaagattaaggataatttaaatcgcatcaattaagacactatgcacatattctcctactatgtatgcatcgattaaatcaccatgctaattacatcctaccatgcacacattctcccatgctgtattaatggtatttcaatggaattcgtgttcatacggttatatgataattaatttaagaaattttagatttgattatataatgatcaaaggagggagtactacctaattaaatatgcagtaattacctagctatttttatttgtgtatgttttacgtgcgactgattagctaaatcaacaagctctaccgaatgcataggcgcaaggcaaacaagcgaacaacactagctctgtaatttcttatagggtgctggtagaccatccagccatcatggtgcccggcatgaaagatccaccacacaccactacaacagaaccactcatttataatgggtggtaacctcgtcaatgattggtggacaatatgagaaaactgttaggatacacgtaggctacgatagcataaactaaaaatttttcaccgcgtaaaccaggaaccatataaatattagatcatagatcgttaccactcgacgcgctgcgcagcggaagtaattaagcgctaagaaggcgaggaacccgcgtgatgtagtgcgcatcgatgtagaggaagtagtcgatcacaccggctcgaccttctccccctcgtgcgttgtcctcgccgtgctcccacgccgattagcaccgcaaagcagcggggcctctaccggtatccacaaaggaacaccacgcgtagatgtgctagcatccacgcgcggttagggtttgctcggggaggggagtgacaactagggtttcacgtggtgtgttaattccgccggtcacatcccctcacgaatataaaggatacacgactgggccttcgaggcccatatgagtcctactcggatccctatccgattgagtgcatattagatctccatccaatccctttattccggccctttaagcgtgcaaccctgtagg

SEQ ID NO: 51346 - DNA, 10713 bp, Oryza sativa
  unsure (1)..(10713): unsure at all n locations
ctagatatgtgccatcatctaatagctcaaccattcactcgaacttgtgatagattatataacttgtgattaactcctcaatcacctttggcatgactatgcacttccataatctataacatcgagtggcccagatatatctctccataggaggagcaaatcccatcttgattattcatatcccactacatgttttatagtatacccgaaaactacttttataactacccaattatggagtagcgtttagcagtccctaagtaagctactacacatgttgggaaccatgataatctcaggtctaaggattcaataccaacactaaataagatcactgatgacacaacacatacggctcttgcagtgtctcatgttgggtctatctaacaacatgttcaccaacatgtgtccacattattaatttggtatctctataccatgatccatgagacatgatcatcaattaatacatgtgctgatcatctaaacatatttgttccacatatgatatttgatcagggatcctttagaaatagcaacatataatataaagagtctcaagaaagaatcacatattcattaacaaataatgagttatctatttcaaggaacaatgtcggataaatatgtaaacatagtatgtgatacaatcatctttatgatttcctctagggcatatcaccaataaaaacctcatccgtgatgagtgaataaccgttaccaataacccatcgatgataggttttaacttatcacacaccaaagatgactcccgtcacatatgagagttatctatgatggttcgtaattatgaaccttcatggatgagaatttatgatttttaaattataataaacaaaaaaacccttaaaatattcaaaatattattatattatttcaaccatggtcgtacatcactagccacaaattcatgattttttaagagatatttacaagcacactatggtgggatttcaaccgaagaccttccaaagcacataaagcatattctcagccacatgttgctaggtctttggatattgttattttggctattctggtccaaatatgaaatactaatttgactctctagatgacttaaaaagaaaacttttcaagtacaaagttgtagatctcattgagctcgtttgaaaaattcaaaaaatattgtgaaaatagatcacattacttataacacatatttggtgatgtaaacaatctcaaatgaaaatattgtcaattggaaagttgtagatctcatcgaacccttgcactctgatataggatatgtctccaaccgagatcatttgaaaaatttaaaattacgtttttcaaaatagatatcatcctaggtagtcatatcttagtcatatcttacgtgggatagtttagatccgttagacatgagtcatcagaacgggttgcattagcccatcacagataccgggatctgtggtagtgatagtgacgtttagaacgagcagaagttgctgcccttgactacctgggaagcctcatgatcatctcccttgattcattgtgatacggggtgcctgactttcttagattagaatacgccatacaacttgacgaactagatgaacgacatgcatgttgcctatgtaacgcacctttcacaacgaattcgcaaaaccacatacaagagatgatcatctacttgaccgcacaaaagtggatctttttctccctcaattcccggctagcaaaagtaagaacaacctatggcagaaactgccaatttctctttctaatttggtggtgacaggtcaaagacttggagaagaataagagcaatatttcatgtgaattttcttttcattaaatgttgtttaccctgttaggtcatgtgtacaaagtcatatattgccattacatgtgttacaaactaattaataatccaatacacacaatttcaaaacctgtcaagactatcgacagtgtagtgaaaccagaaggaaacctatccattatatcaggtgcagccataggagggttccctccgtgttgttgttggtatttgttacgaccacagataaatccgcaagcgtacggaataccgctatagcacttcaccttcgggtgacccctaaaggatatcgaactcagggaacgtgtgtaatctacgtaagcataagactatccaaggacaacaactataggtaggctggctaggcttgagaggactttctatgtgttttaattatctaagctaagttgaaggtaattttctatctgttgcttcgggcaccgactcctgctagtttgccagcgtggtttcggctatagctctatgatgtaaccgaacgtggaggattactaggacgggattcagggctgtcaccacctgctgtctacctctgacaaatccgtgggatacgcaacaaacaaaggtaatctctaacctagacaccacgcctaagttattaattactactctaatacttgcgtaggaactttcttctctatccggagtcctagtactaaagcacttagtacaaatactaaataatgaacctacaaagatggaaatctatcttacttaaacaaagtatttaaataacataagaaaagaacatgaatgcttcctttatagaagaagtttctccgaacccggagcagagtgtaccgacaactccggtactcctccagaattcttcctagaaagctacacccatcgaggtagaagtcggatgagcgccaaacttccgggcactccttcagagcttccctcccctctctccacctaattctaatgtacaaaagatacaatagagcctcttgtaattcagctcaaagttgtgtttattgaagtgagtgagagctcctccttttataagctccaaatgacggttacaagtatgggaaatgatcaatgtgccctccaaccatcattgggacttcattagcagcgtacatgtggaatgctggcgatcaacggccacaacactggtttgtccgaactggtggttcggtctaactagaaaaatatcatcctggcctctcctatggccagtaggtagcttaatgggcccccaacatcatgtactatgccaaagcccaattctaagtggttttgatagtcttatggggcctccaatccatgtaaacgcgtcctgatcgtgcggaggttcatcgtgtcgcatgacgggtgtgtttcctccttaaaatacctgcatacatatatttcaccaacactagttgaaatgattagtaataaatcctaccactaagttgaataccatattttatttcattatatgcaggtattgacggtcagatattataacttaaggaccgtcaacagttgtgaggagaagtggaggctcatttaggaggagattgagaggagaagctggcttgagttatcggaagaagaggatgtaatgaaggggaaaggtaccaagtagagaagtgggtaaggccgcaaggggtatgctgtacgccagcaataaaatacaatttatatattacgcataaacgaagctaaaatattttggattatactgtgattgttatttacctatgatttatgacgtaatactcttgctcgaagcacctaattagacatatagaaataacgtgtgataagtatagatgagacaatgtaattatagttcgatagttcagggtgtaaaataagtcaaaaaatagtttaaggggttaagtgctttagtgaaatagtttgggggagtaaaatgatcttttttcttttaaaaaatatggcagaagattcgtttgtgttaaacatcgttgtatatatgaaaaaaaatatattgttttctccttggaagttcgtactagtttttgagttaaattatttatgaacaaaaataatatttggaatattgttgtaacaaaataaaatattcaatccagttaaataaaatcatgattataagttgaacatattttattttctgtaggaaatatatttttttgttggatgtgaatatcctgatttttttaacggaatttttttggagtttattcggataattactgagttcaattcagtttttttttctctttaaataaattccgacatcatcttaaaaatctagtagatctcgaaaacccaaattccaaactcgcgggcaccaatcgccgcctccattcgaacttgcccccccccctcgcgccctcgtttactccacaaacactccctctctcctcaccgtcgccgccacgcgtttggctcgcgatccgcttgaaactacaaatcaccagtctctcccggtccaccgcggcggcgccgcctttgcagtttcagcttcactaccgtcttcttgctccggcgaggtacgtacgtacgcccccggccgatttattccatggccaacgaggagcagtacgactggtacgacgccgatggcgatgtcacgcgctacctgctcgacccgaccacggatatcgcgatgttctccgagccgccggtggttcgtgcccgtcgccgccgccatcgagtcccatcccacgccggcgattcacgtcgtcgagcgggagtggcccgctcaggtccagatctcgcgattcgatccctgctctcctccgcctccggcgaggatgcttcccggcggccagcagcagcaacctcatccagcgccggggggactggatctccgctcggatgagattcacgccctgaaacaacgacgccgtccgccgccaaatcctcagtcctcgtcaccgcctgaaggtttgctcggcgccgcaaaccctgaccggcctgacgatgacgagcttgatgctatcctaagcagcttccgtgatgaggccgcgcacggcgacagtggtggtggcgtggctcgcgtccaagtgctccccgtcgagcaagatgccaacctggtgccttccctgccgctccggcatggccaactggactgctcccgctgccaccttgtcaggcatgtcatgcacgtcgctggtaagatttttttttcatctatactactctttcttaggggtcctttagatcagacgagtgaaaaaacggagaaattgaaaaaacataggattctaacaggaatagagaattataaaacacaggaaaaacatatgaatgtccgtttgattgggccgtaggaaaaacacaagaatttaagaagagataataattaaaagattattttcatgaagttctaccttatgttaaattttctctaaaacttgtatgggaagaggcatttcataggtattttattggactccatagagttcagtcctttgattcatagggctatgtaggaaaaaaatcctatagaaataaaatcttctaaaactcctatgaatttcctttgaataatcaaagagggccttatacataattacatatacaccctgcctgatatttgaccatgataaattaaccgatctctgcctgatattgaatcagaatacggagaatgtatgtgatatcggttcgttccaatgtttacagcctcagcaagtggacgcaggaatgggctagcgagttcattgcgagaaacattgacacgatgagaaataatacaaacgggcagcttctggacagcggctactccaatttagttgaatccgtccgcaccaatgtgaatgtcccacacacggcggtggaagtgaacttgctccagacgatcatgtccgccccatcggctgatcatcatcagaatggtgagtttgtaaaaatgtatgcatgaaatgtttgcaggaaccatttcaattagttgtactgatatataatttgatattaattgtatgcactgcagctgcagatcaggtagcagccccagcggcgcaaccattctctgcagctcctccagtagcattacctccaaaggcggcgccgcgaaaagcgcgcaaggatcgggattatgctagcatgctggttgcagttgaagaattctatgtcgccgcaaccagtcggcctgtaccaaactcagacgtagagatattggaatcttctcatgtctcccagcagcaggatggaggtagagctatcatatacccaagcttgcaagccagaaggggaaagacgaagcaggaggtaccgagaaggaatgcaaaagatgttctagagtatctgagcttggcgaggaaggagactgagaaggaaatcaatactctgtcctccttcgatggaatttaccggaacgacggaacattaagctacctgatgacagaggtatatatcagctgtgtgtacgtgttaaaggaaccattttattttatgtgacatttggttcttaacttgtcatatcgtaggtacgtcgactcaacaggaagatatggaggctccagaagaatgctccgagtacactgtcgagtaggctgttggcgagcgtgaaggagattgatgatattaaagttgagaagggaaggctgtatgcgcaattcataagtgcgttaaagaagctttgccgaaagaagatggacgatggtggtagtgccccatctgccaacaattaagctagccgatcaacaatgattgcctcccagtgatcgaagtatnnnnnnnnnnnnnnnnnnnnnnnatggaaaattttgcgatacttagtgcaaatggagagtgattgcatgcagtggcttacaatccgatggcatgcaggaatttttccacgatcacctcatcacctccatctctgcgagatgatcagctgacatctgatcttacaaacactactcatgggtaaacatggataagtgacagtacagttgttccaactcgagagaaggtcttagccgcgtgcttctgagaatattttccccctttttcaaatgtttcatctggacaacaacaatgaaataatagaagtcatggtctatgcgaagcccaataaaaaaaaaattcaactatgctattttattttatttattgaatgtgtttcatgttcacccatagtaaattttggatgtgtttaattattagtttaattctctacaaacttcactaatagtaaatttgaatttgtaactcaagctcacatcttcagatttgaaaattttttgtccaggaaagacgaaggtttctttgaaaaggttcttcatgtctagtttacaaatttctaatttaatgacagtcttgcattttattttgccaaaataaaagctttctgagaagagtttaagcgtttggagtaaaacatttcgaaataatctggacggtttgcaaaacatggtcacttccttcacagacaagttggagggacagatgttgtgtttggatgaatttaattaaaggaatttaagaaagcccaaataatgagctacttcaattcaaatgaatatatattaacaaaaaaaaaagcactgaaaggagggttcaatctggtaagaaggcatactgcgcattcatgctataataatatatggctaaaaagaggggagtgagcgtaccgggtgagaaggaaatgagagagatgaaaataagggaaatgtcatcgtaagtggacaaattccgtaatattttcttggaatttgatttcagaagtattattttgattgagattttgattctagaacatgaattctaaatttgacggattttgaaaggaaattgatgattttattttcaaaattttaatggttttttgcatgttttatttcgagagggattgttgctggcctgggaggggggggtggcggggaataaaatgtataagtgcgtatgtaagcaagagaaccgtttctcattaggaagaaggaggaattcgactgaaccctggtgatcaccgtccgatttagggtttggtgtgcacggtctagatcctctcctgatggcggttgcagggcaaaaatgtcatttcgcataggcataaccgtcatacctgtcctataaatagaggagctcatttcacttcactcacgcactccaagcttgagttgaattataagaggctctattgtactatattgtatactagaataggaagagagtagagtagaagaagtcggaggaattttggagttgtcggtaatcctctccctatttctttatgctctgttaattactctgattataatagaattatcttttgagtaatttagttttgctcggtaagaattatttcttggttagttcctattcagagtacatgatcatcgttcactataatcaactaaaatatagtgatttggtttagtgtgtagctagcattaaagtaagtaattaatctgcttagacatggtgtctaggtagataattgccggtgtttgctccgcatctcacagtaggtgtgaggtgggttagaggtggtgacagccctcaagacactaaagtcatccctgtctgggtgcgcagtagagcgatatctaggagcagcgagctggccagtgcccgaagtacctcattaggattaaagttaagctttccgtacacactgttattcaccgacgaaacctctctatcctttgcctatctatagcttcgtgtccttgcatgaatctaaattggagatagcatacacgttccctgtggaaatcgatacctgagaatactcccgggtgaagtgctacatcggtatattccgttcgcttacggatttatctgtgatcgtaagaaataccaacaccctccaccactgcactgatccaccaccgccaccgctggacctaaagccctctccactgctccaagccttcccatgttggatctaggggatccagtcgttgatccacaacctccaatcaaaacctaggcgccacccctgctgctagcagtaggagtcgcatcgctatcaaggtcgtcgtcctggggtcgcctccgctggatcctcatgaggccgacgatggtggtggtggaggaggagccaaggtgcgcggcagccgctcccatcgctgccaccactagcagtcggggtcaccgtcaccatcgaggtcatcatcccggggctgcctccactccggctttcacgaagccaccagcactagatctagccatcgtgaggccaccggtggtggaggagccgaggcgcgtggcggccgctcttgttggcccatgcttccattacaagatacacccattgctggccactccagtcaccgacaaaatggggaagaaatgataggggtagaaaaaaggagaatgaagggggagtgagtaatagtgaagtgatgggggaaacaggagaggagaatgaaaataaataaagggtgaatgaatggaattgcgtccggccgtatgatcctatctcaagagcggtcgacgcctcgtcctgtcttctcagaatccccttccatcagcgcaaaatccttcggtctcgtcttctgacatcgttcacctgcacttcaccgaaagcaattgggaagaagtcagaaagaagcattggtggcgaaagtcttcttcattcattcaatccaacaaccaagtgagcattcaatccagaagagaaaaattccttaaacacatggatggcaaatgcttttgctgcctgagcacccatcatcaaatttttgattgcagagaacatgtccgttgttggttctgtctgaaatcgggacaccttgtggctagttgtcacaagcgcttgagctataagagcaaccctcccccacctgctatgtccacagaaaacttcccagcgcttggtcccctccatttccctcccaaatctttctctgtctctgcttcttcctccatggacgaccttactgcccggcctttgcttgactctgtggtcgtctctaccactggggagatagagaggcgcagggagcgtttctctgcctgctccttagtagcttggcaagtcggggctttgggtgataaggtagaactcaatgtctttgctgatgacgtccgttctgccttccacattagacgtgctgacatccaatttaccaaattccaccccgaagacttctttgtgacttgctccaatcagagtgatcgggatgccattctccgccaaccaagacttgctacagcctctggtcgggtctttctctttcgtccttgggatgaaagtctccacggtgtccaagtccgctaccgctatcgcgcccgtctatgtatcgagggcgtccccatgcatggtcgtattgacgagacgatgacaaaggtgatcggtcgcaagtgtgctatccactatgtggaagagtactcccgtcgtggcaactacaatcgcacctacgacttgtggatgtggacagatgagccgagggctatccctcggggtggctccttctccatcaccgctgctaatgaggaggtgctaggggctttccactgatatccctcttccggaactagagccgcaccgcaaccctcctccctccgagccaaagaagggctagacctacaatgtcctggtccacgtcgacactctggaagatcttctctctcgcaaagcccgtgcttacaaatgggactatgaagttcaagatgatggcactcgctacaaggagtacgcacttccttgtagagctgaaccagacccaacccgtggccccgaggatgaagatgaagacggagacagccactccaggggctagcaccgtagtcgctctctctgggatcggcttagtggtcgctcctccagtcacagcagggatacggatcggtgggacagccagcgccgtgatcaggacaaacgaggccaatcacggggaaaggaacgctctgatcataggagtcgcagccaccggtctcgcgatccaagtaaggtgagaccacctttttctgcccaacctgtctctcattcggatcaatatgctaaa

SEQ ID NO: 51347 - DNA, 1606 bp, Oryza sativa
gaatcttggaagccacctcgatcccatgttgcatgaagcggtagttcagcattctatttactcaccggatacagtctcccgtcgtgtttcttcccctatttttgtgccatcttacacagggtgggtggcgacctccaacccatcctctcctgcagtaggcaaggtgtcacagatcgacaatttcatcaacaacatcgcaacaccaatccaatctcccctccttccggctcctgatgttaaagcgtggaaaccttcccgtgcaaaggtgaagatccgtgccattacctcagcccaacaccatagtgagcgtttgctctgtaagtgccatgcgggcgcaaagctagagaatttaggtcaggaaatactttcaaaaaatttcggtctcattgatgattatgcatccttcgatgataatattaaaaagttgtatttatagcgctacaagaagccgctctccccggcttctctgaagaccattgctgatctggttgaaaagggaggatgcaagacaatccgtctgaagaccttgaagaaaaaagcggctatagcgccgctgtgaaggtcttcggcatgaagacagttgctgtgaaacactccatgtcaagtttcaaacctttgtcagagttcctatgctcaagctgtctgtgttgttgtcacgccctgaagttcccctcccttgctttaaatttgctaaataaatcgcatgaagaaattggttcaaattaacctagagatgaatccctaattaataaatgcaaataataattggaataggcatatggaatttttcttggattctacatgtcaaaatatgttaacaggatttttagtggaattttcagagctccagagataattttaatcaattaaaattgagcacaagcattaaaaagtccctggaaatccttttattttcctttttccctttttccttccttttgcccctcttttctttctttgggccgccaacccatttcttctccttcccctccctaaagtccatccgagctccccctctcctcccgggcgccgacaggtggggcccacctgtcgggttcgcccctaacctccagccggagggacggcctccctcctcaaccgccgctccaccccacgcccccacgccgcctgcctttcctgcgcccacgtcgccgcgacgccgcccacgctctcgccttcccgcccgcgccgcgcgcccacaaggggcggattcaacttttgaatccccttccctctctcttcctccccactcccccacgtcgccggcgaaatcgggagcctccccagccacgtccgcctccccctccgcttataaaacgctccccgtgtccccctctctcgtttttcactttcgccgtactcccccgtgccctcctttgctcccacgccgcttcacccatcaccaccgccctccggccgcgctccggccgccgctagccgtcgctagccgccgcgccaatcctcaccgtcgacgccgccgtgttcaccatcccgtgagccaccgtgtccgccatccgcccgtccaaatccaccgtcggggcctgcttgtccacgcgcaccggtgagcaccaccattgccaccgcttcggccatgggtttcgctcac

SEQ ID NO: 51348 - DNA, 2836 bp, Oryza sativa
ccgcgtgccgccgtcagctccgcgcgcgccgccgcccccatgcacggccggccggcttggagccgagataagccaggcgccacctcccctcccttggagccgctgctggtggggcccgcccacatgccgccccctctccctctctttgtgccactgacccgtgggtcctgcatgtcggtgcccccccttgggtgacgtcagccttgggacatattgcgcaataaataattaaggctttttcttttatagtaataaacacagataatcttctaaaattcatatctaattcatccgagctccgattaagtccattcaagtctcagtaaattcataaaaatgcatagaatccattaagaatggttttatttcatgtttcagtagacttgtgtgctttgtttgtcgcgtagatttcggccgtttcgtcgatccgcggtttctcgaagacgttgttgtggtctcatcagtgcgagagcaaggcaagtcatgcattacaattgatcatattgtacccaatttacaaatgtcccgcatttctattaaatattgcattcttttacaacatcatgtgggatgggtcctactactcagccatatattgtttaccttatgccattgataacttgggtattaaaatgactagatgttggtttaggaaatgcttagccatgcttagttcaactagtacacaaagggggaatcatattaatgcatagactttgattattggcatagctttggaatagagccaccgcaatggtgttagttaattaaaatacactacatggtgcgttgtgggtgcatggttttgctagtcgtgcccatggcgattaaggaccggttcacgggataccctggaagaacttatcgtacttatcataagccagcgtgggcaacgactgggcttgtagtgtagctttcctctagctgacgtacccaagcaagggtgggcgtgatggagttgggtcggccggggtgtccggttgatcggcttccgaattcaccgtggcacgagaggggactgcccgctgccttgcgaggagtgggggtgaaacctgaggtgtggtgcgattggttagagggggttatgcgaacggtcctgtcacggcctctttccggtatgccgtggtggcatgtcggcgcacggaaacgtgtcgtggggctgtgtcttgtgggtacagttgtacacctctgatcagagtaaaactattcgaatagttgtgcccgcggttatgggcggtcgaccagattcaccgtgattagtctcacccctagttagctaatgaactggtgtaattcaggtggttggttgggcttgttgcaacgtggtgtagcgttggacaatgattggttaatattgattaattactacaactgttttactgctttcaactattgcttttaaatgctagctttatgcaaaatgacctttagcctcctttggatatatcctgcatcatacatcctcttccggtatgacttgctgagtacagtgggtagtactcagtcttgctctcttttcccccacaccagagcggaagttcttcccagtttgagctgtctcagaaaggttggtttcgtcgctgccgtcaaggatgcctatagagtggagtcgcccgctgtaggagtcaagtctttaggcttagctcgttttaccttttccgctgcatttgtaatcttttatatttttgtaagacatggatctgtatgtcaacaattatcgtttgtgtaccctggttggtcctggacaggggtttaatgcacattcagcttaaaaattctggttcgtgaatttctgggcgtgacagttgtaggcttttgcttcccgtgtatgactggggtcagttctatgatgtgttacccccctgtctcaaagtctctgctctcttctatcacctactcttcaagctgtgtttcttctagactttctagttgtgtttctgcctgtttgggtgtgatagctgccactttaatttatgtcgcaagataatgtgtacctgttcaactggaatgtaaggggtttgaatgccaaagctaaacaagattctgtcaaattctgcattcaacaacatggggcttcaattgtttgtctccaggaaacaaaagttgcggcgatatgtctgaccaacacatccttaatactcttggccaacgttttgtacatcaatatgcatatctgccagcagatggttccaagggcagggtgattttggcctgtgatgaaaacttcttctccctctctgatgttcacctgggtcaattaccgccgccgtcgtcaaatggagaggaggagggcgccgctgccgcggcaccaccgtcgccgccgccgggccgttggaccaccgccgtctcccctcccgccgctgccgtatccccttctgccgccaggccgtcaccgccatctcccctcccgccagatctggcggagggggagggcctcaccgccgggccatcggaccaccgccgcctcccctcacgccgctgacgccacctctcctcctgccagatctggcggaggggagggctccgccgccaggctgcaacatcccctcccaccgccgcacaccaattcggttgagggagggagggggagagagagagagagggggaatggataaggagaggagatgaatggataaggtcgatgtggccgggggttggttcagctcggcttatgtgggtgtcggttttataaaaaactggcacctataatatattatacgtgtcagtttttaatgatgctggtttttataaaaaatcggcacctatagaataggtgtaggttcttatttagaaccggcacctataattggttaaatgtgccggttttttactattt

SEQ ID NO: 51349 - DNA, 5720 bp, Oryza sativa
tatactccaacaattaatgaatggacaggaaacaaacaacgatcagtctaaataatgactattattagttgcatcgaaatagtggtatataactaagcatgccgtgatgatatcacagccattgaagaaattatattggaaaggttgacaatttgtaatgaccaatcgagccagcctagcaagctagtataaattaactggtacctcatcgattgaacatatatatgcattaatccatcctgtagctggctactaactaaactcagagagagagagagagagagagagagagagagagagagagagagagagagagagagagagagagagagagagtgtgagtgtgtgtaaatacaatgagcaggtcgagcatgaccgccgtcctcctgcaggtagtgttgatagcgatcaacgccggcagcttatgcagcaaaggactgggtgaagctcagccttgagctgccaccgcggacgccgcctgggcaggagccctccccagcggcgtaccagttctcccgtaccatctgcagaatccccaaggatcctatctacaagatctgctgcttcggcgaactcctcccgtacgccgagtccttccaggacaaccaaatgaaggccacccaagtggccaccatcatcctgctcaccaagatccaggccctcgatagggaggtgggcgcggtaagaagcggggcatcagggacaagaacatcgacgactgcacatcgttcttcggcattggctccagcaattcagagtccaccaactcggtgcttgccgcactcgaccgcctcgccgccgccggaaaaggcagacgcaagaaggaggacgtggaaacggtgctcaagtggaccaagaatttggagacccaatacaacggggccacaagcaagtgcaagttaggttatctgttcaagtactgtgacatggttcccaccgttaaggagattgacgcggcgacgaccatcaccatcgacctcctcaatgccataaagctgtgattgatcatccgatcatcagttagtgatatgtcctgaggacaaaatcatagagattattgtattgcacactatatttatttatttgtaataaagtgttgcttaaatagataacttaggctgtgttcttaccttcaagttcccaacccctctccctcgtttttcgcgcgcacgattttcaaactgctaaacgtgcgtattttgcaaaaagtttctatatgaaagttgcttaaaaaaatcaaattaatccattttcgaaaaaaatagttaatatacttaattaatcatgcaataaggtgtgctccgttttgcgtgccggaaggaggggttgcgaacgcagccttatatattatccatcagtgagcatgtgatttgttaatgaagctctttgtgtatgttgctatttctaaatgatttctgattgtatgtcatatgtggaacaagtgattacaagatcaacacatgtaatgattgatgatcacttttcatggattatggtaaagatacctaatcaataatgtgaacaatgtgttggatagacccaacctaaaatactgcatgattacaatggccaacaattgtctaggattatcatgattcccaacatgtgtagtagcatttagatcctttgttgatgctcctcctcttagacgccacagtgccagatccacctctcctagcaccaccactgtcaaatacaccacccttgaggccagccggtggatccacgaaggagggggagaagctactgtccatccgccaccgatggatccgcagttggctaggccaaccgtctgttggtatttcttaacgaaattattagaaatataattcccagcaatggggacgaaatattctcggtatactttatggctacagatacaatccgcaaacgtacggatatactgttgtagcatttcacctcggactattccaaggtatcgtatttatttaatcccaagggaagatatgataagagattattatgctaataatttatatcacttgtatatatcaaagtctaatgcagaggtaattaattcgtgggacacttttatagaatgtgttgacacacagaagtaactaaccaaaatttgagggtagaatgtgttgacacactgaagaaagtaaccagaatactctcattaatatgtagtccaaactaagtgaagaaataataagaaaagtgtcatttctgtacttctaatatatagtcaatttagtctacatttgctagtatacaactatgcaaccaataccacctaactatatctcctggtgtatcgagaaaccatccctgattgccgacttccttatgacaacctgtcatagacatccaaccggtaatgaatacgtaggagtatccacactaggaaatttgtggaaattctcttagtattatatacacacatggaggatacccgtactgagctatcaccatcagcggtctacgtctacagaccagtagcacataacaccatttaatggtatataataatctaagcaccgcacttacattactaaatactactctacatttctgcaggtgacatagagcaatcatataaatgaacattaaacaaacaccattgcatatatccaataagctagctacataattataacgagacaaatatgaactaaagtcggtattcgaataattatacaagtgaagtaaaagaccgaaactatataaagaataatatttcattaatgagtaaagtcttataatagaaagaaaagctactagagccatatccgaaatcttttgaagacttgaagaactaaggaaactattctattcctactccactagcactagaacaatgtaaataaactagagagtgtcttgaatttgatccttcttggtgcactttggaatggagaagagaaaattccctgtgtacccctgaaacttcaaccaatcccttctatgtcccctgagatttgcccattcccttccatacctctaaatttcagtttggatcccttctataccccttccattagttgaccgttaaatttctatcataaagtccattttgctatttggtatcaagaaaatataaatttatgaagtatattgataaagtgtataaatttattatatcgactattatatgtatgagtttattttgtgagatattatttaacaaatgtaatattttggtttcgcctcacgaagggaaaaaataatttttatctatgacaaaatttatttgagataaaacaaaaaaaatattttttaccattaaaaactatatatatagcatattttgttagagtagtatgaaattttttataagataaatcttgttatgcgagataaaaattatttttgttaaataatatctcacaaaataaactcataaatatatttaggagtataaaagggatccaatctgaaatttaggggtataaaagggaatgagcaaatctcaggggtatagaatagaaggggttggacgaactttcagggtacacagggaattttcttgagaaggtgagctccttttataggctgctaatgacggttgtgacagttgaaattgtcctaaatgccccgtaaccgtcattggggagtgaccaggaatgtccggtattttacaattggtcgtagcatcatcgtttcaaacacacatatacactcatcatacaaaaaatcataatgagagggcattagccgcctaagattcttccatcgcctaccatcggagccggtcctcaaagtcgttgcgtgcttatcgtggctcgaacctttgcccttcgtgttggccgctggcaacaagcgtggatgatgcccgggtcgaggacgactaccaggatagcattccggtggcatcaccaccactggcagaatcttctcatgttctttttctagtttcctgaacacaaactaattcataatttaaaagaaaactcagatatgagtgaggaaggatgtttggaatgagcatcgaccgtatggggttgggtatcgaggttctaaatgagcaacccaaaaaataattcagacatgaatttcttcggcggaccattgccaacctccaggcacatgcatcgagatgtgcctccgcctgtaagagtgcacacagcaactgctaccaccatggtcacaaataaattaaattcagaacattctagaatgaagaaatttattgtcaaaatattcagagaaaacctagcgtattcaacagtgttatatgcagtgagcaagctattaatcatattcctcgtaccattcaacttttatgttatgaggaatccacttcaatttctctactattcaaccagaaaatcacatcacattaacaaaatcccagtaaaaaaaaagattaacctacaacttctcctagaatcttcagttgccagaagctccctcaaacagttcagcttttatccagattctgagaatacatagttgtagtcttttataatctggaacatgaattagaagccggaagcttctccagatttttaccagctagcttctcagcagctgcttctcagaattttaagctccccaaacagatcctaagatgcattgcaatcacttacaaccggaagccaccagatcggagtgattaggaaaaacgacagaacaaacaaaagaaaaatgatcatcttcctttgctacatccacaggctgcattgcggcaagtgcattggcctccttcatcgacagcctctgaccgtggagggaagtgccgccaggaacgagacctgttctcccggcggtatcgtcgtcgtcggggctcagggcctcaggggcgatccccgtgttgtgtgagtcgaagcatcggtggctgcgccccacctgcatgaaccgttctgatcctcttacttgccttcggattttggtgtcgaggcacgtgacaaggcagaggcagcatgggcggttcccctgccgtcctcgccgaatccagcgtctctcgagccggtgccgctggatctagcgctcctttcttcttcctctccgtctctcttcctggggcaaagaagcaggtggctggatcggtgaggctggtgacaggtgccgagagagggatatggaggacgccgcttcatcctcgtcgccgctgctgctccttgacgttgccgcaattgctccgtgacgctagcgttgctgctacatggatgccgttgctcctagccagggtcgtcgccactgccgtcgctcaactgctccaccgagccgccggagccaccgccctctcacatcccaaaaaatatacgatcgggattgatagggaatgaatgtatatgtggttggttagccggggccgggggaacccaaaccttataatccagtccatttaactccctaaactgtttcacaaggcggttttgcacatatggcgggctgactgaaccgtatttgccacgttgtcatgctgaccaggcaattgcaaagtaacaagagggaaaagtggagcgatcgcgaaataacatgagggagggaacgcacatcagtctatatatcattcttgcctcatcgtactccctcatcccatcttctaggtttcttctctcgagtgttgcgcccatggcgaccatggctgcgtgaatcgtgatcacgcacggacgggaagatcaaggtgatcgcggagtacgtcttggagtaggtgagatccctgactccattgcagtgtttgatgcaagaaggtttcttccctttttatctagggttttgtggtgattgttttactcacattggttgac

SEQ ID NO: 51350 - DNA, 1461 bp, Oryza sativa
gcgtgggagaagatagtgacactactgatagtgactatcaaccagaaagtggaaatagctctgcagatgatgagtaggtagtaaaccttacagaagtttgctgagatgtataacaaaaagttaaaagcaatgaagctgattctacaagatcctgatgcaaacagtgtgcccgttgagttaataggtcatggagatgatagcttgaatgagataactgatgaacctacatatatgattctagtgaagattattcttgtcgaggagtgatcctctctagtgggaggttgtgagaccctccttttgtgagttcggccgggggataaggcgcgatgatcaagagcgcatctccgcttaaggtcgggctactagatcgcttacgaatccgtgagagagacaagggattatacaggttcgggccgccgggaggcgtaacaccctactcctatgtgtgaaattatcgtggagatcttacaagagatcttgagctcctgggaaaccctagctgtgcttcctttagagttcgagctattaagagtcgtccctcttttcggtgggtaaggtcctcctcttgtagttcaaggggataccacatgcaccgttcatccctacccctccatgggaggggggcccacatagcctgagtcagatcactatccgtgccttcaaccggaagcaaagtggttgcccgcccctaggtggggcccagcgccgtcctccgcctgacacggaggacatccccgtcattccctcttaaatgcatggagactttggtggattcaccatatataggggcacacttggcagcgtgccgatgggacagggcatacctgcccctactctgccagacacaaagcgggacatggaggcactgccactcgtcccatccgcctgcagccggtcgcaggccggtcaagaccgattgacatgcatcaatcgggcggcgccgcacgcccgcccatgccgcattaaatacggtgagggacggttgcggcgccgcgcatttaagacgctggacagcgcctcgtgctccgcccactcaccccgccacgtggtggccggatgagggcctcggggtagtatgcctcacgggcccgagtggtgtgacgtggcaccccgaggccccctggccacctcataactacctgcctccccccgagggggtgggggaaaaggcaggccgcacgaccacgtggccagatgggaaggttattctcctctaccgtgcgtacccccgggtccaatcaccgacaattcttatgacgatgatagtggtgaagacaacgaccatatagtgaggagaaagagtaggtggagaaagtatgactctaattatgctattccccatttttcggggaaagaggaaatgaagaaagctttacttaagtaaggaatagttagtcttaataggtgcttattcaaaggagcatgtaatggagagatgctttgtgccttaagaaggga

SEQ ID NO: 51351 - DNA, 3872 bp, Oryza sativa
tttcaactactacagaccaagcttgcacaaaagactgtccaaggagccaaggatatgatgaatactgaaccaaaacattggtgtagagcttggtttgaattagggtcaagctgtgactaggttgacaataacatgtgtgaatcatttaacaattcgattgttgatgccaggttttatcctgttatatatctcaatgctagaggcagttaggcgtaaggtaatgatcaaatttcaagagaacagaggcaaggcaaataagtggcagggcatagtgtgtccaaatatatttaagaagctcaagatgaacattgagaggtcaagtcagtgcaatgtattttggaatggaaaggatggatttgaggtgaaagaaaaggagagaaggaggtacacaataaacttgcaaaatatgacatgttcttgtagatactggcagctatctggactgccttgttgtcatgccttaagtgctatttgtaagtcaggacatgccacaaatggttttattgctcaaggctattcaattgaagagtataagaaaacatatgatcattgcatggagcctttggaaggagaggagaggtggcctacatctgatcatcaccccaagccttcgccacctagttatgtcaagatgcctggcaggccaaaaggaaaatctaggaagaggaagcctggtgagaaacctaaagaaactaaaatgtcaagagttggcacaattatgaggtgtgggctttgccataaaactaagcatagtagcaggggttgttcacccaaagagaggggcaagaagaaaaatgctcttgtcacaggagctaatagaaaaagaaatcaacctaatggagcaaaatcatcgactgctcatacagaacaacaggcaatcacatctccctttaacttttttagataatggaaataaatccggcctttgctcaaaaagagctacaaccacttattacacaaacttgttcaaaagcgaacacaaaccacagagttcacaagacacactccgaatttaacaatactcataacacaaactaataggcaccaacgcaagatagagaaaacacaattattaaatcctatttgtaaatctccacccgaagttggcgaaaatatgcatgaccgttgactcaagtttgtgacatgcattctttattagctaactgcaaatttaattttaatgtgatcctgtgtgtttcaaataaatgagattatagagaaaatgagattcagtatgacttgtgtacattaaaggcatcacatagcttgcaaggagcaggggaaggaacaattcacaggctaggaaaggtacctgtaaggagctccaagaaggtttcactgaagggcaagccaactagaccaacaatctgatcagcagtgttttttgtgtttatacatgtattcttgtcaagatctatgttccttactagtttactactattggaattaatagatgggtcttagctcacccgaagattaattctttggaaaatcacaaaagcccacctcatgggatagcatgcatggggagtttagtaccaccttgcttattgtaagagggggacctccttaaaaggaaagatgccctcctagccacttgaaccatgctcgccaggcctggcctggcagcgcgtgcacgacgtacgcatcaaatggtccgccaatgtgttgcaccgtcgctcgtagattactccatcccgctcaccggcgtgcactagctatcgggagagtaagtctccggaacctctgcctttgacgtcctactccaggagaagacaacaataaggtttttgggaagcactccgcgagactgctccctgtttgtccacgacgacttgcgtcgtcctcaacacccgcaacgcaagtaattcctgctgagcaactggtcttccggtactctcggtacgtgctcaacatgttgcacatatttgatctgttcatgttgtgctgtctagtttacatgtaaagattttatgatgcattcatgctagtttacatctgcaatgtcatgatttatttatggaataaattaaatcattatgtgcttaaaatttcaacaatccaaaaaaccttactataggcactgttgttttactatggctagttttgctgatgcactgaggttggataaattcaccggtgtgcattttaagagatggcagatcagggtcactctgtggctgacagctatgaaatgcttctgggtgagtattggcaaacctgtcatgcctggaatttctatccaaaattccaaacacttacatgtgtgtaaaccctcgtccaggaatcagccgaggcacacaataacaaattaataatagagtacaattattattctaattaataagcgaatataatatcattacagaggtagatagttcctctcaaacaataaagttctaagcagcggaaaataagataaacggcgcagacgactccatcccacaagcagctcaaccagggctacgcctaatcctccacaccatcaacatcactatagaactcctcctctgatgaatgattgcaaggtgagtatatggcatactcagcaagccacgcagcaaatatgcaagtgcaagggattgcaaaggatggcataatatagtctcatttgcataaatagcatttaataaatatttcagaatttaataaaacaatagagtatttaaaaacaatattaatccaacgctatacaacataccctgttgcataggcccaaccactctgaacaaccaatcccggctgcacagttctatctccaaaccaggaatataccattccaaaccaggagctaaacaagttattatctattacagcatcattttttatggtgagaggtgtgaaactaatcacgaaagatattgttagacccgcccataaccgcgggcacggctattcgaatagttttactctggccagaggtgtaccactgtacccacaagacacaacctcaacatcatgtcaaccatgcgtcgcgatacttaacaagtacccgaatagagattgtgacaataccctctgcataacacaattcaaagcaatgcaccgttcccggatcataatcacccccttgtaaacaaggcatgtgtcacgtcctgataaattcatcccgaaataaaaatcatcctctaaaaagaataatagaattaattaaaatttgaaaagaaattggcaaacactaaaatacgtgccagaaaaattcgaatgtggtccggagaatttttgttaaattctccttggtctaaaaagagccctccaattttacttgaatttttagagcaccggaaatatttattaagcaacaacaactatgatcaaagtttactaaaaagaaaagctaaaaataatccttcttcctccctttctggcccaaagtcctctctctctctctcggcccgcggccaaagtcctctcttcctccctctctttctctccctcgactcctctccctccttctcttgggcctcctctccttcccctcggcccagctccctcctccaccctctcttccccaggccgccactccctcttctcctcctgggccggccgcccggcccaagccacgccacctagctgccccagcctcccgagccgcccccccccctcacgtgcgccgcacgcgcgttgcatgcgcgctgaccgtgtggggcccacgcgccggtcgtcttcctcctcccgcacggcctcctccctctcccgtgaaccctagctcctttcctccctcaaatccgtgcgatttaatcatgggattccaaaattaaatagggggaattaatccccattgattcctctttgatttcccccgttttcccccttgaatggcgcccccaatcgccccgaacggccgcgccattcccggcccccttccatgg

SEQ ID NO: 51352 - DNA, 11462 bp, Oryza sativa
cggagttccttcggcaaccccttccaccgtgccgtgtgccggccgacgtcgccatctcctcctccggcatcgcagcggtaaggtcgccctcggcctcgcctccccttcgaccgaaccccgccggtgttcgtcgtcgtcgtcatcgttcctcctcgccggctcgtcgtctcgcggcgccgcctccgtcgtcggattcgcagcggcgtgttccacgccgtcctcatctccgtgcagctgctgctagctgtcccttgtcgcctcctcgccggccccggtcgtcgtcgtcgtcgtcctcccgtcgttcccggtcgtcgtggcgttcgtccctccgtcaagccattctcgtccgtcgtccgcgtccgtcaagtgtgccgctgcagccccgtcgtcgtcttcgtcctcgcctccgcgtcgtcaagccttgtgccggccgcgtctcgccttcgtccaaggatcgccaccgaagtcgtcccctcacctttcgtctccgtcgttcctggccgtctccgccgggcccattcgtcgttgtcgttccctcgccacgtcgcgtggtggtaaggatctctcctctcgctgccccgtcctcgtcctttcggtgccgcccgtgcccgttgtgcggttgtcgaccccggtacccgtgtaccggtgtcggtagtcgtttgcttgtgcgtgtggtgaccatgttagtgtgcccgctcggtagccgcgtggtttccacgtgtgcagcccgtgtggtgtctagtggagttcgtttgtcggccactcgcctcggttgacacacaggatctgcttccgtcgacccgtggaccgtctctgtgtacccggtccagcgtggtcccttaggttggcatgtggagtccgcatgtcaacagcgcagccttcctgtcttttccaggctagcgcttacacatgttttatagttgtaaaacctaattacaataatccgcaaatctccatgtaacagcattaaacttcggatgatcatatcttggtcatacgagctccgaatcgatccgttcaagtctcctaatgtttgttatatcctaaagaaccctgtgctttctttttatgtattgttattgcttctttataggtttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactagtgggtactctattcatggttccactggtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcatacctcaggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctgcctgtcccggaggttccggccgtaggtgggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctaatcagagtataacctattcgaatagccgcgccctcggttatgggcaagcctagcaatgtacccaagttagtgtttcaattcttaaaatttgcttaacaactaaaatgtggaatggttggcctgggttggcttgggacgagctgggacccagggttgggttgccagttcggtctgaatcatcgtagccttgggttaaggtaggttcgtgagggttcacggccttgattaataacactgtgtaactctaggatcgtctttataaaatggctttgggcaactaagtgacttttaaatgctgttttctgcaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctatgaagatggagccgtaggcccgctagtccgctgctgtttatttttgattgtcaggccttaagtgcctttgtaataatgtaaatattatcgatataataaagctgtgtcttttatatcatgtttgtgtggtgtaccccggcttttcctgggacagggattaatacactagcgttcgggaaaatgtatttttctcggtcgcgacagcatggactccccagcgacccccgtgggcttatctccgccacttcacagtctggtgctccgcaatgaaccatactatacaaaaagtaaagccgttgcccacgctggcttgtggttggcacgattaatgtttcacaaccgaagatcgtgaaccggtccttaattgtcatgagcacgaccatcaaaaccatgtgctcacaacccaccattatcagattttagttggcacattaattaattaaccaatcacgattaaccatcgtgaactatcattaagccatcattaaatattagggaatcataagtatcccatttatatgagctagtgtctctaagcaaggctaagcatcctattcactttagctaaaaccatataatgttctagctaatccaattgttaaccaagtgacaaagaataggtaatcaataacaaaagggctataacaaggcaataggttatttccacccaatgacattcgaaaataaatgcaatagttgaatagaaacaatagctttaaacgggatcaacatgctcaaagggtcgtttgggatctgtgtgacttgccttgctggccttggaactcttcaaaatcttctcctgcaaactcaggctctccgggaacgtcggaatctaagcagaaaagaacaaaatcaccaaaatagcacataaacactcatgaacagtacatgtggatatttttaacatgtagatctcaattttagaaaaatttagagacttgaaccaactaaatccgagctaagatgaattagttatgaatttttaaagattaaatcggattaaaccatttatatagattttaattgaattatgacgcaataaagaattatttttgaaaaggaaaagagatttattgctcagtgggctcgggtttacggtggaccgggtgcacgggacggtctaaggaaacgaatggccgagatcgatcctatccaaaacgaacggccgagatcgaatcggtctaccgcgggctacggctgatgtcgatgatgacgtcggcgatgacgtcaccaccggcggcggctcagccacgcacgctcgcaggcgaaagacggtgcgacggcacaaacggaaggcatctacgcgaagagggcgatgcggcgaaccttaccgaggcacggacggcggcggacggcaaccggacggcgacggcgacgaggttggagcggcggtgatgatcgggtcgacgacgacggcggtgctccggcgatcttcggcggaaacggaggggtggacgaggacggcgacgacctggcgaacccgacggtggccttctcgagcgacgacgacgaccggagcggcggcggcgcacggcttgacgcggctagagcactacgagcggcggcgagctacggcgagggtggcggcggagagaggaggtctcgagggtccttataaagggctagagggcggcgatggagacccacggcaaccggtgacggcgatggaaggtttagtgttcgggaggaagaaggaatccgaatcgagctcgaatcccacgatttccaaacgaatttagatgacgattccaaaagagaaaagatagaggggatcccgaggatcatttcccctctattgattcgatcggatcggaaaaggagcggtcgaatttggaagggcggcggcggcggcttgcgcgcgttagggcgcggctgcggtgggaggaagatgacggccctgacaggtgggccccaccggtcagcgggagagagaggggagcgagcggcggctcggctcggcggactgggccgggcgcgattgggcggggagagaaagagaaggggttttgggccgactttcggcccaaagccaaaagaggacttttaaaacctttttcaatttaaattattcatgaaatgcaattccatttattaaaaatacttccttggctcaaataaatccccgaaaattctaggaactgtagaatcaaatgaagtatttaataaaattttatctagcccacttttatattggaatttattatttaaaattagatcttttcttctagacttttaaaatcatttctaataattccaattaagcaacaatttatatatttggggatttttagcgtgtgacaaacctaccccccttaaacagaatctcgtcctcgagatacagaagagctggcgaatagatgcggatgagctgattttaattcatcttctcgctcccaggtagcttcttcttccgagtgattactccattggaccttatagaaacggataactcgattcctggttcttctctcatctgtttccaggatatggattggtttctcaacatatgtcagatcctcttggatttctatctattcaagattagcttcttcagtgggtacccttaaacactttttcaactgtgacacatggaacacattatgaacacctgccaaggattggggtaactccaactgataagcaacctcgccacttcaactaacaatcttataaggtcccacaaaatgcggtgccaattttcctttggtgtgaaaacgatgaacccctcgaagaggcgtgacacgaaggtacacatgatctccttcctaaaaacttaaatccctgcggcgattatccgcataactcttgtgacgagactgagctatacgcaatttttcttgaatgatctttaccttctcttctgcttccgtcagaatatcagtcccgaaaacctgatgttctcccgtttgatcccacaaaagcagagtgcggcacttccgaccatacagtgcttcataaggagccatttaaagactagcttgataactgttgttgtacgagaattccgcgtatggcagattcttatcccaacttctaccgaagtctaaagcacaagctctcaacatgtcttccaaaatctgatttaccctttcggtttgtccgtctgtctgcgggtgataagcggtactgaagttcagcttggaacccatttcttcatgaagtttcttccaaaactttgaagtaaactggcaacctcgaccggatactattttcttaggcacaccgtgcaaacacacaatccttgccatatacaattccgccaaatgacttctggaatatgttgtcctcacagggatgaaatgagccactttggtaagcctgtcgactatcacccaaatagagtcatggcccgatgatgttctaggtagaccgatgatgaaatccatcccaatttcctcccacttccattttggtatctttaaaggctgcagcaaacctgcgggtttctgatgttctgccttgactcgctgacaaacatcacacacaactacatactctgctatctcacgcttcatacttgcccaccaaaatttctccttgagatcttggtacatcttggtattaccagggtgaatagagtataaagtgtcgtgagcttccttcagaattgcatctttcaactccttgttcctgggacacaaattctctcgcccatccatacggttccttgctcatcttccaaatacccgatagcctttcctcttctcatattcttcttgatctcttgaatatcaggatcattgacttgagattctctaacctgatcaatgagagtgggctttgcttctaatgctgctacgaaacctttactgacaattcccaaattcaatctttcaaattccttgcataattcccacgacaactgtcgtccttctgtagcactgcaatagcctttcctgctgagagcatctgctacaacattagcctttcctggttgataatgaattcccatgtcatagtccttaatcaattccaaccatctccgctgtctcatgttcagatccggctgggtaaagatatacttcaaactcttgtgatccgtgtacacctccgtacgagtaccaaagagatagtgacgccaaatcttcaatgcatgaaccactgcagctaactcaagatcatgagtagggtagttcttctcatgcggacgtaactgacgagatgcaaaggcaaccactttcccatcttgcatcagaacacaacctacccaaacttagatgcatcgccatacacttggaaacccttctttggatcaggcaaaatcaaaatgggtgctgatattaagcgatttttcaactcttgaaaactctgctcacattcttctgaccacttgtacttcacatctttctaaagcagtcgtgtcatgggcttagcaatcttggaaaaattctctataaacctccgttaatagcctgcaagacccaggaaactacgaatctctgaaactgtcttcgattgtttccagttggttacagattccacattactaggatcaacggcaactcctccggctgagatgacgtgtccaaggaactttacttcagacaaccaaaattcacatttgctaaacttggcatacaattgatgctctcgtagcttctctagtgcaaggcgaagatgttcttcatgctcctctttggttcgggagtagataagaatgtcatcaataaagaccaccacgaacttgtccaggtattccataaacaccttattcatcaagttcatgaagaaagcgggggcattggtaagtccaaaagacataacagtgcattcaaacaacccatatcgagtggtaaaagccgtcttaggtatatcttcctctttgatcctcaactggtgataccgtgatcgaagatcaatcttggagaaaacggtggcacctttaagctgatcaaacaaatcatcaatcctaggcagcgggtatttattcttgatagtcacctcatttagtgcacgatagtctacacacatcctctgggtatggtctttcttttccacaaagataactggagctccccatggagacgaacttggtctaatgtatcctttctgaagcaaatcatctacttgcctcttgacctctgctaattcattggctgccattctataaggtctcttatggatcggagttgttcctggtaccagatctattctgaattctatatctctcttaggtggcatgccaggtaaatcatccgggaacacatccgggtagtcccgtactatgggaatctcttccaaagttatttgattcagacttgaccttaaaggctcggaaggcaatgcatgaacagttacaacttgcccgtcattgttggtgagagttacttttctattggcatagtctatcacacctttatatctggttaaccagtccatccctaggatgacatcaaggtctttggattctaatagaataaggttggccagaaatggtacaccttgaatctctatactgacgttgtgatgagagtgcctggttactcggggtactaaccatcaaaggacgtctaagatcttctatctccatcccatgatttcccgcaaaactcaaagataaaaaggaatgtgtagcaccagaatcgaaaagcactgttgcaggaactgagttaacagggaacgtacccaaaatcacatctggagcaccttgggcttctgcagtagcaacatgattgacacgagcctttgtcgctggtgcggtggagttgttctaggcagggacaaccttcatgcggcggggcttcggacacttgtcagaataatgacctggctccccacagttaaagcacactcctagcttgttaccttgctccctcttggcaggctggtgctgggttggagttgcaacagggcgtggagcttggttgcggttgttgttgctagtattgttgttgaagaactgacgctgcggacgaacaacagacgaagatcctccctgcgacactgcctgaggtcccatagcaagacgcggcctctaactattcccctgttgagctttgaagtgagcaatcctgcgtttcttctgctccatacggttgtacttatcctcctagcgaatggccttatccaccaacttctggaaaatcatgataatccccagtcattaatgggtaagagagctcatcattcagtccttccaagaacttctcttgacgctcttcatcggtgcacacatcttccgaagcatagcgagccagacgattgaattcatgcaagtattcggtgacagagcgagatccctgagtgagtgccctgaattccttcttcttgagagacaccactcccgatggtatgtgcgtcttccggaaagcagcagtgaactcaagccaagtgattggttccacggtagtcctatttagacggaaatgatcccaccactcagaggtagggccatgaagctgatgtgacgcgaaggagactttttcttgatcggtgcactgaagcaggtccaacttcttttctatggcatgcagccaatcaccagcctcaactggattggtagtgctagaaaaagtgggcggcctcacacgaagaaattctgctaacttgttctggggaggtgcatggttgtttccctggttctgttggttctggagttgctgcatcatcatattcataacctgtgcctgttgagccaggacttgggcaagcgtgggattctctccattattgttgttggtggtgttgttgttgttggggccattcccattgctgcgagtaaacaccatctggcatagacaggagcacaagaagagaaacaggggaaaaactacttaggacaggaaattaattttttacaatcttgacttttattgatcttaactgagtttcattattacatatgtctgaagactctcacaccacaaaactcaccaacttcctaacactcgaaagcaaacaaacgcatgcacttacatcccaccaatgatgtaaaccacacgcaagacccacacacacaaccaaacttaaacaagcaaactaacacaacgatctaaggcaatgacttaacaagacatctaggtcttccgggcatcggagttgattgaaggctcgtttggctcgtccccatcatctcgagtagctccccactcgacctttgaatgggtgcgcttcgattcttctccatcatcatcacttacgttgacgatcggaggatccgctggggctgaggcggcttctttttccaccacacgaacctttggcgccaactggtagcgagggacaaatagagctctcttccttgcggtaagacgaaccctagctttttgtggtggtgcttctcccttcaatgcggctagttccttctccaaacgatccaccttgtcttccagcttgcaaatcttaccacgattccggccttcgcgatcttgagctgctaacataatctcagcgcaggtctcatccatggcccacagcatctcaaccaaatgcctggtggtagcatcattctcaatccctgcaggttcaaggtagctgccacggtcacttccctggggttggcgaggatgatagcgatactcagtgtcggccaactgatcattgtagctttcgcggagctctcctatggtgatccttgccacctcctgacaagcatgaatgtagcttccccctccagcctcgaacatcaccgatgggatatcttcacgattactgttcaaggtgactttgacatggcacttctcttcatcatgatcatgaggaatctgggcatacaaaggggcagtcccgaatcctatggcaaaggacaacgtacgcaactcctggacaaatccctcagtaccgaacaagtactcaggcttgaagcgcggcatctaaagacaagtgaaaggagggagttaagacatttatccaattaatagcacaagtttttggattaattgaataaagttagaaaatcaaagtgaagggtaaattaataaagtaaaccaatcttgcaagataagttgaaacagttgaaaacaggataacaaattttgcacttttgagtaacaggtttcaaatagaatgaaataaaagagagttataaaatcaacatgctaagttatgttgcaacatgattaaataaaattatgttataaaacttttactggtaaatgggccattagtacagtaatagatgtacagtactaacaacacaggaataataaataaattttgaatgagaacaattaaagggactataaactgcatgtgctattagcttgatttaattaaaagagaaagagaggagaacagttctacttttttaatatttttagagggcttctataggtaaccatttggcataacctagggtcaaggaggctctgataccaacttgtcactcccggaatttctatccaaaattccaaacgcttacatgtgtgtaaatcctcgtccagaaatcagccgaggcacataataacaaactgataatagagtacaattattattctaattaataagcgaatataatgtcattacagaggtagatagttcctctcaaaataagataaacggcgcagacgactccattccacaagcagctcaaccagggctacgcctaatcctccacaccatcaacatcactgtagaactcctcctctgatgaatgattgcaaggtgagtatatggcatactcagcaagccacgcagcaaatatgcaagtgcaagggatagcaaaggatggcataatatagtctcatttgcataaatagcatttaagaaatatttcagaatttaataaaacaatagagtatttaattaaacaatattaatccaacgctatacaacataccctgttgcataggcccaaccactctgaacaaccaatcgcggctgcacagttctatctccaaaccaggaatataccattccaaaccaggagctaaacaagttattacctattacagcatcattttttatggtgagaggtgtgaa

SEQ ID NO: 51353 - DNA, 13321 bp, Oryza sativa
atcagattttagttggcacattaattaattaaccaatcacgattaaccatcgtgaactatcattaagccatcattaaataatagggaatcataagtatcccatttatatgagctagtgtctctaagcaaggctaagcatccgattcactttagctaaaaccatataatgttttagctaatccaattgttaaccaagtgacaaagaataggtaatcaataacaaaatggctataacaaggcaataggttatttccacccaatgacattcaaaaataaatacaatagttgaatagaaataatagctttagacgggatcaacatgctcaaagggtcttttgggatctgtgtgacttgccttgctggccttggaactcttcaaaatcttctcctgcaaactcggactctccgggaacgtcggaatctaagcagaaaagaacaaaatcaccaaaacagcacataaacactcatgaacagtacatgtgggtatttttaacatgtagatatcaattttagaaaaatttaaagacttgaaccaactaaatccgagctaagatgaatttttaaagattaaattggtttaaaccatttatatatattttaattgaattatgacgcgataaagaattatttttgaaaaggaaaagagatttattgcgtcagcgggctcgggtttacggtggaccaggtgcacgggacggtctaaggaaacgaacggccgagatcgaatcggtctaccgcggtctatggctgacgtcggcgatgacgtcaccaccggtggcggctcggccacgcacgctcgccggcgaacgacggcgcgatggcgcaaacggaaggcatctacgtgaagcgggcgacgcgacgaaccttaccgaggcacggacggcggcggatggcaaccggacggcgacaccgacgagtttgaattggcggtgacgatcgggtcgacgacgatggcggtgctccggcgatctttggcggaaacggaggggtggacgaggacggcgacgacctggcgaacccgacggtggccttcccgagcgatgacgatgactggagcggcggcggcgcacggttggacttgcggcggcgatggcggcgcacgacttgacacggctagagcactacgagtggcggcgagctacggcgagggtggcggcggagagaggaagtctcgagggtccttataaagggctagaggacggcgattgaggcccacggcgaccggcgacggcgatggaaggtttagggttcgggaggaaaaaggaatctgaatcgagctcgaatcccacgatttccaaacgaatttagatgacgattccgaaagagaaaagatatagggtatcccggggatcatttcccctctattgattcgatcggatcggaaaaggagcggtcgaatttggaagggcggtagcggcggcttgcgcgcattagggcgcggctgctgcgggaggaatacgactgccctgacaggtgggccccacctgtcagcgggagagagagaaaggaaccagcggtggctcagcttggcggactgggccgggcgcgattgggccggggagagaaagagagggggttttgggccgactttcggcccaaagccaaaagaggacttttaaaacctttttcaatttaaattattcatgaaatgcaattccatttattaaaaatacttccttgccttaaataaatctcagaaaaatctaggaactatagaatcaaatgaagtatttaataaaattttatctagcccacttttatattggaatttattatttaaaattagatcttttcttctagacttttaaaatcatttctaataattccaattaagcaacaatttatacatttggggatttttagggtgtgacaaaacctatgggagttcttactgctgaccagtagaaagcattcaatgaggccactactctctttgtgggatgcattcttagcgttcttggcgatcgtctggtcgagctgtatatgcatatgaccgacgttaaggagctatgggatgcactgaataccaaatttggtgctactgatgctagcaatgatatgtacgtcacggagcagtttcatgactacaagatggttgacaactcttttgtagttgagcaggcccatgaaatacagaccatggtgttgacgcgaaaaacacacactggcctgggagatctgcttagctccagcgtaggtccaaaggttgatgagatacgggcataccagtcagtttgaccctgcaactgacaagatatacaaatagcagatcaatgagccgatcggctgacaagccgatagattaattccagccgatgccgataccggccgatagcgatagggtttcgagctatcggctatgtgttgatgtggagtctcacacttgatgtaaataatgacatatagaaaatcggctgatgatgatgtaataaattaacaatataatcgagtagaaaccaatcggctaataatgatatgatagaacaagtattgatccgaaggttaaagcatacatcggctggaggtccgatgtcattaaattcagaagattagataaacagtaaaatctttgttgctatcggctaaatccaataggtatgcaatccttgtaagccgatgcaacgtccagataactcatcagctgaaaccccgatgaaacccttattggcaatcaagaagcaggctagagattatggttctaagcacgacttagtagatcaaacttagctgatgcagcactaagtatgaaaagaatcataatatctagataatcaagtcgttgactgagtttttagggtggtagatgtctaagctaatctaatctagcaacatgatttagccgataccggtagaaatcctaaaatgagaagcagccgatagagctaaattgataagctaagactagattaacagatacatatgataaataggtaggcaaatatatcatgcaaaccagagcaatccaagaggtcgaatgtactgatgcagccctgaacgacgctgacatagacgatacaattgcctaggctggtagaacgtaggacttactccttcgctggagatcgaaccgaatcgatgcagccccgcgtcacgtgccaaattccgccggttgataagtaacaacctcggtaaagagggtgttgatgcgccgagagtagttgtattgatcgagagatattttacaatgaccccgggtgtatatatttatacccatagggagatattagtccttgtaggacaagaaagaaactttcctaaagataaaaagaaaacataaagtccttataggacactgaacacactttcctaaagataaaaggaaactaacaaactattcctaattaatagataagttgccatgccacatcctcctttaactcggacactactagataagcttcctttaatagattaatttccttaacagaatatagcaggaatccgactattggcgatgtgataattctcttaggggcctaccaaaatttgtcgttaacacatggctaaggaactcgaactccttaagtgtgtcttacccgaaaaatttgtggccgggtgcattattgtgaaactacctctatcttggagaggtttcggtactgcactcaaacacaagagataggaatactccgttgagaggttgatagagtctcttgatgttgaggagaaagctcgggaaaaagatgccgcgtctaaaggcaatggtgggcagtctagtgccaatgttgtgcacaaggccgaaaacaagagcaaagggaaatacaaagcccagcagaccaccaacttcaagaagaagaagaacaataacaatcctaaccaggatgagaggacttgctttgtgtgtggcctacctggtcatttggccaagaagtgcccacaacacaaggggatgaaggcacttgcagggcagacttcttagtctgcaaatgtgaccattagcaacaatggagatgtaagcgggtatggtaatttacctactgttttttcagttaatcagtctactaactagtgggttgatactggggccattgtacatgtttgtgctggcatctcattgttttcttcttatcaggtcgcacaagattccaccgtcttaattgggaatgggtcacatacttctgttcatagtgttggcacggtagatctgaagtttacttcgggaaagatcgtgcagctgaagaacgtgcaacatgaccctactatcgacaggaatcttgttagtggctcccgtctaactagagacggatttaagttggtttttgagtctaataaagtagtcgtgtctaaacatggatattttattggtaaaggttatgagtgcggaggcctgttccacatttccctttctgatttctaccataagtttgtgtcacatcctgattttcgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcagatttttcggagctcaactcttaattttaatcatacaaagaacatttcagtaattacccacatattaaattaatcattaaatggtctgattataatcttgttaagtactttgagtgtccaagtattttcaggattttacttgaaattacttgagcattggaagtatttttaacaattcaaagatcatttcagtgattaatttaattggaaaagttattaaaattcctcttttccttttcgggccgaaacaggaaaagtcctctctctttcttggcccaatctcctctcagcctgcagccctctccctccctctgtcgaagtctgctttgtgtccctctatcaatcgggccaagaagtagaagcccagcaacaaagtttaatttgcctccctgggcactgttcatcttcaacctctggcagccgaactgagaccgagttggctcggtttttctcctccaaatccaaccttttctcttgtgttttcctaaaattagttgaggggaaatcatctccaccttatcctctccctttcccctaaagtgtcggagattaattttgcctggataaaccaaatcgaattcgtttttgagtttatctctccaaactaaccctcggattttccggctcaaatcctctcgtttggagtccgatctctctagtccaagcctatataatgcatcccctcgacatcctcttccgtttgccccaagtcccaagcagagccgtcgcccgtagagttgccgccgcgttgttttagccgccgtcgggtgcgcacggaggagaggaatcccgtccaccccttcgcagccgccgaacaccatcggagcgccgtcgccgtcggggacccgagccaagccgccgtcgaacctcatcgctggccgtcgttcgtcgtcgtccgtcgttgttctttgcaccggtgagttcgcgtcgtcgtcctctacgcgtaggtgttctcggatagcccaaccgagctctcttttgccggtggtcgcgtggaagccgtgccatggccggcgatgatgtcattaatccttttttcttagttttctctattagttgaaaatcgattaaacttcggaaattcataactaaatcgtcgtaactcggatttgagtggttcaagttgctaaatttttctaaaatcaagatctacatgttaaaaatatcaacatgtactgtttatgcttgttttggtactgtttatttggtttttattagtctttttctttgttttgcgtgttagcttgtcgtttccgtcgttgcgaaggttcgtgcgtgcgttagaagtggtcaagaagattaattgaagaccgattattgcaaggcaagtcacacagatcctaaacacaatcctttgagcatgttgatcctatatttaaattctgtatttatttcaactgtgcatttattttcgaatgtcaccgggtggtgtgaacctattcctttgttatggccaatttgcattgaatgccctattccttgataccttaggtaataaattgattagcttgaaccttatgtattggtttggtcagctaaatgttatatatataattgcttggccatgcttagaaacattagctcactaatgggatgaatcatatatactacattattatttatggttatatttaatggtagctcacgatggttaatcatgttatgataattaattggtaattaaatatgattaatggtgggttgtgagcacttggttttgaaggtcgtgctcatggcaattaaggaccggttcgcgagctactgttgtgagacattaaccgtgccaaccacaagccagcgtgggcaatggctttaccttttgtatagcatgattcattgcggggtgccagactgagaagcggcgagaagtccgtgggggtcgctggggagtccatgcctctggttatatttatagagggggcgattataatccaggaatggtgcactatggtgagttgtgttgtgcgaagggtattgtcacgatttccccctttgcagtgccgtggtggtacttcggggcatggcaacatgtgtggaatcgtgtcttgtgggtacagtggtacatctctggccagagtaaaactattcgaatagccgtgcccgcggtcatgggcgggttgagcaatgtttttcgtgattagtcccacactattcattaatgataataatgtgataataaatttgactcctggtttggaatggtaaattcctggtttggaggtttgatctgtacgactggggttggttgttcagaattggttgggcctgagcagcatgggtgtgctgttcagtgttgattaaaatttctgattaattactctactatttcactactcttaaatctttactaaatgctgcttttgcaaatgagactatattatgccatcctttagtatccttgtgcacttgcatatttgctgtgtggcttgttgagtatgtcatatgctcattctggcaataatcaatcaacctcagttgaagagaaaggatccggaaagagcagacgtttggcttataccccagttgagctgcctgtgggagtggagctgaagtcatcgctagaccgttattccgctgctgttttcttttcttttgtaagtatctaaggcgttattattatgatggatttgtatattaaattgtcagtttgtgtacctcggctgattcctggacgaggattttatgcacaaataagttcggaaattactagtgaatttccgagcgtgacagtttgtgaatcatatttgtggcagtgtggatgatgaggctaatgtttggcactcatgcttaatggagagctggatgaggagatctatatggacattaagacagcttttcttaatagagagctgaatgaggagatctatatggatcaacatcaaatggacattaagacagcttttcttaatggagagctggatgaggagatctatatggatcaacctgatgggtttgtagttaaaggttaagaaggcaaggtgtgcaaattgttgaagtctttgtatagtctaaaacaagctcctaagcaagagcatgagaaatttgatagaacattgacatctgcaagcttcgcagtcaatgaggcagataaatgtgtgtactgttaggggtgggcattaaaaccgataatcgaagaccgaacccgaaaaaaccgaacccaaacccaaaaagaccgaactctcgggcatcggtcatttgttcgggtgtgacatctgaaagaccgaacaaacttcgaaagatttggtcatcgtgcaatactactcgaagaaaccgaggaccgaagaaaccaaatcaataccaatcactaagcagacaacgtgaccatcccatggaccaaaacagcccaacaacaaggtgaggcccaaatccacgtcaatgacccaatccccatgaccccaccattccattgaccgaagcactcctagccatagttaggccacgcgccgccggcgcgccacttatctcatcacatcgcatgtccccttccttccgcgccgctgtcttctgcagtgctgccgcatgctgctgctcgccggcattgccgcagtgtcacatacaatcgtgtggtcacgtggaagccataaggaggccacaggctgttggcttgctgatcctgcagcacagccgcatgccggccgctgcgccatcgcgtgccgtctgcgtcacgtggctgatttctgccgcgtcgtcgccttccgtcccgccaacacttgtcaccatgctagtggatatccgtcccatgtgactgagatggagccatggaggttttcaggagcaagaagacaagaagattgaagaggacgcacgttctggttcggacacctcggtttagaccgaagactgaaccgaattttcggttaaccgaagtagcggttagtaatttttgcttaacaacttcggtttcctgtttccaaagaccgaatttttaaaagaccgaactaaccggatcgaaatttcggtctagaccaaatgcccacccctatgtacggtcgccatggtggcggtaagggagttattttgctcttgtttgttgatagcatactgatatttgggacaaaccttgaggtgatgaatgaggttaaattattcttgtctcaaaatttcgatatgaaggatctgggagtacctgatgttattctaaatattaagctaattagaggtgagaatgagattacactcttgcagtcccattatgtggacaagatcttgaatcgctttggctacattgatagcaagccttctccaaagccttatgatcctagcttgtcgcttcgcaagaataagagaattgctaggaatcaattggaatactcccaaatcattggctcgcttatgtacctggctagtgcaactaggcttgacatctcctttgctgtcagaaagttgagccggtttacctctaacccgggagatgatcactggcatgcgctagagcgagtaatgcactatctgaaaggtactatggaattggggctttactatactgggtatcatgcggtactggatagatatagtgattctaattggatctctgatgtgtatgagatcaaagccactagtggatatgtcttcacactaggtggtgatgttgtttcgtggaggtcttgcaaacagaccattttgacgagttcaaccatggaagcagagctaacggtactggatactgctactgttgaggcataatggctgcgtgatctattaatggatctgcctattgtagaaaaaccagtgctagctattcttatgaactgtgaaaatcaaacggtaattgccaaagtaaacagttctaaggataacatgaaatcgtctagacatgtgaaaagacgattgaagtctgttaggaaattgagaaactccggggttataacattggattatatccaaacagctagaaacctggcagatcccttcacgaaggggctatcacgtaatgtgatagacaatgcatcgaaggagatgggtttaagacccatgtgagttatactatggtagtaaaccagtctatgtgatcgaagatcctgtgaattagaacctaggaagaacaagccattagttaactggaggagagtaccaatctataccctctctaagtgaagatgcatgtactctcgtgagctgcaaggcaggttggctatgccttaatgagttatgttggctttaattagcgaagatgttgtcccgcagagcattcctgaaagaactcacctttgtgagcttgactgttggtcacagtctatggagatttggggtgaatcttctaggaagcttactaaaagaccaaggagtatgacttacatgctccacctgagggatagtctacagacgatctagtcctagataagactctgagtgaaacttgcttgcacaagtgtcacgcccggaatttctatccaaaattccaaatgcttacatgtgtgtgaaccctcgtccaggaatcagccgaggcacacaataacaaattaataatagagtacaattattactctaattaataaacgaataaaatgtcattacagaggtagatagttcctctcaatcaataaagatctaagcagcggaaaaataagataaacggcgcagacgactccactccacaagcagcttgaccagggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaatagttaagtagtaatttaaacaatattaatccaacgctatacaacataccctgttgcataggcccaaccattctgtacaaccaatcctggctgcacagttctatctccaaaccaggaatataccattccaaaccaggagctaatcaaattattaccagttatagcatcttttattatggtgagaagtgtgagactaatcacgaaagacattgttagacccgtccataaccgtgggcacggctattcgaatagttttactctggccagaggtgtaccactgtacccacaagacacagctccacaacatgtcaccatgtgcctcaataccaccacggtacctcggaaaggagctgtgacagtaccccacgcacaacacaatccaccacagcgcacctttcttggatcataatcacccccttataaacaaggcatggactccccagcgacccccgtgggcttatctctgccacttctcagtctggtgctccgcaatgaaccatgctatacaaaaggtaaagtcgttgcccacgctggcttgtggttggcacggttaatgtttcacaaccgaaactcgtgaaccggtccttaattgtcatgagcacgactctcaaaaccatgtgctcacaacccaccattatcaagttttagttggcaattcaattaattaaccaatcataattaaccatcatgagctatcattaaatatccatcattaagtaatagtgaaacattagttatcccaattgtgtgctaatgtttctaagcatggctaagcaatcatatctaatatctagctgaaccaatatataaagctcaactagtcaagttataataacccaaggtatcaaggaataaagtaatcaagaacaaaaggactataacaaacaataggttaattccacccaatgacattcgaaaataaatgcaatagttgaatagaaacaatagctttaaacgggatcaacatgttcaaagggttgtttgggatctgtgtgacttgccttgctgcccttggaactcttcaaattcttctcctgcgaaaacgaactctccggaaacgtcggaatctaaacagaaaagagcaaaaacaccaaaacagcacataaacaagcatgaacaatacatgtggatatttttaacatgtagatctcaattttagaaaaaattagagacttgaaccaactaaatccgagctaagatgaattagttatgaatttttagagattaaatcggattaaaacacttatatgggttttaattgaattatgacgcaataatgaattatttttgaaaaggaaaaaggggtttattgcatcagcggctagggtttgcggtggaccgggtgcacggcggcggctcacggaaacgaacggccgagatcgatcctaaccaaaacgaacggccgagatcgaccggtccacggccggaccacgacggatggcaacgatgacgtcagcggtgacgtcaccaccggcggcggctcgggcgcacaagctcgccggcgaaagatggcgcgacgacgcgaacggagggcaccagcacgtagagaacgacgcggcgaactcatcggtgaccaaaacggcggcggaagatcaacggacggcgacggcgtcgaggaagaagcggcggcaaccttcggcttgacgacgacggcggtgctccggcggtctacagcaacgatggaggggcggacgaggacggcaacgcgacggcgaccacgacggcggccttcccgagcgacggcgacgactggagcgacggcggcgcacggctggagcggcggcgacgacggcggcgcgaggctacacggtgctagggttctaccggcgacgagagacgaaggcgagggtggcggcaggtaacggcgggcttgggggtccttttataggggcaaggaggcggcggcaaaggcccacagcaaccggcgacggcgaaggaaggtgtagggttcggggagatagacgaatccgattcgagatcgaatccacggatttccaaacgattttagccgacgattccaaaagagaaaaggtagaggagatcccgaagatcatttcccctctattgatttcaccggaaaaggaaagaggcggccgaatttggaaagagacgacggcggcgcggcgctagggttcgggcggcggccggccggaggtagacgacaggcctgacaggtgggccccacttgtcagcggcagcgagcgcgcgcgggcggctcggcttgactgggccggcttgggccgaggaggagagagagagggttttgggccgactttcggcccaaagccaaaagaagacttttaaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaattaaacaacaatttatatatttaggatttttagggtgtgacagtagatctcccagcccacgtgttttctgtcaacacgcttttggcacgcccagtgggacctgtaagaagtcagacgtcagttcttcctcatggccgagaaacaaccaccaccaccatctagcccaggttctgttaaaggcaaggcattgaagttgggattgactgacatcattgaagaaaacgttatgccgatcgatccagagaaattcacgcctgagcagaaggaagagtttgaagcaacgttgcagcaagcacgggatcagtttctgaactcattcatgcagacccgcaaagggacacttgttcagaagtataaaataaaagtggttgctgatagtcctaggaccggttcttctaaagatggagaagtgaaacaagctccaggcggctcggctcagccgag

SEQ ID NO: 51354 - DNA, 18477 bp, Oryza sativa
ccatgtttctgccacctccacctattgttgatccagtgcagcagcagcggattcagcagacaccaccaatccagccggttgtgcaaccaatccaacaacaggtcgtacaaccagctcagcaaacaccaccaagccagcagcctctgcaaccaattcagcaaacaccaccaaggcagcagcctctgcagccgatccaacagactccattaaggcaacaaatcgttcagccgatttagcaccaggggtcaatgaacgcatcggctgggttcgcagcacctggtagttagcccatacaacaatttgtgaaccaagtcgtcccagaacatttggttcaccatgtacagccagacggcacagtaatgcctcaggttgttcctgagcacttggtgcgcaacatccaaccgaaccttcataattactaagggggtaacttgagttatcaatatcagcctccttccccgcaagcccaatatcagctagggggattggctcaaccccagttcgcatctcagcctccttccccgcaagcccaatatcagccagggggattggctcaaccccagttcgcatctcagtatggtcagtttgagcccatgcaacaacagccacaaggggcagctcagcaacgaccgtgggccgatgtgattgttgatgtaatgagagaacagtttgggcttaaaccaaaagagactggaagcttgtatcggcagccttaccctgagtagtttgagagagttcctcttcccaaccggtttaaagttccagatttctccaagttttcaggacaagagggcgtgtcgacttatgagcacattagtcgattccttgctcagtgtggtgaagcatcggctgtagacgctctgaaagttaggttattccggttatctctgtctggatcagcttttacttggttttcctctttgccatatgggtcgatcaatagttgggccgatttggagaagcaattccatagctatttctacagtggggttcatgagatgaagttgtcccacttgacagtgattaagcagcggcatgatgaacccgtgcacgagtatattcagaggttcagggagatgaggaacaaatgctttagtttgagtttaaatgatgctcagttagccgatttagccttccagggtatgattgctccaatcagggagaaattctcgtctgaagactttgatagcttatcatacagaaggtaaccttgcatgagcataggtcggcggaagtcaggaaaagctctaagaaggttaatcatgtttgtccgtatatgtatgggtcggatgatggggaagacgattctgaaatagctgcagccaaatgggtgaggagtaaaaaggtcataccatgccaatgggtaaaaattcctaaaaaagagaagtatgactttgatattaccaaagctgacaagatctttgatctactactccgagagaagcaaattcagcttcctgctggtcatacaatcccatcggctgaggaattgggcaaaaagaggtattgcaaatggcataattctggatctcattctactaatgattgcaaggtttttagacagcaaatccaggttgccactgaagggggaaagattaggttcgatgattccaaaaagccaatgaaagtcgatggtaatccttttcctgttaatatggtgcatacagctggccaaacagccgataggatccgtgcaaagggttttcaagtaaattcggctaagattatcaacaagtatcagaggaagtatgacaagtagcaggagaagcattatgaagaatacgacgatggttttgatcctcattggggttgtgagttctttagattcttctggaatgaagggatgaggttgccatctatcgaaaactgccctgggtgcagtgatatcatcgagagctcgagccggtcatataataagggtaatcggctaaggcaggcaagacttcctattcatcaaagattgggtccgatgaatcaagatcatggccaagaggatgaggtaatcaggaagaatcaatggtgtccttctggtattttcacaaaaaatcagaagagaagggttcaaagattgaggaacagggagcgccttcaggaggttgaacaagaaatcaaccatcggctgaggaaaccaaagccaagacaggagtggcgtgttaagaatcaggttcctgtagccgatgatgctgcagccgatgaggcgaagaggttggcaaaaggaaagagtgttgtagcggcaccaattaacatggtctttacattgccagctgaattcgggatagatcaagccgatgtcgatgaagtggaagaggaatcggctaagttggttctgtcaccagaataggcagtattcgagaaacccgagggaacatagaatcggcatcttaaaccattgtacataaacggctacgtcaatgggaaggcgatgtctaagatgatggtcgatggtggggccgcggtaaatttgatgccttatgctacgttcaggaagttggataggaacgccgaggatctcatcaagacaaatatggtgctcaaatactttggtggtaatccatcggaaaccaaaggtgttctaaatgtggagctgacagtcggcagtaagactattcctaccacgttttttgtcatcgatgggaagggttcgtgcagcttgttgcttggaagggattggattcacgccaattgttgcattccttcaactatgcatcaatgcttgattcaatggcaaggcgacaagatagagatcgtgccagtcgacaggtcagttaatgttgccagtgccgatttagccctttgggagatggatggccttgattgtttatctggaaaagtctgggatggagattttctaaaagtgtccgattctgatatacagccaattgaagatggagaacccaagctattactttgagggcgtcgtggagggttctaatgtctacaccaaggatacagtggatgatctcgatgacaagcaaggtcaaggtttcatgtcggccgatgagttggaagaaataaacataggtccaagcgatcggccaaggccgacatttattagcaagaatttgtctccagagtttagaaccaagctgatagagctcttaaaagagtttagagattgcttcgcttgggagtattatgagatgcctagactcagccgatcgattgtcgaacatcggctacctatcaagccaggggttagaccacgccagcaacctctgaggaggtgtaaagctgatatgcttgaacctgtcaaagctgagatcaaacgattgtatgatgctggttttatccgtccctgccgatatgctgaatgggtttctagtatagtttcagttattaaaaagaatggcaaggtcagggtgtgcattgattttcgagatttgaataaagccacaccaaaggactaatatccaatgccagtagctgatcagctagttgatgctgcatcaaggaacaaaattttgagttttatggatgggaacgcaggatataatcagatctttatggctgaagaagatatccataagacagcttttagatgccccggtgcaatcggcttatttgagtgggtcgtcatgactttcggtttgaagagtgctggagcaacatatcaaagagccatgaattatatatatcatgatctaatcagctggttggttgaagtttatattgacgatgtggttgttaagtctaaagaagtagaggaccacatagccgatttaaggaaggttttcgagagaaccaaaaaatatggcttgaagatgaatccgacaaaatgtgtttttggtgtgtcggccggccaatttttgggatttcttgttcatgaaagggggaccgaggtaactcaaaggagcgttaatgcgatcaagaagattcagcccctggaaaataagacagaactacaagagatgatcggcaagatttctaacttgtctggaaggttagagccttttacacccttgttaaggttgaaagccgatcagcagtttacttggggggcagagcaacaaaaggctttagataatattaaggagtatctcaactctcctcttgttttgatccctccacagaagggggtaccgtttaggttatatttatcggctggtgagaagtcaatcggctcagttttgattcaagagttggaagggaaggaacgagttgtattttatctcagtcgacggctcttggatgctgagactcggtattcccctgtggaaaagttatgcttgtgtctgtatttttcgtgtacaaggttgaggcattatctattatctaacgagtgcactgttatatgcaaagccgacgtagtcaggtatatgctatcggctccaatattaaagggaagagttggaaagtggatattctccttgactgagtttgatcttcggtatgagtcgccgaaagcgattaagggacaagctatagccgattttattgtagagcatcgtgatgattcaatcggctcggttgaaatagtgccatggactttattctttgatggatcggtatgtactcatagttgtggcatcggcttagttataatttcccctaggggggcatgtttcgagtttgcttatactattaaaccatatgcgaccaataatcaagctgagtatgaggcagtgctcaggggtttgcaattactcaaggaagttgaagccgataccattgaaatcatgggggattctttgctagtaatcagccaattggcaggagaatatgaatgcaagaacgatacattgatggtttataatgagaagtgccaggaactaatgaaagagtttcggctggttactttaaagcatgtatctcgagaacaaaatattgaagctaatgatttagcccaaggggcatcggggtataagccgatgatcaaagatgttaaagttgaaattgcagcgatgacagccgatgattggaggtaagatgtgcatcaatatttgagtaatccatctcaatcggcttctaggaaattaagatataaggcattaaagtatacactgttggatggtgaactttattatcagacgattgatggagtattacttaagtgcttaagtgccgatcaggctaaggttgcaatcggcaaagttcatgaaggaatctgtggtactcatcaatcagcttataagatgaagtggttgcttcggcgcgcagggtatttttggccaacaatgctggaagtttgtttcagatattataaggggtgtcaggattgtcagaagtttggagcaattcagcgagcgccagcgtcggctatgaatcctattattaagccatggccgttcagaggttggggaattgatatgatcggtatgataaacccaccatcgagtaaaggacataaatttatattggtggcaactgattatttcaccaagtgggtagaggcggttcctttgaagaaagttgattctggggatgccattcaatttgttcaggagtatataatctaccaatttggtcttcctcaaactattactacggatcagggttcaatcttcgtgtccgatgagtttgtttagcttgccgatagcgtcggtatcaaattgttgaattcttcaccttattatgcacaagctaatgggcaagccgaggcatctaataaaagtttgatcaaattgattaagcggaaaatttctgattatcctcggcaatggcatactcggttggccgaagcgttgtggtcttataggatggcttgtcatggatcaattcaagttcctccttacaaacttgtttatgggcatgaggctgttttgccatgggaggttagaatcggctctcgccgaactgagttacaaaacgatttaacagccgatgagtattacaaccttatggccgatgagagggaggatctggttcagtcacgattgcgagcccttgcgaaggttaccaaggataaggaacgtgttgctcggcattataataagaaagtggtacccaaagatttttcggaaggagaacttgtatggaagctgattttgcggattggtacttgtgatagtaaattcggcaagtggtcgccgaactgggaaggaccgttccaaattcataaggttgtgtctaagggagcatatatgttgcaagggcttgatggtgaagtctatgggcgagcactcaatggcaagtatttgaagaaatcttacccaagtgtttgggttaatgcatgataggctcgtattgccgatgcatgatagccgatgtgcttacatcgccttgagatggctgatattgttatatcgcccttagttgtttttcatggtgtaatcggttgtggtttgccgatgtacaatggccgatattcttatatcgcccttagttgtttttcatggtgtaatcggttgtggtttgccaatgtacaatggccgatattgttatatcgcccatagttgttttataattttatcaatgcttttgacattgtaaaattaggggggcacatatatgtcaaaatgcaatggaaaatttttgaacaagttttcaaagtcatattaatcggcacaaaggattgttaagacagtacagtattagaatgtcttagccgattacaaaaaattctaagtcctattacacaaaggttattgagacaagtatcgctggatagccaatatagccttctgcctaatctattctacttcttctatggcttgggcatcttgagcgtcggttccagggataactttcagagacttggtcagatcagcaacatgcttgatagccgatttgagtcttgctttctgttcttcaatagtatttgggagatcggctagttttttgtgctccatatccagctcagcgttgcattcttcaagttgtgctaagagttcaatcttgcgagcctcgagccgatcaatgttggacttgattgggccttcagatagttgatcaagcttggacttctcttcatgcacaagttgtcggttagcttggatagtagcttcaatgtccttgcgctctcgccgttcggccagtcttaacttggctttctccagtttgaattagtgttgctcaaggtaaacggctggggtaaggatatcggctaactcatctgggattagagcctgaatctcatgtagccgagccctgattgagccacaatcaaccaccaagctatctagtgatgatgcctctagccgatcagagatactttccagagttttcttcacatcatcagataaagaggctaaggctttgcttgtggtatcttcttctccttcatcaagataatctctgatgttaaaagagaaaagatcggctaatacctgcagcaacgatttagaagcagttagaggttaaataggcatagccgatctgaatgtttgttgagacaaagagaaacttactgggacagcaggagcagttggttgttcttcttcctcaacgtgatgactccccacagccgaaggagtctggtcacttgacgattgctgtacagaaggagaaggaggaggaggaggctaaaaggaaacaagtgttagacagagtcggctgagaattaactaatgaaagttaaaattatcttactggtggagctagtttagatgttgttgcagccgatttcttcttcactgcagtcttctttttctgcaattataaaacttggaagtgatcggctataagacaaaataattatgaaagggattaaagagagatacttacccttgtaaagtgaacgggggcagaaggagttgggggcgtttgcttgggtgaagccgatggtgttctttctgtgtcactcatttcggctacagcctggtcaacatcttcgccaatttcctcttcatctaaggcttgttcaataaatggatccaaggcgggcagatcatcagccggcttatcagtcggtttggttttcttgaacttggcctttttctttggagccaagaccaaggtattcacggctgatggtctggttttccttttttggcctgcatcggctagttccctagttaggccgtgaaggagagttgaagtcttgggggcatgatagccgataacagggggagatagcccacctccattcagaattaaacccgaagcatactcaatattcttgccactattactttgatgaggaggggaggactctgttgtctgcaaagcaggagcaaaagattggtcaagtaatgaatcggctaattgactatgcaatttagtaatgacaaagtttacctggggtatgacgtcggggaacagatctgtcatatacatcgtagccgattgatgaaacagatgcagcttccattcaccccaccatctgtcaaagtttttgcttctaaatcctgccaactcaatattttcaatgctgcccagaggaggcccaggtaggttaagtagccgatccatcattagagtggatgtgatttgtcctcggcactgaatcttgtcggcaaaaaataagccgattgggagttggcccaatccaagttgtctggccgagctcattgggtgataaaactcgtaggagtcttggatgtttctcccttgatgaatgccgacaggaaggatgcatgggttgattgcggctataaaaacttctctggatttttggaatttcttgtgattaatatcttcgaatctaaaatctgatggaagttcgaggtctgcggagtcttcataagggaaccagattcgtgcatctttcttaaaaccttcgtagaagctacagaaccagtccttaagcagctcggccgataactttgctcctgcatcggttggtgtggatgcatattctccatacgacatgcacctgcgatgggtgcgctcttctccgtcatcttccacgatcggccctggcagtgtgaattcagcttctgttatagagggccgattgacaaccttcataactatcaggtttaaccaagtttgcagcagccaccagggtccacctgctccaaccactgagccgacggctattctagccgatgcattgttcaacatctgatacagatagccgagaaggattttgcccaaagggaattctttctttgattctaaggcttcagctacgaactgccaattggttgtagggccacaactggatccacagaagaggaacttttccagccacatgagcaaaaaggctacgtgctctcgaggggtaacagatccttggcccatgtatgccgccacatagccgaaccaaccacctatgctcttggtcttcaagtcaaattggttcttgatatttatgctcatggggttagccgatgaagtcacatctaatccggtaatcatggtgatgtcgattaaagttggagtcatcggcccctggttgaataagaaagcgttgatggtgttcgaccagaagtaggtggcggcagccattagaggttcatccttagcagaattggctatggtgagagcaagtgcttggccgattccaatctcgtcccaatgaactttcttactagccgcgttgataccaagtagaccagctcttatcaggtgtgagtttttcgagagatggccaagacttaaaggtattcttccagtgacccaagttagggttggctagcctaaaagggatccggttggtttcaccaatgatgaaatcagtggggtcgagattgccgattgggccaaggaaatagtggttctggtgcaaaagactgggaattgcgacttggtgggagagatgctacaaatccaaggcaatcgatataaggaaaacgatataagataggagaaaatcgatctgctgataagaaaggggatctagccgatagagacttacctcagtgtactcggttgatggcgcatcagatgggttggtggaagacgacatcgttgcaagcggaggtcttgccggagaccaagtcgcccgggagtcgcttttgcatcggaggaatcgccggagagagaggggattaagattcgcttgaacggtgaaaacggaagtcacggtgtgagatttctcgagggtgacggttagtatttaaagcacggcaataacggtcggaaaacggcaaagtgcgaaacttcgtcggagtcgatttacagcaaatccgaaacatttccaaatattccggacttgggggcgtgtgttaacaaccaaatttggtaacatcggcattgggaaagaagattagatcgaagcaaagtcggaggcggagatcgagttcgaaaacagagcaggaatcggctggagtccagatcggctacgatgagatcggctgagtctgagacgggctaggtgagccgatgtagccgatcccgacaatacgacttgtatacgacatcgggtttaagttaatgtgcttcaagatgattgccatgcacggatagagtcctgggaaggcaattgtatctattaattaagatattttatgtaaattccttatagataaatgtgggcaaaagtctaccgcaaagacttatggtattttagggtttgttagatataatagtcgtgtccggtatgggtatatcttgtaattctcgggtataaatagaccccgagccctatgtaattgataacacacacgttcaatacaattttggcgcatcgccacccttttgctttagttttgtttcgacgagttcttactttcgggttgagctgcatcggattcgatcttcaacaagaggtaaaacttgttatgatgacttatattctcgggattagtgcttccatctttatgacactctaatcttgtttatgtaattcgtcgagttatcatatatcttacataatctctggcaatatcgctatctaatctactatcggctaacatctgttagcagagggcaaccgattaggttagattttgacgttgatctagattatataagatatctaccactctatgaaacttctagcggcttgattgtctagatatcgttcttcttttcatacttaatgctatatcagttgagtttgatctattaagtcgtgcttagaatatcgatctttagcctgccttctagttgctgattagagtagcgtcggagtttcagccgatcttatctgatttaactatatttgttctatatgcttcattgacatgttaaatctgtcctttatatcgagatattgttgtatctaagtatattaggcctttgtttgatatattatacctgctttaatttcctgatatagagtagtatcggagtattagccgatacatgctagatctatctgatcggctatgctataaacatatatagtcctgttattgatatatatatttcgatctaagtgatttatactgtctcggcatggtgaccgatctatcccgatcacttgatttaagtatacatcgatataaggggtatatatcgttgatatctacagctgatcgagtagatttagttctttcttacttattcatgactgccgaccgatacacagatgacatcagctcaaagataaatgatatgtcatcggcatctagccgatcggctatcatttatagttttaatcacggtttctttgcttctatttcttgttgattacaggatcaaatcaattggcacgctcatacattcgaaggcgagctttggacctgcactggagttaagaagatctcccaggccacgtgttttttgtcaacagatttatgctattcgtagcttacgcgtatcccatcatcagcctgtcacgggcgctggggtcgtcgcgctcgcggtggctgcacaccagagccgctgctatgattacccacgctagagtcgccacgcctctaggttcgggatttgacgctgctattaacgtgcgggaagaactcaagatggggaatatgaaccctagagcgagaggaactctcccttcccctcctattagtttgcaaccgcctggtcagcatgacaacatggcaaatacggtccagtcagtctgccacgtgtgcaaaacctcctcgtgaaacagcctagggggttaaatggactggattataaggtttggggggctagataccccattttatagttctgggtactatatagactcttgggcatagtctagggggatttggacttttttctatccagtaaaagtactacttagaatataaaaatgaggaggaagagtctcttttagtagaatttttactaagctattatgcaaattgaagcgcgggaggaaaggagctggctgtggctggggagggggcaagtgcgggtgctcgtgcgctcgcgtggtggtttggcccccttagtctctcatctctcctctctacacacacacgcacacacgcgcgcgcgcgcacacacacacacacacatatatatatatatatatatatatatatatatatatatatatatatatatatatatatatacactttatataaatacgtataaattttgtatatacgtacacaaattatatatacatatataaagtacgtacatatattgtaatatgtatatgtatatgttttttatatagatatgtttaatgtataaaaagatatatacacatgtataatgatttataggtgcgtataaaaactttgtatacgtacataatttaaaaacaaaataactgagagaaaagaaccaaaagaaaaacatatcacaaactttatatacatacacataaaagtttgtataggtatgtattaaaaaagggtgaattggaaccatctagagaaaaaaaaaagagtgagaaagctgaaaaaaaaatataaaaaaaagaccacgtgcctctttcccacgctccgcccccttctccgcgcaagccacgtgactgcgccattagatagcctttttgccaacctagtatttcctcagctgctcagctcgtcagttgtcctataccacgtaatattgaaggagggatgacctcgaagctaatgccatctggatcggtctcagcttctcgtgccgtcgtgtatgcttaattatgtggagtatcttttatgattatgcacgtgacaaaactatatgcaaaaacaaaagactatatctaacgaggagaataattttgacgagctaatagacagagagaacagtgaaaggttattaaaacttggccgacaggaagcacgtggcgccggtggtacgtccgacgaaaggacggtacccccggctcgcagttataaaactagcagtacaaggtctgctcatattgatacagcagctacacagctagcaccactaataacgagcaagctagtcgtcagtggcgaatctataacgaaaatataggggtgctcctttctaatgcgttttaggaagtatggatgaaagcttgcatgtcatctaaatagttctaattaatttgaaaaaaaataacaatatgtattgatatgaaatatattactccataagtatataacttctacgagttacaacaaaaataacaaattaaattgaaaatagttatcgtacattcacaattatatttattttttttgcaacatgtagaagttgaattttaactttcatgtttgtggagtgatatatttcacattaatcatttttttaattttttgatgattatttagatgacatgcacaaaacgatgtgatatcccctcgagggataaaaacgctttcccatgatggaagacaatacgacaagggcacaaccacaaattcaataacacaattgttgataattgttggattactttgtgagtaaaaaccactcacttccctaatcccctgatcgttccatccattgaagtaggaaaaaaaaaagaaacaaaaactaatacagtagcttaataaggaaggtctagcagccaattagtccacttaatcacccatggatcgcgatatgttgtctttgtttgctccttccttgcgacctggttgatctgcacttatgctatacgctgcttctctcccgaaaccatgcggctgctgctggttctgccgagatggagctggggctcaagccccaacgagccccaacgagccccaacggtgaatccgcccctgctagtcgtagctagctagcgagtgaatcagtggagtgacgagagatctcgcgatggcgaaggcggtggtgctgccgctggttagcaagcttcaggaggtggccctgagcgaggggagggcgctggttggcgtcggcggcgagatcaaccgcctccgcgacaagctcatgtggctgatggccttcctccaggaggcggacccccagaggcgggcggccgacgccggcggcgagctcatgcgcgtgctcgtgcaccagacccgcgacgccgcgttcagcgccgaggacgccctcgacgactacgccgtccgcgtcgacctgtcccgctaccccggctggtcgcgcgccgccgtcggcttcctcgccggcatcaccacccagctgcgcgtccgccacaggctctccagcgacatcgcggccatccatgcccgctttgaggagatcgtcggcaacaaggacaagtacaggctggagggctctgcgccctcgtcgttgctgacgtggactgcctccgccgcctcctcgagtgaatcaatcctctggttagtcaaacacagtccttacacgatcgaaacgctctattcacttcatacgtcctccttccatactcgtaaagaaaatcgacaatatttaacaatataaattataaataactcagtcaaatcttgagaatataaattataaataactcttaagttattgtgtttaaaaatataaaaattatataaatagatttgtcttgaaaaaaactttcataaaaagtatacatatatcatttttcaataaatatttttatagaaacaagaagtcaaaattatattttgaagaccgtgttaatatcctaaacgacttcctttacgagtacgaatagagtactcgtacggggatacaagcgagctaagcggcgaacccgcttataaacaaaactagtgcataacccacgaattgactcataggttaccttctaagggtttgttcggcacctccttttcccaacccctctatctcgttttccgcgcacacgcttttttaaactgctaaaaggtgtattttttgcaaaaaatttatatacaaaagttgctaaacggaggaagtactcggttaattataattacatgctaatgcttcatgtctttgtatacgccattcaaaattccagtgaaagattcatatctcggggctgtgtttttttgggaggttgggaaccctcccatctgcacggaaatcggagcgatagattaacacgtgattaattaagtattagctattaaaaacttgaaaaatggattaatatgatttttaaagcaactttccattataaacttttgcaaaatgcgtaccttttagcagtttaaaaagcgtgcacgcgataaataaggaagatgagttagagttcatgggaaagaacacagctaggcttttccttggtttcaacgattaggcttagattttcgacacgggcgtgaaacgtgaaaaaccgttagcatatactctatgctaattattgaaaaaccactagagtaactaatctagtagcattaatttttttaaacttgaaaaaagttatttatttgatttttaaagatactccatagaaaaattttacaagaaacatatcgtttaatagttagaagcgtgcttacgaagaatatgaaaagtttataagaactcacacaagagtggttttctggatggcatggtaatatatatgtagtgaaacgttttctttatttttgtaaatccaaataaaggaaattatctttagacagttttttccccaaatacagtatagaatctcatgtgtacacacagagcttatgatcacatacacgcaacctaccaagtatttctgagaaattgagctgtcatatacacttaaaatataataacccataaatactaacatatcagtattgagtcggttacaacaatgcatggtagatcatttgtgatcatatggacaaatttggtatgatttaaatagaaatatgtaaatatcatcagttcattttttttatattacatgaagtcatttctcacatgagaaaaacttatttcactatatacagatgttaacacagatactctatacagcaattgtgtgtatgttcataatgcatgtatatagaagtcagtactttaaaaaaattgagaagaagtcgcttactacttaattaagattccaaattaaagtggttttagcattgtcacgcattagtaaagctacagtaaaattgtgcaaagttaattaggctcccatcggatggcctaatcagctaaagaaaaaccaaattttaaatttcatacttaattttgagattgattttcagatgttttcaacgtagtttctttttcaaccttggcttttaaatcacccagaacacatatataaaagttttacctacaaattcatttgtattccctaataagccgttttggcttattagagaaaaagccaaacgatggggaccttagtttagtactcccatccgttcccaagtagttattattataaattgtttagcatatattaatgtgttgggcaagaaataaccatagtaccttaatatttgattcatgtgttgttgggagtgagagggtggttaaaggtaggaaggaaaaactatatattgaggataactgaggtaacaaaaattactctgaagtaagttactctaaagtgataagtctttttagataaattacgaatccttaaacgacgaccagctatataggacggaaagagtatgataaaaaacagacttgttccgttttaaacgaacgtcgataagacctctttaattaatttgtttttatatcgattcttttgaactttttcttctgcaaagcttccggaattattattcaatctcttgcggggaattattattcgatctcttgcggggtacgggttgtttgcgatttggctgcatcactccgttgactgaccacaaaagtctcgtcaaatcacgtgtctggccagtaaggggatagcacatacttgcattcaaataaccttgttattaagacaaaacgaaataggaaaacttgccacttggactaaatgatatgcaccacttgtacttaaaagaacgacttacgtacctttagtctcaaattaaactttggtttcttttatgtcatctattcttcaacaagcaacttataagaatattctaaacacaacatcatctaactatcgcaacagtacgcatgatttacacccctaaacttctatactgaatattttacaccctccaaattttcaaattgaacgaattaccctctaaccaagccaagagcagtttgatgccaagtgatatacgcgtggtaaccgagccaggggattttttttttcaagaaaagtttaactagcccacgtgtatattcttcctcccaatccacttcctttctttctcccctttctctatttcttgtctcagttgcttcgagcacatgcctagctgttaaaaaaccggtcccaaaatcaccattggaaaccgaacatggaagaaacgccataggagatcaagcacgatgagaacaacgagacacgatatttgttaacgaggttcagccgaagcctacatccccggggcgctgattacaagcgctatttcccgatccagcatattaaaacgtatcagagttacaacgaccctcggccggacgccgcaggcggccgctccctctcgctatattaagtcatcatatggttacaacaggtctgactctctatttaagagagatcttaagatagagtccgactcttactctagacctaatgcctattacaactccaattcttaaattgtaacctactttgtacacatattcgacacaaaacactaacaaattccacatcggtgaatatgccacgtcaacctgaatttgtcccatgtatgaacctctgcttacccagacttgagttggttcctttttgccgttcatgttgagccgcccccgacgaaccttcacccggctcccgttaacgagagaccttgctatccccgtaaattatctctcttgactccacccgcaacagggctccaccttctctcatatcactatagtcgtcttgccaagtgaaattaaatttcttcttagctggcacacagcagactccgcaaagaccttgttcaccttcactttccattttaagtttgagttgatctaatccatgatgtgataatacacgtatcaccaaaatagataaatcaaatacactagaaatgaagagaaccctttatgtatcctaaatatatcatgtactgtcaaacagtccgttgacactctcaatgatattcatctgctgctgcctgggtcctactcgcatgctgcttgacaggtcgagtctccctgcactgcttttctgcccgaaccaatactttgacttaatatgacaccgttgcatagccaatgcaagaaattccttacacatggtctgaattgtagcatgcgggattatgatgaagatacatgcatgcaaatgtatttaccgtccaggagtacaataattgtgttataatcctgaccaagtacctatgcgtgtaatattcttgcatgcagtgcagacacctcggt

SEQ ID NO: 51355 - DNA, 17162 bp, Oryza sativa
tattgttgaagaaattttgatgatttgatatggatctaatggttgaaattgttagttagggtgtgtgtgattcactaattaaagtagtttgcaacacttgagttagtcatatttgatacttgatgaaacccgtgctgcaggagttttgtatcatttaagatagctagatgacaactttatatactttatacaatattcatctttgatcgactatttaaaaaaaactatgaacggtagtttataacaaaactaaggtggtgtggctcaatgagaaagaaaagaagggagataatatacatttatcatccaaaagcaaaactaagttgataggagaaaaaggagggaataatttatatatttttttatctttggttgactattgaaagaaaaaacctaaacattataagatgatatggtttataacaaaactaaggtgatgcggtgcaatgagaaaagaaaaataagggagataatatagatttatcatccaaaagcaaaattaaggtgatataatttaataacaagaaataaagaggaaaataaatttggaccgtagatcaatcatccatgtggcttcatgacgaaagagagaaatagcattaactacacttagtggggatgaactggtgtttagtacctagaaacaaaataatattcacttttagatgacttgagctaaaatgaaaagaaatacacattaaaggaatcaagatactatttataatatttagaatttcttatgatagttttaatttttctttgttttttttaaaaaatagatggttaggacaaaaatatgttgatgattagttatgcagatgttttaatattgtgagaacatcgtcaaatattgttggtaccatcctaatcacaataatgtatttttaccaacacaaattcaagccacaacaatagtatgatacattcataatgaatatcttaacctttgtggaccatggttgctcaaaggaattgacacatgcatggggaggtaacattttagggtcataaatagaaatacttaaaggaatttaatttcttagttacacaggaagataagagtcatctctctcctaaacaatccaatagatatcatgagctacatgtgcatttcaagaatgatccaattgttaaggtttaaacggtgacgtgggtcaatgtatgttgatgagcttgcttagatgaattgacacatgcattgggaggtaacattataaggtcatgaatagaaataattaaaggaatttaattcctcagttacacaagaagataacagtcatctctctcctaaacaatccaacagatatcatgagctacatgtgcatatcaagaattaatgatacaatggttaagatttaaagggtgatgtggctttatgtatgttgagcttttggtcccaactatataggatatatagatatataatttgtagctagtgttttaatcatttactacaggttggggtttgccataatttcttaattttgatctgactcgtcacatattgtttgccttgtttttttatgaaatattgtttagcttgttttaccacaagtgtggccaccaattttggtgccacaatccatatataacttaaacatgtcgtggttttgctacaaaattgtggcaacttctggaagtgaccaaacaaagccccaaaattaggctatttggggctaatgttctgttgatggccatacactaacctgtagattgtcatcttgttggaaatgcaggggtacatccaagccaccaattatcgggcgtgacgaccagcagcaggaactagaggcaatgcttctcagctccgcaggatgcctcgccgtaatatatgtcgtcggcgatagtggtgttggtaagacgatccttgtaaacagtgtctgttcaaaccctctgtcagagaacacttcaaagagcgaattggagtgaaggtcggaaaagatgtggtatatccaacatcctgagtttgataagcaaagaactgaagaaagaaaataacgaaagtgacaatgagaatcctagaagcaagatacaaagacgtcttggtgaagagtgctacttgatcatcatcgatggcaggcagatgtccatcgctgactggaatgctgtgatccatgctcttccgaagaacgaaagaggtagtcgggtagtgctcatcacgaaaataaaaccacagtttctagaccacccaatgaatgatgtccatgagataaagctgacatgcctcaatcaaacggactgcaggaagctgttccacatgaggctccatggcaaagaggaggatgaacaaaaccaaacctacctgccaatatactaccagcgtgtgtatgacattaccgggggctcgccattggcagttatcctgcttgctggactcatgcacaacaaggagtatccacatgaatgggatagggtgttaaaatacctcgagtcagccaaagagaagcggctcaacaggatactgtccctgagcttcgatgacctgcaccatgagctcaagctctgcttcctctacttcacagcattcccggtcagctacaaggtgtaccagaacgtgcttgtcaacttgtgggtatcagagggctttgtggtgccgcggcacgggaagacggtacagcaactgggacagctatacctgaggcagcttaccactaggggactagttactgaagcatcagctgatggtgactacgacatccgccactttttcctccatgacagtgtctacttgtttgcacggtcagaggcacatgaggcaaacttcatggagctgcatgatggtgactacttcccatcgccggacagggctcgacgcctcacactacataacagtatggacagatacgcggcactagataacaagatgcccaagctacggtccatctttgcaatcttcgaagagataccagccagcacagcagaagaaagtgtatcatctcctagctgcttccccacctgctgttcatgcgagcagcacagatcaccgaaaatttcaagatttgacctcaccaagctgctgaaaagatccaagttcctacgagtaatcatgatcgaaggcctgaatatcggcaccgagttgcctgaggcaatcggaggcatggtgcatctccgttaccttagcacgcgttgccgatctctgaggaggatccacccgtcgattgggaatctcaaaaatcttcaaacaattgatgtcagacaaagcttagtgcatgaactgccgtgttccttttggaagatcacatcgctaaggcatgtgtttggctctgagctgatcgtgccaagatggactcgtgaactgaaacagctaaatacactcaagtcggtgagagcattgcaggattgggatggctctatgttgagaagaatggttaacctcaagttactggatgtgactatccaagagaagctcaaagaggagaaggcgcgcaagttatcagacaaccttaacaatctcaacaaccttactacactgatcttgaaaggagttgacctcccaatctctagcatttttacggcaccttccctgcaattcctcaagactatagaactaaccggaaccatcctgctcacaactccatcaccagaaatagacaagatgaccacttcaccttctgatttccagctgccgaacttgagcaaattgtcattgtcaaagacgtgtctgcaacaagggttcattggaaagctaggcaagctgccccttctttccaatctcacactcaaggatgtttcttgtgacggagaagagcttgttttcaggcctgatgggtttcattgcttgaaaaaattggaagtaaacgacacgtccaaacgtgttgtgatagaggagcatgctttgcctgtattggtctctttgcatatcattgggaacagtagaaattaccaacactcgatccatcctactcacaagattatcaacaagattagacatgaggacataaatctttttcagcgtatctgcacttgtcatcagaaagagataaccaaaggctaacaagcatatatccttgtaagtttgtcaaattatatcgctttagctctgtatttttccatcatatgttgtttacatgcatgtaacaattggatatccttctttttgctaatttccagtgttaggaagagtccttcgaagtgaaagttgtacgatgtcatcgacgaagagtcagtttcctcttcaaaatgtcatcgacaatcataaaccaattctgcaatatgacattgcgaaagtgatttccttctgtttgcaatttttacacaatgcgcaaattacctgtaagtagacttgtacttcgttttcttgttttcgtttttctcaggagtcgggtgttgacgtgttgtagttcgtcattaatttcgtttccttgtgcgcggaaatgcgacccgcctcctggatcattctgtactattgcaacttacacaaccactgaataaactcgattagtgatcatatgaattgtttgtttggatctggagcatctggaaagttgatagctagaaatatggcatgcatggactacgatttttttttcgctactttgtgcgtgcctcttcatcagggttatttttttcgtggaatatttgggtgcgattccatctttaatacatcaccaaacatattgaggtcgaatataacaaacttgattaagcaataaattttaatcaaatggcttgtttgtttacatggctcgcaaagttaacggaattaattcatctgcagcctttcatgtgcaaaggtattgcgaggtacagacttgcatttatttgcttcccatagcttatgctccccctctcattttcttgtttctgttatgagtggcaatcctgttatttgtcatatggactaaatgcaaaccgtgatcaccctggattaggtatggtaggcatcaatgcctgatttttctttgatgtgtctccttgcattcgctggtaaatgagtatttattagggttaattgatccatgccattataaattcttcagttttgagatatgccattactattcaactatttaaggtcatgccattataatttttcaagtattgaaaatatgccactacatactcctttgatgtgtttcacaaaatttttagactaaattgccctcgtcgtcttctctcgttcatcttctacctcctatttttccctaagccagatttggatctgacgatgggagaagacgacgatgaggccaaggaagaagatgagggcaatttagtctaaaaattttgtgaaacacatcgaaggggtatgtagtggcatatttccaatacctaaaaaagtataattgcataacactaaatagttgaatagtaatggtataaatcaaaactgaagaatttataatggcatggatccaattaaccctatttattatggcacatttttcatgtccatgacgtcatcaacaaggggaatattatcgtagaagtctagaaacctggttgaaatataaaagttttctagtgtggcttggcatgtgttctaagagcagtacgataatcctagtcaggaggctccaaaaatttttatattgtttttttcatagatggaggagagagaatcaaagagagaacaacgcaggcccggcgatagcacgcgttttcacgcgcactcgcgattaaaaacatattttgtgggtcccatggtgacctatccgatcccgtgcgcatcctccttcgttccgccctccggtgcttcgtcgaccgacggacgatgtcttccgcagttccgctagtgttattcattgtcagcgagcgagaaaaccccaccgcccccacaaatcacgcagtctcgtcctccatcctgcaccacgcacactcatcctcagttcctcatcctcgtccatgaagtcttggcggcgcaattgctaccgacgagaagcatctcatgcgtgcgccaaatcctgataatttgggtacgtggtgaggtaagtagcggtgaccgtccctcgtcttgtgctgtcgcataatctgatcactgatcattcatgaagacccggtgggatcgatgtatggatggagctaatccatcgcgagcttgctttgttgtgttcaccctcatatcacaacaatgaccacaagaataggatccacttatgatcatacatgtcaatacctgtatgcacaattaattgtttgattacaaaattatagtcagcacaatagctaatctattgtaatagttggctttagtagtaactacgaaataatataagaatggttggagccagcagccggctaactattgaccttgctctaagcgccggtcgaccggcagtttccatgcttgatatatataatagttgtatgcaatattatatgacgcagagactgtgacttttatattattattgttatcttaaaaatgtgtaacccatagaagaggaagtgctgccttcctagtttgcatgctctgtttctcgtctttaatttgctttcatgcatgacaacatgttctaactatcaactacacactgtaggcagttgatgacatgtaaaagtccctgcagttgctgacatatatatcctcacttgattctcattccctattacatttgaattaagagtgctctgtgctcatactgggtttcttcctgggagcaaaacaatacaaatacctgggcatcgaccaccccagcgcaaacccatcacaattataccccccacctctgtatttaaaatgatttggtttgcgcctcggtggactgagccttgtcagttgtcactttggtcctgtttggaagattagcccagggctaattttgagagctaatatttagtcttgaattggtaggctaatgtagggtgacatgtttggatccttagactaatttggggctaaaaggtggaaagagagaagagagagggagatagggctgctttttgatggtctccatagaaaattagctccattagcaccccttggaggggctaatgttttgaggggggctaattcactttagctccaaactagcccacctgtttagatcctttagggctaattcagggctaataattagcccatggaaccaaacaggacctttgtcagcctcataaaaatatatagtacaaaaaaacgaaatttctaaacaacaattgactacaataagagaattgttcactcaatttttttgaacagcaatccaacaatgacgtagtcgatttttttcctctattataagaaataaaaacctgacggaaataatgaactaaaacagctgagtttcccttcatgcatggaacttaatacatattatgggtcaacttgtcattggtcaaaaatcgactgatgttcgagatgaaataaaaatagccgagtaacatctaaatgctccaacaacattttttttttgacaagagctcccacaacattttagaaaaagagcgagagaagaaatgcacatatgttagaaaaaacaataaagttgtatcatgaagacaaaatataaatgcatgtgctaatttcctgtaatccgaaacaaactcagaagaccgaaagtgtccaaggaaaaacagtatgcatttcaagtaacgaatatcttgcctagcagatccacatatgatgatatgcaaacaccatgttctatttaattatcgtaacatcaacctagaggactataattcccctaagtaaactgctccagattcctagacagtcaagaatgacagcacagtccaggggtccttgattagaaacacgaaaaacacttcagcttgaattaaaagagaaattgatataaccgcattgcagcatactagtggatgggaaatctggagaaacattgttcataatttcatatagacaggaacttaaaacacccccacaaccaagagtgcgaaagcaactaaaaatccacttgttcacataggtacatgaaaacaaattaagtatgcataagtttttctactataaaaatcagtgcttcatacattaagactcagtaggatcggggttgatatgcagcagttcattcaggaggaaataaccatgtcgaattcatcagtcttccatctggtgtctaaattttgtcctctgacatgtctgcagtaattggtgtcattgtaccatctttcatgttgtacacagatttatcaaaagagcggtcatgcataaaatagataagataatctttgactacatcataatgagataaacgaaaagacttgctgctgagttggctgataaagttgcagtcgccatccaagctcttgatctcagtgaatgtggcagggtttgtgctgcagtccacctcatatactctaatctcaataatgttgtgcccaaattcaccaaagtatgtcacaactatcagtagtttcccgcgccactctactatgctccaagtctcattagcggtacccatgaccccaggcagtttgatcacacaagactcaacacgagaaaccatcaagccattgtcatcttcacagatctcaaagactaagaggttagtggtgaatttgccgaaactgagcatgtggaggttcccttggcatggcagaagacaatatcaatggacctaatgatagtatcaccatcacacacgctccacgacttcatcccaggccgccagagagcaagcttaactgcatccttgaccatggaggtggcggccacaacacacttggagccagagtcaggcgacgaggacaagacgaccttccagaacaacatcacgcacttcgctgcgttgatcgtgcaatgcaagacaccagagccattgatgatggggagagacctagtgtaggcatcagcggagcgggaggctcccgaaggtagcgggagtcggataacatcccgggagaaactgttcatcaagaaacgccggcggtcaccgaagtagcgacctttgttggccttgacgccaacgagccatccctcgaacgagcccacgcagcagacgctgccaccagccgccatctccctctccctctccggcagcgggacacggccacgcactcccatgatggtctctcctgcgcagaagctggagaaggagaagtcggccatcacgagcaggggcagcggcggcggcgaccgctggtggaggacgcgccacgcgcggcagacggagcgcagcctggcccggtcctcgacgagggggaggcagccgacaacgaggccgaggatgtccgccgggaggtccgcccacggccggcctcgcgcgtcgtcgagccatggcgcctcagaagccaggacgcattccgtcgaacaccttgcctacgccaccgctgtcagcggccgcgacacctcgacgccatcctcactgacgcggacaggcaggggcgcgttcgggctctgatcagccggggttcctgtcgcggcgtccatggccgccggacagtgttgtggcgccaggggctactctcgcctcggggagaacagcgcctggagctctcacgtacggggtcggcacggaggcggcggcggcgtcgatcagcttggcgaggtgcctatctccatcgagcagccgctcgcatcgcgcgggaggaatgagggcatgagggcggcgtcgctcaggggaatcgcgcagtcgcgtcgcacctcgcggagtcgagtcgcggtcgttgcagcggcaatcaggattcggctactttactataggacttacagatttatatatgaatatatgtcaaatataaaaattaggatcgttttatattaagatattataagagttatataagaaataattatttagcatgtttatatgttataatttgtagatggtatcccagtttagtagtctttctagcatagaaatgacaaaatatagtgttgtaaaaatgaccaatgtgcctttatgttaatcatttcaatgcttaaaatttgacacaaaactagtattacgcctaccattacatgtctgcaacaaacatggagaaaaaaattaataaaactattcatgctagtggctcacctactagctgcccacgacatggacaatgacttaaattcccagcgacaagtaaacagggatggagggagtagtctagttgcaattaagttttactacgtactaataattatcatgctagtatatgttaagtttttgtgtgttagtaggttgatgtgccatgcttgcatactaataattgcgatgcttacattttgtttaatgtgtggtagtaatgggttttgctcatgtgttgtgatgagctatacttgcatccagccccatgggtgagtttttagttcccatctccgatccgcttaaggttgttttagttgcttatctccttagacccagctctcttcttcaactccaaatttcaacatcctcatttttcgtaagtacgttttttaaattgttaaatgatacgtattttgcagcaaatttctatatagaatttgttttttcaagtttataataattaatacttaattaattatgtgctaataggctttgcgtttcgcgtgagctgtaaatcttcctctaccgctatgcaaagaacgcagccttagtctagcccatctttttcgtccaggctgaggttgggcacgataaggagatatgtttggttccttgtgctccctctattctaagatataaaatacaatcattttttatgtgtcataatataaacgtatatgcatctatatatttaccatcaagcacctcaattatattgcacgcattcatcgatatgatctaaccgataaggtgattaaattatttatttgtattcatgttggtagtgtttatgccttatattttagaatgaaaggagtattggtttagcgtgactagtatgagattttgtttgattacttacatatgagatacacatatgagatacggtttgaaatatattttgtttgattgattgtatggatttgaatgtactagttaggtgatatcacctctaacaaaaaaaaaatcagatttaactataacgtgatagttaggtgatatcacctctaaaaaaaatcagatttaactatcacgtgcaaagaacaataatatatattggtgttcaggatcggtgaaaaaaaaaagaaattagcacaaatatgatcggtctatagtaactatccttagaggactgttttcttttgcctctgaacagtcaagcttacaaggagtatctcaaattggaacatgaggtctctcttctcaatttggacgagggcaagggagatgaatggagctacatatggaattctactagatatactgctaagagattttacaagcttatattcatgtctttgcagacgccaaggccttatgtttggatttggaaaacacgtagtgttatgaaaattaaggtctttgcatgacttctttttagcgacaggttgaacactagagatatgcttaatcatcggcattgtgcaaaggaggatgatgatcttacatgtgtacttcgtacaaatggtcatagggaaataagaggacatcttttcttcttttgtcctttcagtcagagatgttgacggcacctaggcattctttgggatcctaatctcaatttctttcaaatggttgtggtagcgtgactgcgtttccggcaaaagggcttcttggaaatttctttattgctgcccggcatatttagaaagaaagaaatggaaagatatttcagaacaagaattcttcctttgaggcctggagaattttgttcaagaaagaaggtcttctgcatatgtgcggaatgaaagatcatttaaagtaaagagtttttgattggttataaccattataatattttcagtgctctctttgtaattatcttttgtaaatacttttccttttaatgaaaatcacactgcgagacaaagttctagcagtaatttaaattaaaaaaaactatcctatagttgtcataccactaagccaattgtgtcactgttatccaaaccttactaacaaaaactgcatgaactaccacgcatgaccgtgcaaatagaggtttcttcggtttcaggagaaggcttggtttttattttgaaccgcttatgtgttcggtttatatctcacataaactgaacttccgataaaaccggagacgttgttcttgtggatggagcatgcaacatttcgcatcttgtcgcgtactatagctgatgctagctgcacttaaaggatgcgcggccgcattttggtggagcgcccggtacattcacaagcccattgtgtatataatatccttatgaggtctatgctgacaacggcctaacaacccaacacgtaaaaccacatctttgtgttggaattaatatgtgggttaagacctatatggagattaatttttgaaatcaccaaagcccactgtttgagaaacaagaactggggtcctcattcctccgaggccctaggacactgtgggcccacaagatcactttctcttacatatagaggtcagaaaccacggaagtggaaaatgacaaatggtgtggagcaggaaccaaggcccctatagaactggggctgggggtatcgacgccctataaggtttacatctacaaagtctcaagaagagtattgagacatacaagatcgacatattcaaggtactggagtagatgcatctggatattggcatatcgtccaaggtcatgtccatcatgaactccttcatcaatgaaatcctcgagaaacatgtcaaagttaacaagacatctcatcaagcagcatgggagtgtgcaaggccccaggagtacatgtgggccctaggcgcggatcgtgctccgggagtacagtctgccctggggatacagcggttcatggcacagatattgccacaaagtaagacttaggcgtatcattatcatcttaaaaggcgagctttggcggtgcttgttgcttgggcgctcaacctgaggactccgttggcaacgctcgctgccccgggcttagcctagcccaggatctcctcccagcgttctacgcagggtggtgggcccggtgattggacggcgagcgatggcattaagccgtagcagagcaacatccagagaattacaacttgagattacaggtcaattacatgcaagaaggaggtggaaagacatgaagtaatcaagctagccacgtcacccaaaggaacaagggcatagtgacatgtacatgactttgccgtgaagtaataaggtgggcggccaatccaccatgccctcatctgggcccaccatgctcggtttcagaataggtggtgcaagaagccttctctagctatcctaggccccttgctaagccttttcggggcacaaagcgtagccccgatcaacagcaatgatcacgttcaaactaatgtgacaggggaacgatgacaagaccaagcatagtgccatagtcacttccccgtgcaagaatgtaattgtaggctccccttagggtataaaaggaggagtcaggttactttgaagaggattggatgtttgaaagaactaagcttgaatagaactttgtatcacattcatcacacaaagtcccaaacacgagaatatgttgttacgcttccaagtggtccgaacctatatatttgattgtgttctttgtttaccgcacgaacaagctcgatctaaactcaccccccggctgaatatctcaacagggagtacttgttcccagctagaggagatccactctttgacaccctcctcatgggaaggcatgcttatgaaccttcaataccacctttgcttattctaaaagattgagacctccttaaataggagagtgctctcctagccacttgagacatgtataatggagagaactagagggacacacatgcacttgcttgcctcgccaggctcggcacgggccagatcggacgcggagggctcctcatgcttgtgcaaacgtggtttccttttgctgtagaattcagtttggtttttggaaacacatcgaataatttgatgcatggagcggcgtggagtttggataagatatgcgcgatttatccagtttgattacgccatgtggagatcttgcaagtgtcctgatcacgcgttctgatatctctatataaaccgtccgccgccgcctcacaacatacacaaaattaatctagggtttgcctcctcctctgtaccgtgccgtcactcgtagtctactccgtcttgcttgtcggcatgcactggcgatcgggagagcagatctccagaacctttgccctcaacgtcctgcactgagagaaggcgacaataaggtttttggcaagtgcttcacgcgacggcttgctggtcttccacgatggctcatcttcctctacgcttgagggttgcgcgatgatgacaacacccagcaccacgcgttgttcctatgatgcgtgctactctttgtcaatccgatccacagcagaagcaaaaccctcggtacgtgttcaccatattccatttatttgacctgttcatgatttacagcctggtttacatatatgtatcacatgatgtggttgtactagtttacatgcttcatatcatttgatggaatatggtgatacatgatattaaatcaatatgcttatagttcaatataagcatatattgatttaatatcatgtatcaatgtatgcttatattttcaaaactttgtagagtactccgccggtttcttcggtagaaaccgacaccgaacccaaatagtgtggttttccttggcttggcttcctaatttgttactaatgaaatcggttagtgtttataaaaagccgaacatgcacaaaatagtacaaatcgaaacgaataaaccaaacaatcattcctaattccgacaacttgctctgtagcagcaatggagggaggagggtgggtggtgccaacacgtcaggctgaattgttatttccgtgctactctctctgtcccataaaaaataaatctagaatatgatgtgattctaggttcagattcatagtaatgtatcacatcttgctctatgtttgttttttttcggacggatggattatttgggagtgacgctggcaaaaaaaaaacaccaaagttcatatataagcccggtccacatcgcttaaaaagaattagtattccctcccatcattaatatatgacgttagtgtaaaaaccgtcatataatgaccaaaatagaattagtaccatatgttcgtgaatgaatctgccgtgcaatgcaacgacacgcggtccacttgtattgcacagcccgtccccgcggcccgcggtgatggatgatggtctattggtctggtccccaagccccgcgtccccaacgcgttcttcgtccggttcgccgtcccccgtcacgcattcattcccactcccaataatcatcctccctgtttctcttttataaaaaaaataataataatcatcctccgctccgcgacgctcgcgcccacggggaagccaaacccagccactttccccgtctccttcctcccctactccggcgccctcccctccttatccatccgcacccacctcctccatcctgctataaaccaaccccaagatttgtcaccctccggtaggtagtaccactccaatcccaatccaagcctgaatcctcttttgatgtgatggcagtggagcgcggcgagcgccgtggcggcggcattgggtgcctctcctgctgcttcggcggcggggacggggacggggaaggagaggagctggggcagcgcgcggcgagggcgctgcggacgtcgtcgcggtgggtgcgggaccgcgccgtggagctgccggagatggtggcgctggccggggggcggcggaggaagccgcatctgcagcatcatcagcagcagcagctggccggggagttccgctacgaccccgtcagctacgcgctcaacttcgaggaggacggcgacggcgaggcccagccgttcaagtacatggtcttctccgcgcggctgccggcgtccccgccgccgccgccgccgccgacggcgctgcccgtcgaccggggttcttgaattgattgttaggccgttcggatgtacatacgtacgggagattaaagtttgggtttctttctctttttgttttgttgtttgattccttcgatttttgttggcgactacgagcgctgatatgtgtacaggaggatttgaatcgtttcttcttttggtttttttaagcagagatttccttttctattacaagttatcttggctctgaagaacgttgtttttttgttttagtgctagtatatgcttctgagaagaatgttgtttattggggtagcaaaatctcaagccattgccttgttctttgaaaatactaagttatccatgtgttatattgccagcacctggaccaatagattcggtagattcatatttaaaagagttttagtatctaacatatgttcacatgcttcagctgtcagaatcacacaacctactgcaactgaaactacagagtacagactacagtttgtatacagatttaaactacaggttgtatacagatttaaagaaggctttaaagaatcacagcatacggttagatgacaaacaaaccattagcacatgattaattaaatataattattaaaaaatatatgtttctttgattttaaaataaattttatataatatattaaaaaatacagtttaatggtttaaaaaacataatgtaaacgaaaaggttgcaaaacccagactctaacgaactcggctcatgtcatcccagctctaaagtaggcaaaagaagcccaacccacagctcactagcccagaagcaatcagaatagaagggtcactcaacattatttatgtttggaaaaagtatactttggctccctcaactatcgcccgagtacgactcatgtcctccaaccacaaaaccgggtatatcgattcctccaactattaaaactggtgcagacaatatccctcggtggttttcgaggtggtcctacatggcggtcttgaccaagtctttgtcctacgtggctcttacttggcattagaataaaaacaaaaaaaaaatgtgggacccatatatcattcacacaaaaaaaaaaatgtgggacccacatgtcatcctccctctccttccctacttcctccccctctctcccttctctctctccccctgtcctttctcttggccggagcggctgcggggatggcagtggcgagcggcggcggcggcggtcgggacgatggcggtgggagcggcggcggcggtgatgggaatgaggatggcggcaaccaaggagtg

SEQ ID NO: 51356 - DNA, 2029 bp, Oryza sativa
  unsure (1)..(2029): unsure at all n locations
gtcccccaatacttttttttgtgtgaatgatatatggggtcccacattttttttatttttgtttttattctaattccacgtaagcgccacataggacaaagacttggtcaagaccgccacataggcgccacgtaagccaaaaccacctccaaaaccacctagggatattgtctgcaccggttttgataattggaggagtcgatatacccggttttgtagttggaggacatgaatcatactcgggcgatagttgagggagtcaaattatactttttcctttatgttttgaaatgacaaaaagtttaatttggctcccgatcgagtttgaatagcatcccacaaccgctaaaccacaaacgaggtcccaagatggtttggatggcggtttcggttaacgtggttggattgacttgatcctcatcccacttaatctaatacatgatcgagtggatgattaagcaatttaaaagatggcacatatctagccttaaacttaatcgatatcatgaggcaaatggtttcgtacacaaatacactaaggtttgtgatccctaactcgcatggttcctagtctacgtagaaaatttttatttcatgctatcgtagcctacccgtatcccttcatcaccctctctccctctctatcccctttggacggtggcggatgtcgaggttgagcatcgtcaccatcttcctccaacatgacccctcccttttccttggccatgcacggtagtggtggtggccggtggggggcggaggggtctaaaggccagcgagacggtgcctcttccccttctcccctacctccccggatgcggccatcggcgcctccttcccctcccttcggcgctagatgtcgagctcgtgtttcgtcaccgtcttcctctagcgcaacccctccctctcccttggctgcgcacggttgtggtggttgcctgcggtggcggagggtgtagaggccagtggcatggaggcaaagctaatggatgtcccggttttaccgttgtgggacccgattcaatcaacctcaatcattagataagagaactaaagtgaactttttcttttaaaatcgctatcaaacggatggcccccgggccctgaacataaaagaaaaatgtcaatcccatttattctaagccagaatcttaactatgacaagtttggttttaaaatggaacatgttgcttgatgatggtcctctagaatattcacggtaaagaagtgctcgacctgtcctcgacagcagttaaaaggaacgcaaaatataaattcaaataaacaaaacagaaaaataaataacaaaaccacgtgcacctttattggggtgcggcttcctcctagttagaatgaatattcaactcaggcggggtgaacgaaacaattgctcaaggattaaagacatcggcaaacattgatatacatatgccgttgttgatgccaatgatgacagcagtgcctcaaatattttatggacgtattcagcttggtgggcaaccacatcagtatgaagaactacatcaatattggccagagaacctcatcagtatacgcatggtgaagggtatcattgtatgcaaggaacaatgtcgcatcactataacatggacaatgtaaggaataatgagtgggccgatagagatgatgagagaacagtttgggatcgatcaaacctatatgtatcaatgcccatatcctaagtagtttgatagggttccagatttctctaaatttttaggacaagacaatataccaacaattgagcatttcagtcgatttttagcttagtgcggagaagcatcagctggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51357 - DNA, 15437 bp, Oryza sativa
ttgaaacaataagatgcagggtaaagttttaagatgccatctgcgtacaagaaaaatgacaaacacttggtgtgcatagaaaaacttagtgcttaacaatttgctacctgccgtcatatgcacttgactgccttagggtcttgaccgtcttgatcaccaagcacagatccaccaacaccaagtgaaaatgtgatggtgaggtcgctgttgctgatgtgtggcacgcacaagggacatgtaacggggacgcacggaggatgctagccacaccgcgcgagtcggaactggacctggattcctagggataggccaccggggcggctagggcacgtctgcaccggcgtggaggcgaccggtggccagcgctgcaggggctcgggcctgttttggtggctctcgtcaacgacggagtgctggggaacgagactagattggatgaagattggaagggagcgcacaggcctacacgtaggagatgagcgtgtttctcaatcggtatcacaactgcttctggataaggagaagtgaacccaggaaattgagaaagaaacatgcaaaaagatgtttctagactcaattgatgagcccaggaacttctttttttttcatgtttttcaggaacgatataaatagattagatgcaattcttttctttttaggaatgagagaaacagataagatgcaattcttttttttaggaacgagagaaataaatgattgccatttttttaggaacgagagattttcttttgtaggaacgagtgaaatagatgattatttttgtaggaatgggagataggtgagatgcaatatattagctaactcttctgaatgctagaacacgtgtacacattttaagtgctagaacacgtgtacactattttatctgtgccattgcaaatgtgtctttttagataaatactactccctccgtcccaaaatataaacatttttagcctaatgtaaagtcaaccatttttaactttgactattaatagaaaaaaataaaaatataatcatgtaaaattgaggttactagatttatcattaatcaaactatcttaatatgtaacttttttatttaaaatattttatttttataaatataatgtgaaaatagcatgcatctcgaagactttgtcggagtacaaaaatacttatattttaggacatgagcattaaaattcgtctatttgtaagggatgttgtgcgtgaagctccacaaggagatctatgctgctgccctccccggcggctgcgacggcaacaccaacagctgagagcccgagaacaacgcatcaccattagtctttgtctttagaaagccagccgccggcaacaccaacagtagagagcccgagagcgacgcgtcgctgttagttctatctttagaaagccgcactcgacacgttaacactacaaattctcctagcatcggaccctataaatcaagtttgaccaataataaacgttggaccgtacctactaattagaggctcggtgttattaagaaatgtgataaactaaaagcatatttgtccgtacaatgcatggctccccttagttttgtattatatgatatgaaaaaaaacaatcgggtaaaaagaataggaaaaaaaagaaccattagtttcatattatatgatatagatacccttttaaaataatattattctgctgaataaaaatgaagggagagctagcagagggacacagtcattaggggatcacgttaatcacataaggaatttccttaatttttatcagtaaggtacaaaattactaatgtagtaattaaccaattttgtaaaaaaattgagatgtatctttttttttcaataaggaaattccttgagttttttcatgcgtagtttgcctccaaatacttcccgccaaactcaattttccctccaagtagtaccgcaacattagagtaacaaacctgctaatctctctccacatctctctcaacgaataagctccctatataatccccattcaacctggaatcagttagtcagtcttctgctccccactatctctcaccagagcactcctccatcgcctcctccaagatcgcattctcaactgctcagccgcgcagggcctccggccatggctctccccctcatctggccatctctctagactctctcccctatttcttgagttgtggaatctgcagactcgaagatccaaaccaccccatccttttcgcctgcgcttggtgagggcaggtcacaggaatcgacatttcaaccaaaggattcctctctacagtttgtgtaccttctctctaaaattcctgatgcttatttctgagagttagatcaactagggttaaataaaactggatggcttgctctctgttagagctatatacaccatgtgttcgatgaaaagcaccggtaccaccatctaaattccatgtttatttctgtacaagaaacaaaattagttcccactgatgattattgaagttctgatcaaacatgcagttatttgataaaccgtggtagcatctgctagacaatctgaacaggttaatgacatatgttcagtgacattgactacattattgtgaaatgaattaattggatttatgttgccagatctatgtaattagttgtgtgcaaaatattcctgtttagatatcttgataatgctaagtaccgaatcaaaatgtatgctccgactaataatcaaagtttatgcaaagtacagaagcaggggaagattcttgtgtgaaatagtcaattttaggttactgcattcattctcacttttatctccacctctaccatgtggaactgaaaatttgttatgctcgtatctctggctgtacttccaaacccaaacaagcaggtcatatgtgtgttcttgtctataatgaatatagtgcccctgtcttaactgaaagtttagtagtacttaccgcatttaagctcaattatatgcatccagttatatcatattaagccatttataatttatagttatctctttgaacaattcataagttttcaatagatgtagttttccaatttctgcaaagcatacgattttcatgtagaggcggtcaacctgtagcttttctcttgtagctgccatattacactctgctttagctttaacatttaagagcaattgatgatttatttgctttccagtactgtgggaatggaaggtgctgagaaaaaggaatatttatttgtttggttcttttctggattcttctctagctgaaagtgctacatccattatatttttgtcatgcatatactacacttataactgtatagtcttctaatcttttactccttgtgcagagatagttgtagttggtacaatattcccgtatagtcaagcatacatacacatagattaattcgtgctcttgaaatacagtaagccaattttgcaggcaaaatggctggaaagaaaaggttgaacatagtacatagcagctgtcaccatggaaatggagagggaagtagcagcggacaatcattgccacaagtcgagcctcctctaccatatgaagacgaggtgattcatgttgagcagcaagatgatgagcccctcaacatgcctggtaaaactttaactacctgaatcccaaatagtttgtgattgcatatatatggttaacctaaagttagtgagccttatgtcaattaattttgtagtacaagatgaagaggtgaagaagcgcaaggggacaaccttgcgatatgtttgggatcttccacctgggaaacgtatagttgtaaaatgcaacagattagggcaacctatcggggatgaaggtggattgctaggacagtttttgggcacattagcaagaaatggagcttactgtccattagataagatgacctggagaaagatcaaagcagatgaaggagatttaacaatactacaatttgtccaggtacctcaaacgctaaaatagcataagtataatgctctgtttgtattactagtcattacttttttcctactctcagattgatgcatctgttcatatccatggcaactgaatgttttcgattcaatgtttatatgtattttacagatattcaatgctgagttttcttacttgctgttatcccttgcctaaccattgacgtaatcatgcaaattcaaatacttctactctcattattcctatgtatttcagacaaatttcctgtaccctccatcatgcgttcaatggatactgaaatcaattggaagagattggaggcgatacaaggctgcactaaaagataaatattttaacccaaagaagaagcgttctgctctgtataagctttgtccagacgatgtagaaaaagaccaatggattccacttatcaaatattggaagtcaaaaaaaggaaaggtaaaaaatctgctccacaatctgtactattgtctcattgacatatattgtactgttgttcctaccgtaaacaacattggaagtgtgaactcaatgagactacattgcttctgtaataggccctcagtgcaaagaacaaaagaagtcgttcaatgttacagaaccctcactcagcagggacaaagagttatgctcgttggtctgaggacttggtgagccaatttgttttgttcaaaattcatctatacatgttcactttactttcttacattacctttcattttcagagacaagatgatccaaataagaagcagccacatagagcaatggtttacttagcaactcacaaaaaaaaggataaagataaaaatcaacacgtggtatgccatatacacataatccttccataaatatctaatatgtatgttatctaccttgtacagtgggcatatattttttcacttgcaggtcacattggagaacctcatcgatgaacaaccagagttggcacaaaatgaccaaggaagagttgcatgggaaggtgatgcgctaaataaagtattgggcaaagaaaaacctggccaagtgcacggaatgggattacttcctgttcctaagcaggtttatggtcgtacatcacatcatctcaagaacataaacatcactacagtgaatgactcatcatcgaatgaagagacacatgttagaggggaagtgggggaattaaaaaaattagtcaaaacactgggtcagcgtattgaggagttggaaaacaaaggaacaagcaatgggaatagtgaaccaactatggtaaacgttataaatacctttgtccttaacattgaatttttagctacttctgatttcatttttgtagatgcttgtaaaataaaaaatttatgtgattcacactaaaatcttaccccttcctgatttcattgttgtaggcaacatctcagagaacttttgatgatggtattgaagagggagtagtacggactaatagaaaggtaatgtcaaagtaatgcattctatgtttctcaccatattttgtgcaacaatatttaaatatgtgcacatacagagggttcgatgcagtagacctgatcaagacgactcaatgagtaatcaaagaaatatatcaatggtattttgtcgtttctaattgataaattttatttgaacactcaatacacatactggcatctatagtaaatttttattgtccattccactatagaacaaaagaagatgtgaggaacagcaaaatatgcaccatgacaatattctggatctttgtggcaaaaaggttaggatttgttgttttcattcatatggtgcaatgcaatttatatatggttttacatggattatatatcatggaaccagcaccaggaggctgataacaacataggatcaccatgtcaagatgattcatcatcacagccacaccttgctcatgatcttcggtgggaggtagttcttgaatgcctattaaaattgtacttgtttctcaatgtgttttatccatctcactacgatattagagtgaaatataaacacgttgttgggagaactcctagttaggcaatgctacatctgtgaatgcatcatttgtgtgaaacataaacaaaatctttccaaggagtactgctatatttttatagacattaatcaactgaaaattaagtagtagcttctagtgctcaagtttagctttggacccttcatctatgccatttagtgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgatgtagacccccgattttggcaatcggaaatcttctgtgtttatccgtaccaatccctggatcagtagttggtacacacatacatagttggatcacaacatatcacgaatgaatttaggctaaaggagttaaatacttacattagggccaggtaggccaacaactatcagagaacaacagcggaagacaaaataacataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaataacaatgcatatgatagagggtatttcaaggaatggcttcaggtccttttgcataaagctaattttacaattcttttcacaagcctaaaacctagcatagactgatcaaattttagtaccagtgttcactttaaacaacgacggttctgtccaccatccattgtgatctcaaggatagcttcccgccattgaatcgtcatggttttctgaggatgtccaccttccctcctctcgggatgtggctccatcagcataaaattcatcatgcaatatcccattccccacaagttaagaatttagagtctagccaagtgtaatacatgtcccggtgctcaataaccgcgagcgcggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcatgggtacaaggattttaagggtaaacaataatcaaggcatggcataatcacaagtaggatgttcatcattgcatgcaattttatttgtaaacaaaacaatttcgcaattaggatcaacatgttcaaggaatagtgatgacttgccttgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaaccacgctaggggctaaggtttcttaatctttctattgtcaacgtggcctatttaggagttaaccatcatagcatttatgggatacatatatatttggctaatcggtggtttagtctatcaaatggcttatggaaggattatggctaagcatgcatccatctaaataggacagtcatatactagaggttatgttgttagatggatttaggatcaatcaaataattacagtgaatcatttgtattatttattttattgatggaagctttaccttgattatgaacatattttacttgtcacaataaattataaaaggttaataattatccatgctctatatgttaaattcgggaagtttataatattatagttacatattatctcttaatgaacaatccggagttacaattgaactatgaacatatgaggtcaagatttataattagtacttatctactattcatgtttgttatatactcccagtttaatatatgaaaaagataaattaattgtgtaactataatgggatgtacaatatatgtgtgcaacaacgtataaggttttggtcgcctactctacatgagcttatttagaaagtgtactacccaatgctccaagtgattcctgaatatattgtagtttaattatacattagctagtttctatgagtgatattgtatatgtgatgcgataagtttaagcactggttctattgggttactaataagtggtaatcaatttaggcatatataagctattctatatggtattgcgtcgattaatttacttagtgattcctccacatctagctctattattattctcctaagcaggttaaagattcatctatgtgtgtttatattttagttgcataatcataaggctacacttgatttaaataacctataagccatggccatcgaatattaaataagtactagtattttcctatacatccattcatttgagacatcacataaaattagtttgtgtggttgttacagtggcaagacatgttagagacaaatattattacatccactctactgtacaatactaattttatttattagcatatttttaagttgactattatgcatcatcttgatattaattatttaatatttataactatattttatcaaatagtgaattatatatcattggaaagcttatgaatttagatgaatttaggttcaagtttcactcaaattggagctaaatatcgaacgaaatcctagaaatattatatgatttaatttagtctatgactaaatgattaaatataatacacggctaaaatccctagtaactaaatccgaatttctaccgtgaatcgattacttatagggattacccaaaaataatctataataatctataagaattcatctatttgtctagttattaatcacatctaaattactaccgcgaattgatttctcatagaaattaccaagaataatccataatttatattaaattttgcaattctacgactataattaatctataattaaattctaattattttaaattttctaaacttccccaaactccctctaatttcctatttatttccttttcctttttctccctttcctttttcttttcttttctctttttcccttttctttttctctttttctctcttttccttttcttttctttctctttccccttttctttttctctttttctctcttttccttttcttttctttctctcctaaatttctttttccctttattctctcttttccttttcttttctttctctcctctctttccctctctttctttttccttctctctctccctcccggtttctctcctccttccttcttctttctctccctcggcttctcccttcctccccctctctcggctctctctctacccggcggcatggcgacaaacaggggggaaaggcagcggctcaccgatggcggcggcggcgacgacggcgcacggcgcggcacagcgcggcggcttcgtggcggcggcgtggcggctcgaaggtggcggcgcggcggcacgacgacggcgacgcgtggagaaggggagggaaaagggagaggaggaggggatggagtggggagaggggaggatggtgggcttttataggggaaagagaggataagggggagagggaagagaagggaagggcggtggagggggggtgaggcgacggcggcgatgtgacggcgcgcggcgcgcgggtggagatgacgacggcgcggcgcggctcggggcgcaaggcggcgcggcacgtggcagcggcgcggggcgcgaggcagcgggcgcgcggcgcgaggcgacgggacggcgcgcggcgcggcagcggcacggctcgaggcggcgatggaacgcgcacgcggcagcaggtggtgacagcggcgacgcgacggcgcggcgcggagctcggcgcggcacggcacggggttcggcgcgacggcgacggcgaggcgatgacgacgcggtgcggggcgcgaggcggcggagtgacggacgagcggcgcgtgggcgcggggcgcgaggcgacgatgagacggacgagcggtgacgggacggccgacggcgacggcgcggcagcggcgacgcgacgcgagcggcgtggcgcggggcgcgaggcagccaggcgcgcgcggctgaggaggctgaggagggggaaatagagccagggaccacatcgagcacctagagtgcaatgaacagtgccattttctatttaacccgattttagtttatcccttgtataaatttcattctataaatcctaatttttacataaataaggtttgcccaatatatgttttaatttagatgaaagtttaccaaattttaatattacccatattttattcttatatatatatttctattgtattatttaaatgaggtctaattctaaaattagcctagataattttggaggctttgagggttctaaaatatcctagtgtggcccttattattacaatagcacattgaatgaacttatagcaatatattttacacggataggttgaatctatttattctataaatagtatattaagactcggtacaacattaatctaattttaaacactcacatattcttgtttatatataaggattaatttatttatatgaccattattttatatgagtgattttcatgtcatgagtaactcggcgacatgttgcaagtatcaatctatatattccggtgaattacttatttataaacacgatcactatagtggtgatcatcatttcatgtgttcttatatttcatgggagattcgattcaaatgaattagatttaatcttactatttctttagctaattgtgacatcaagctatcaatcatggttcgaatatttaatacctaatttgtaatttgtaatagaaattaatatttgacttaactatcttgtgcataattatttgtaggattaaatatattctcgtaaatcatatctattgcttaaatgtagttcttttctttaccttcttggtgatcatttatggtttggcaagcaataggaatcataacaaccagcatgatgcaaaagttttaaaaagttcgaaattttagtgatttttattgttgggaatttttaggatgttacacatctaccccccttaaagaaatctcgtccccgagatttagtgggactacggagacattaaactattttggcttaaatattgttcgacaaacaaacatgcaaatcaaaagtaggaaatcccgggtcttcgtggcttctggatgtcatgagtcgatgggcgaagcgaagcgacactctttgtacttccgccgtcttggtcagcaacggacttagttgacaatcttggggcacatgatccgtcttttcgcagaggaagcacgtgatcttcgttgttgggcattctccgtttggatggtcttcgtcacagtaggggcattgagtaatgcaattactaccgtagtgtcctatctctccgcaacgactacatgccttaatcttcgaaacttctttggatgggtctggaactctatccttttccgggccgatctgtgagggcagtgtttcttgttcttcattggtgtcttgagtacaacctatcgcataatgtccaaattgtccacaagaaaaacaacagccatctctctttcgttgccatagttgtagttcttcaacatcttcaggcaaatcaccgatttctattcccattttactgaggttaagttcagcatatgttattcgtgatgacgcttttcttttccgttttcccttccaccaatgtggtgtagttccttgtctacgaaattgctgatacataggttttggatagagtgaatgtggcatcggttttggtggtattcctgccctcattttcctttttgggtgtcgaggtatattccttacttgtccatttcctagctttttcttagggcaatccaaggcacaatgtccttcctcgccacatctataacacgtgacatttatccttcgttttgctggagtcaggtggcacctttcattcgaagaatattgctttaggtgattcagattgatggtgtagtcttcaggctttagtgaggcttggactcgtcctttgttcctggaagcttggggaggatcttcaaagagtagcatgggctggtttattcccatattttggggtcttgtagattggaggaattcttgtttttcgatgtcgattggtccatgtcttcacgtcctgtggtaggtttctcttgttagaagttagtaggttgaaagttagtaaactactatactagtcatcaatagtagcatgacaatgctgaattgttgtttttcttcttcatttgttcaatccttcgttccttaatatttattatgaatcttgccgacgagagttaaggtcacaccctttgcagttttactatccaatgatacttcaaattccctgtacaagggcaaatataccttgatatatagtattccttgtccatattttcccacaagttattatttcctcgaggtttctccatcataggctaccccccttaaaataagaaattttgaaagcaatttaaaaggagatatgcttttgcgttcacaaagaagatttttttttttcaaaatgattttgcagaaatatcctttggaagtgatgtttgcaaaacatttaaaatattcaagagatgcagtttctcaccaaatataatttgaaaatagatttttcaagcaagattttgtataatcatacatatgtttaacaaaaagcaacatggcaactaaaaacttttgtaatcaaatttttttttttaaacaacatttgattttatttcgcaaaagagcactcttgccaatagggccaaaataccatatagattgtatgcatggttcaaagttgaaacaacaataattttgaacacctcaaaggaaaactcatgaaagaaatttatttttttactattattattattattattattattattattattattattattattattattattattatttttaaacaaagctttaggcaaataattattggaattcagcttggaaaaccttttgaaaggaggctttcgaagacatgcactgaaaaattggttttgaatgaagttttattttggaaaactttgcaatacattatttggaatcaaaatttcacaaataattttcagagaaaattttcttttcaagctaatttcgaccattcccaaaatttaatataagttcagtgcggctctggggacaattttgcaattacatagtttgaaacaaacattttcttcctttttgaagtaatttttttttgtaaggctatatttcaaaatgcaaaaattaatttgcttcgcaatattttctaaagacattttataaaataaagttcagaggatttaagccatatgagttcgacttgtccttggaattttgaagcaaccctcaagctaatatccaataaattcaaatctctttcatcattcgtccatgtactcttatccaaataagggttccttttattgaatttccatatctacgtagcatcttatgttccttcttgatccataatctttagatccttgtatgtttagtattcttgctgggctttctcataaatacgtagtctgtttcttttctctttattgttctttatgaacttccatgtcgcaggtcgagcttctatggtcactaacggcttagtcgagacttcacttctactatacgagtgtgtgactagagcaaactagtactaacaatcatgagttatcatgattgatgagttaatttcgttcttttcttttgtttttctttactttgtttttcatataatcatgatgcaatcgtctactttcgaggatgaggtttcggcacaatcaataatatccctatagcgtcttaattgctttcggttcttattctaaaattttgaaatgtggatgagaatgtagaaccaatatttttcaatcacaaatcaagtgataaaatcgccttgtcaaaggaagggttgagatgtaaggtatcaaaaatatttttttctttttggcgtatcggaatcagatatttttgaagagaggtaagatgagaaacaatatttgaatgttttcataacctcttttttttagcattttaaaaatatatttgtaaaatataaggtcctgcaactaacggccattctatctagggtctcgacctacagtcgataggctctgataccaaccctgtagacccccgattttggcaatcggaaatcttctgtgtttatccgtaccaatccctggatcagtagttggtacacacatacatagttggatcacaacatatcacgaatgaatttaggctaaaggagttaaatacttacattagggccaggtaggccaacaactatcagagaacaacagcggaagacaaaataacataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccataataacaatgcatatgatagagggtatttcaaggaatggcttcaggtccttttgcataaagctaattttacaattcttttcacaagcctaaaacctagcatagactgatcaaattttagtaccagtgttcactttaaacaatgacggttctgtccaccatccattgtgatctcaaggatagcttcccgccattgaatcgtcatggttttctgaggatgtccaccttccctcct

SEQ ID NO: 51358 - DNA, 9269 bp, Oryza sativa
gagtaactcggcgacatgttgcaagtatcaatctatatattccggtgaattacttatttataaacacgatcactatagtggtgatcatcatttcatgtgttcttatatttcatgggagattcgattcaaatgaattagatttaatcttactatttctttagctaattgtgacatcaagctatcaatcatggttcgaatatttaatacctaatttgtaatttgtaatagaaattaatatttgacttaactatcttgtgcataattatttgtaggattaaatatattctcgtaaatcatatctattgcttaaatgtagttcttttctttaccttcttggtgatcatttatggtttggcaagcaataggaatcataacaaccagcatgatgcaaaagttttaaaaagttcgaaattttagtgatttttattgttgggaatttttaggatgttacaggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagtccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtgacgtcgggcatggccatcccaacagacccttcaggtacttaccactgcaggccgattccagcaggatactcgaaggtcgaagttgagttggtcgaaggcgcgtacgaggacctcgagctggattaccctggaggagacggtgagacgcatctacgagacacatgacatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaagatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccaaaaaagaagattcctatagaccccactgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtaaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcaacattacaagacgttcatactgttgccatacaacacagagttagtttaattttactgtcttcctacataccaaatttcattcccgtacgaacttgctaagtgtttcatatgtaatgcatcccacgcacattgcagattccactaggtgcttttattcatcgacctggaggcctgcaccgtcaacgtatatgactcaatggataaaaaagagtctacatttgacaaggttttcgaacttatagacaggtaccgtcataagttcctttgttaattaagaaaatcttgttatgttaattgctactatgaattatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtaagtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatatctatatacatatgcatttgcataacatatatatgtataaatacatatatattatgcatgtatatacatataatataatataatatatatatatatatacatatatatatgtatgcatatatatgtattgaaacatatacatgcatggtttatatatatatatatatatatatataaaccatgcagcaacagggccatgcaaaaaaaaaaaaaggtcagctcgatctttagtcccggttggtgttaccaaccgggactaaagatcgatctttactcccggttatttcaccgctatctttagtcccggattggtactcccggtttggaaaccgggactaaagggaggttacgaaccgggactacaaagggtttctccaccagtgctaatagaatgatcaacaagctgcaaactagagtgagccattggaagcaaacatgagctcgacaccaccaagtaacgagcttctggtaggctcgagcttggctctgtcaaagctggattatagcacaatcgcagcagaaagaatgaaaaggttgtatttctcactaacagtgctgacaagaagctgttcaagctttgaaaaataaagcttgcaaagtggcgagtttgcactgggaagctcgcatttgtcaacctttttacaaggccatcctgctagcgtgcgagagctggttcaagtgccatcaatccataagttctttatatataaattgtcgtgtattatgtaattttgatgtctaaagaaaagatcgtagacgtttatgaaattaccattttttatttcgtaaggacacacaattgctttggcccaacttatatgaacactattcacctgttacacatagtgacgaaaacggatctgaaacaaacggaaactagctagtgtgcgtagtgtctggcacttcttttgtatttacgatggtctcccaccactcatgtaccgtcgaggttggttgccagtaaacagggcttaggtggtcgcaggccgtctaatgtgcgatttcattctagattctctttgtgtatctgtattctgccagtaggtatagagccgtctcttgcaccagtcaaaaattgggcgcttaattttctagacatgaacacagtagaaatagaaggcattggaacaatccctacaatctaatagaatcgatgaagagctgtgaactctttcaaggccgcaatggccccaaatacgagctcttcatcagctaattaagccagggccacgatccgatccagcctgcagccatgggcagatccggattctggtccgttgcccaaatctcacacacttgtttcttcaatttctgtttgatctgccgcaaaaggcgaaatggctaatgaacgactctattattttttttccttttagcaaataactaaaacgacttgattaatcacgggctcaacctagttcttcctgatttttcacacacttgttctcttttgtttgtatgtattccacggaaggcccatcgagcaggcatgctatgtggtctgccccaagcccatttggacgttttattttatttttgttttaatattcatttgcataaaattttgatatcttaatatttctatggaaatttctatctacaaagtttatatgtataaactttgaatatataaagtttctttggtgttatacactatgtataatgtcaaaacaaatgaatttttaatggacggaaaaataaaagtgggttatgcagacaattttttttctaagccacaaagtatggctaatcaggggaaaagagagacgtgggttgagaaaatgcttgagaaatataaatggactaatacttgggccatccagttcacaatttttttttctctgtttgtacttcttacaccatttctctctgtttttctttgctcaaagtacacctatattactacaaaatatgcaaaaaaaaaaaatgcagccattatgttaccaagagattattttgtagtaaactgacgaccaaaaaaggaccaagtttgaagtggcagagcttcagttcccctacctagcatgccactgttactttatatatgctaataaactgacgactaaaggtgagcatatataaactgatctccattgaagagaatggcattgtgatgttattgcaaggcaagcgtagaacccgttagaatttcatgctctttgaacaaatatatatacggaaactatagaatggaatgcattgggacaagcgatactacgaagtgtacaagaattggtagagcagtgtatttgtcatccattgagctagagtgtcatgataatttagtgtcatttgactaaatagaagaggggaaagccatcaatcattgaagaaataggagaatttttataagtcggtcaccgaaatgaggagtagctggctgcgtcggtggtgcataggtggcggcgtcctccagttgtgaacttgtgaaggcgacggcgatggcccaggtggatcgagcggcaccggcagcccttgtggatccagtgggcaacgacgacaataacgacgtcgatggcgatgggctgggtggattgagcagcaactacggctcttgtggaaccagcaggcaacgacacgatgacctcagcgatgacaaccccggcggcgatgatgacaacctcgacggcaatggtccgagtggatctagtgggctagggttttgggtgatggtgcaaatcgggtggcggcggatccttctagggtttctgggctagggttggatttttggaatttttttttgcgatatttttgtcgcaatcggttggtttaaacgccctaaatttcacatactattacggctctacccacttgtaaaaatctgcgaaaatcgattttagctgcatggaaaaatggattatatagtggtgtgattagacacccgatgagccccaacagggccagccagaacattctaattacattgagcatttactgcgagaacaagtacgttactaggaagattatatttttaatttctatagaaacatcgatatcctacagcatgtttgccaatggtcgagcttgggggccgcaggaatagggatggatgccctcagccctcattcaaaattaaaattcgtaaaattatttattgttgatagtataattattctactctaaaatatgatgagtcgataataatttcagatttttcatctttgcttcaaacttttcttatcatgccagcttgattaactagctgttggtccgtaggagtcctgtctgattcaatgttctttctttaggattaacctttttggcacagttaggttcttctacttgtcctttcagaaagtacaaccacaactcgttactagttatctaccatgtgcaaaaaaacatatccaaattaaagtgatataattctttttgcactatgcatcaagtgctttcgcttataaatgttgcatatatcatgttacatgtgaagtgatgcatgctccttctgttagctgcttgtagggtaggctcaagcctaccagaagctgcttgtagggtaggctctcgttacttggtggtgtcgagctcgtgtttgcctccgagggctcactctagtttgtagcttgttgatcattctattagctagtatacacctttagggcttattcggaatataggataggaaaaacgaaggaataggaaaaatataggaatatggtaggattgtatgcgtaaaacagaggattggaaaacataggaatttcttattctccgttcgcaggattcttacagcaaagaggctagagtggattctttttttcctgtgaaaacatgggtagggaatagtattcctatggaattcaagatagctaaccctttcaaacgaatgcatctaccgtacccagttcaaaggaatcatcaatcctccatttttcctttacatttcctccattccgaatgagcccttagacttggaaggcactgggaatacgactagcactattgagtacaggtaagggggctttcaaagcccatctccttctgcccgccatcctcaccctcgcccttgggccggttcatcaagttagctgggaggtacatacgccatattcactgatgcagcatattttattacaattattactgttgtttgattcaaaactgtttttccttgcgattcaactatctcgcgcaacaatatttaatttctctttgttttttttttccattttcagttaagacgaggaagagcagagattatggtatccagtgatctccgtgactccgtgtgctttgttaaaattaatggagaccatcagcggatgatgagcgtatactactacgtgccgatgtcattttagtgctactactacgtaccttactacaattccggccagtaaagatgcattttggtgctactacctaccgatgaatgaaaccattcaaagatgtagtggtgctcttgagacgtacatcggcacaaaactaaaaggaaggtgtcggaaaaaacgaaaagtaaattatatgtgaaaaacactttaagctggctgtacgatctcgcatagagtttttgagagcccgtgttctgtatgccatgggaatagaagaaaggaaggacttggtagaaaactattattaactagataaatacatcgtcgtgtgttgctacaagaaattaagttgtataatatgtataaataatgtgcaatatattttataaaaccaaaaacaatatggattcctatgttttacgtaatttgtacatggttgtaaatatagttgttaacgccaaaatttgataatcccgaagttatcatcggcaaagcaaacatattttatttgaccaatacttgtgaattttgagcctaaaaaactattcaaattgcacagttttatgagagaagaaagagataatttgtgccatatatatatctctattatccgaagggtaaaaataattgtggtgatgtgacttcatgagaaaagatcgagaaataatattttctacacttagtgaggattgtatatataggttgtttgctaattaagaatgaactttagttagatctggttcatgtcactccctacatagtaatatttcagtctgccaatgaacacaatgctgcatattggtctaccgtgagttcacttgtcggtgttaattttttattttccaagtattgaacacagcaccgtcaccaagtatacttatgacttgttcggcatagctccaactctgtttttttttcctgaactacctagcttcaatttttcttttgcagatagagttgctgctgcatatatatatatatataacagttatcagggtgatattttacaccaaagtaaaaatgattaagccacattaatttaatgtataaactctattttctagaagaatttaagagttagaaccatattaaacagacctaatatgaactaccaatcgggggccatatcaccattcatatcattactctgcccattcatatatgtaaacacggaaatccaatttcaatagttgaagagatttgtaccttgcagttaagagtgatcagcgggctggctatcctttttcgcatcttctcttaatttatcttcctgcatacatactatgcccatttgatactatgtttttttttcaatgtacactgaacacgcagttaataaactggatgatacactactggagaaacgatctttggagggtcgagcgatttctacaatagtctcagttctaataagaaccgggactaaagattgtttttagtccctgttaaaaaaaattgatcttgaccaaccggaactaaagatgatttttattcctggttcatcccctgtcagaagcttgtgagagggccgaggatctttagtcccggttgacactaccaaccgggactaaagattaccactttagtcccggatggtactatcaaccgggagtaaagatcatttagatctttattcctggtttgtactaccaaccgggagtaaagatctatctttagtcccggttggagttaccaatcgagagtaaagatttatctcccatctgtgatcggttaagtactagataagatcagataagtcccctcgatctctcctccc

SEQ ID NO: 51359 - DNA, 1807 bp, Oryza sativa
aatgatgggattaatttaacaaagggtaataataataatgtgtttagtgtgcatgtatgatggtgatctttcatgtagactgtatattccagttggtacaagccatctgtttatctatatttgatccacagatggggttttgttctgtttccagagcactggtaggtgtgtaaatcaagtttcatatagatgaaacacatttattttctgtcttaataattatcatcatgagatgtcatcagtttagcctatgtggcatctcatttaataaggttgaaactcttatgaaacttccactcggaatagccatacaggagtgcactaagacaaagaaaatattaataactctcccataccatatttacctcggtaacaaactcgaagcatgtatcatcccactacttccgagtcactaacaaccaagatattacctgttagttgtaaagtgttgtgtaaatgaatacatgcattagggtgtgttcgctggttctggttcccatccagcacagtgagcacggaaaacggagtgatctattagctattttttttaaaaatagattaatttgattttttttaagcaaccttcatataaaacttttttaaaaaaacgcaccatttagtagttcgaaaagcatgcacgtggaaacgagggagagaggttgggaaaaggggcatccgaacactctcttttttttttagataatggaatataatatcccggcctttcctcaaaaagaactacagccaattattacaaagatccactccagaagagagtgtagtttaagacaagttgaacacaccaaacaagagaagagaggacccaaactgagaaaaacaaaacaaaatgtggagctagaaggcctcgtcaaggcctaggactgaagttcgaagccaatgcatagaccaatgacaatatccttgcacgaagaggtttctccaaagtggtgcccccaaggaggatgcgacgtggatcgccgccaccgctcgttcggaaccgaagcaaggtttttacccagagaatatggtagggaaaggaaaggggtatgctaaaacaacgcctccaaggaggggaacgacgccacacggcgtcgccgttgtcagctagccaaatggctcgacaaggctttcgcccgcgattccctgtccaaacccacaccaccaatccgcacaagaaggatcgtcgtcggtcaacaacattgtcccttcagcgattcggccaaagccaccacccacagttgttgccgccgtcgacggcgcgcccgcacccggactcctccttccccgccgccagacccttccccgcctccacaaaccgatgccgacgacgacgcaccatcagccggatgatggccttcaaccatcgccgccataggtaccatcgtcgacagccgccaccgccactaccacagccaccaacgtcgcagccgccaccgtcagccaccatcgccaccaccacggccacggccacggacacccccgtccagccaccaccgtcagccaccacccgcgctagccagcgcccgcagacgccagccgtccagatccgacctgggtagagcggataggaggtgcagcgcgaaacgcaggtcgccagcatcatggaggaaggtgtcacgggcatggtgttcacagccggagcattgacagctgccaccgtcagccaccattgccaccgccaccgccaccgccaggaaacaccctgtccagccaccaccgtccagccgccactgtcgctatccagtgccgccagacgccagccatccagatccggccggggtggcacggatcggaggtgcagcgcgaa

SEQ ID NO: 51360 - DNA, 16465 bp, Oryza sativa
tgttcatttactcccatacacaggtgataaaacaaacttaaatttaaggcatgaatactaatatgatgattatttaaaaataccatagaaaattacatgatgatcaattgggaatcagagggagcagaaatatatatatggtccctcatggttttcatttgctcatgggttatccgagtggctcggctgctgatgctcccgtcctgcaggtaaacgctgacctgcagagagagttaattaaggagaactcctacctcatttagcaagttgcttgtcgtcactgctgatccatgctgatgctgacttgtactgcttcgaagccataacaaaaaaaaaagttttatactgacttcacttacaattgatcttcacactaccaaaacaaattcatgtttaatgggaggcattttaaatttttttgtcactattacatttagcacttaattatttgccacccatatattgattatatgtggatccttatttatctaggacacgtgagtttggtagaaaatagttaattgtgtactctgccatcccatatttgaaaaaattatggaaaaattttaaatataagtcatgtataaagtgtagtatttatgttctatcatgtaatataaataaaaatactaatcataaaaaatttaaaataaaacaaatagttaagttgaatatgaaaactcacaactgtatttaaaatgagacgaatcgagttaagggtaagatttataatggaggtgatagtcacctccatttttatccatatcatctatccaaaaaaattaaaagtaacttatataaatatattgcatttaatatactagtcctaaatcctaatacatttgccaccaatcaaccctctcattttctattatcacgtgaagtttgtgtagaggttaccatgaggggtggctactcctctctctcctcttctgacacttttcttctcacactaataattgcccttaaaaattaaatatttctacatgcatgcatagagccatggatttaagggcctgtttggtacagctccaatccctaaatttagctccaggagttaagtctagagtggagttttggagctgcctaaacccagctccacaactctagtatattttgtgagagagctccacccaactccactcccagttttggtggagctgaaactgtttggctgagctctagctccaggaggggtggagctggagttggacctgtaacgctccgcttgtcgtgagacgttaaaaactaattcggcaaaaatcctatatgcgaaaatttcgttctttgtgtgcgagtctaagtcgtgccgcggaatctcaattcaaatcctgttgttccctctcgtcgtcatcaaaaatcctccacctcaactttcctcttccaattcaagtctccgaaatcaaattccgaaagtcaatcccttcctttgaatcctctccaaataattgttcccactcccgaaagtatcaactcccctcaaatcttttccttgactccacccaatactcccgagaacaaatatccaagtttccgttttgaatctcttccttgatttctccttgagtcttccttgattccaccctgaaccctcgagttcgaatatcgaatttgaatccaaatccaaacttcaattctcaacaaaccagccttctctgtgaaagtctaaatcgccttcctcaagttttgtgggccgattttgtccccctcggcccatctctctctctcagccatcccctcccttctccgcacgtgcgccgcacacgcgtgtgctgagctgacgccgagccgagttctctctctctctctctcgttctctcgatctctctccccgtttcactccctcccagcgccgattcccgcctctgcctttgaaatcgcgccgccttcgcccttcccgcgcgctcgcgcgcgcgcgccatgccgcccggttgccgccgcgtcagccctgccgcgcctgcgccgcgcagccgcccgaccccgctcgcctttttgcagtcgtcgccgctgtcatcgcccggtcccgatgcccccatgctgcatgcttccaaaacacagagctagagctcgcgctctctccctcctcctttctcccaaaatggcatgggcagagctccctttctctccccatttcttctttttccatgaccggcgccattgtcacctccaccgccgttgcagcagctcgccgcccccaccttgaccgctccacgctgccagcccgcgctcgtggttcgatttccaccgctcgatccaccgccttcgtcgccccttgcatcctcgccgtccgccgctcttcggtcgcctgtgaccaccagccgagctcccttgaccgccaatgtcggttccctctcccaaaccgacttcacgtgcctataaaactgcagccgagcccctcctctcaaccctacccacttcactctccacattgccgcgccactatcgcccctgccctgcagtcgccctctccgtccatcgccgaagcaccagggagaccggtgcgtgcgaaggacacgagaaggggactccgggcacccttctccttccccttccccggcccgaggccggagagctcaccccgcgccgtcggccgcccatcactgcgcccggctcggtagtgcctcctccgttctccctccccgctctctctcgtgcccttagcttttgagctagcacccgtagcactaccgaacgcgcgtggacaccgccccgagccccactgccgccccgcatggcctcgctgccattgccgtccgctcccggaggccgccgctcgtcgccggccctcctcggtgctcctccgtcccatccggcgccggaaacgcattccttgaacgctggaggtgctccccccgccgagaatcgatccctctcccctcccggcgagtttccctcttcctctcaccggcggtgacctccgccgcgattcatcgtcgtcggcccttcctcttctaatctgtcccgttggctcgctcctcctcgctccgctcgtcgctccggtggtcccccttcctttcgccgcgcctcgccgccgttctgccgatgcgcgtcgccgtccgctgtccatctcggcatcccctcttcttcctcctcccgccggcccgcgtggctgccaggaaggcgccacgtcggcgccagctcggccggaccgggtcaagctgaccccggtcagccgctccctccgtctcccgctcgcgcgcgtggtccaccgcgagccgtgaggctgcgcgtgggcccgacgcgtctcggtccatccggcgcaccgctcgtgcaccatccccaccgaaccctagcgccgccctcgcgtgcgcccatcccaccgtgggccgtgtcaccgacaagcgggccccacccgggacccgtgaggtgctcccggtccaccggaccgctccctctctcttccgcgcaccgtaatgggccgccttccccgcgcccgcgccggcccaaatggctcggtcgagcctccttcaaacctcgggccacgcccttgccgcccgagaaagtctaatatacatccctcgtccatttccttttccataaatcaattccttattattccaaaattgcataaatcaattcctttggtcccgcacgtaagtgactgtcaataatattctggagaatattatttctataaattccataaaccatttctcctattccagaaattccatttaagcttccgaaattcatatcttctcaaccgttcgtccgatcgcccccgttcaacctccagtgatttcgtaaaattgagatctatctaatggcactattaattagtctaattaggatctttcttttagtcttttgtttaggtttttgattgtttgcgtatagttgcggttaccggatttttcgtcgatcgtggttttctcgaagattcgtgaagctccctgaagaccttgagcaaggcaagtcaccctttgatcaattgctcctataattggaaaatcattattattttgtttgtaacttgcattattagaatcacacacttaatttgcttggcctcggtttgcgtgccaaaccgacggacctacccagtagtcgaactaattcctgtaggctgtactaccctgactccttgtcgctccacctttgtggtacttcggtatccgtgctctctaagcgcgtataccaaatatcccacatacaccgttgattgtcgaaaaattgagaaatgggtttgagaagacttgaaaacccgacctgaggtgtcggtgtgtttaaaaataaaatgaattgtgaaaactcgcgatgcggcggttgtgcctgtgtggcactgtcccgtattcgcatataaggaccgattcctgtgggaaactcatcgagcataatcaaagtgcaaccacaaggtggaatgggacacactggctaagtaagtagtcggttcagggaaacctcgcatgccaatagttgggaacgccggggcggggtcggttggagccaaaccgggttcctggtaagaaggaagagtagcttgctgaattatcgatcgagtggttggagtttgatttgtgaaaactaaaatggcctatatttatgtgaggatttgatccttctatgtggcatgaggtaaccctgggtcggcttgggaaaggctttgtcgcgaatctctgacactggccagtgtctggagtaagttcgtgtcttgtgggtgaagtgtacccctttgcagaggttaactaactattcgaacagccgtgtccacggttatgggcggatgtgaggtggttcccgttgtgtagatttgttggcctgtgctttgtgaaaatttgttgtggtgtgggaatcgtaaccagaatcagcctatgtggcagatggaggacctgagtggtcagaaacgaatctgtgtgattcgggatgtctgcgggcatcatagactagacttcccgagtggaagcggattgttgtgctggtgggcagctggactctgggagtccgagaaaatgaaaaaggctctgagagccggttaatcaagtgaagtggctctgggagccgagaagtaatgatctgaccccaggaggtcggtacattaccatttgagttgttgaaaagcatctcttaaagttgaatcgagacgcaagtctcttttcgacccaaagttaaaaagaaataaatcacttagtgattccaaaatgctttcaaacaaaagatttgcaacacaatcttgcctctcttccaagcttgcattaaacaactaagttctcttgacttgctgagtacgaaagtactcatccttgctctatataaatatatataattcctgtgcctggaagtgaagatgaagtgaagattagggtttcgtcctgattctcagccgtcgcctgtggtgttaggtgttagtttgttggttccgctgctgctgctgttgttggtgtttcctcgtccgtgtcatcggttgcattcttgggctgttctgagctgcaacctaagttaagataaataagtcatctatttattttaaggattgcaatgattcatatttgtcaccgtgggtaccagcgctatgtcttaggactggtactgagatcacggtttcgtaggaagcggtccgcgccgtgtggaccgcttcctacgacacgctcctgtcagctgccgttgtacggcggtaccggattggggtgtgacaggagctgtgccaaacagaccctaagtgtgagagattttctggagattagttaaatcacttggtccttttttaccgcatgcatgcgcgcgtgtttctggagattagttaaatcatttggattcaatgccatgactaattagcacaagaagagttataaatcccctcacactttttattggtcatgtgtgcggcatgcccggcaaccgaaccggcactgctatcaacgaatcagcaattgcttgatttatctctctcgtggtaaagagtatagtagaaatatagatcacctctcatacctatcaattatatcatccttgcacctaataataactagaacctctttataagagtgaaaacttgacaaccaaaaacctctatagaatttagaatgaagctctcaaattcataataggttatatctttataatttgctgatgagaatttgtttaattccgtaacaaaataaggccctgtttagttacatgggtgaaacgttttgacgtgttacattggatatacggacacacatttgaagtattaaacatagactaataacaaaacaaattacagattacgcctataaactacaagacgaatttattaagcttaattaattcatcataagcaattagttactgtagaaccataatgtcagctcatggaacaattaggcttaaaagatttatctcacattttacacgcaatctgtataattagtttttttctatatttaatacttccatgcatgtgtccaaacattcgatgtgatagtgtgaaaagtttttacgtgagaactaaacaaggcctatatgcattttgctagaaaataaataaaaaaaataataaaaatgttggatttccacgtcagccacgaaaaaatcactcgccccttaaacttcttccttggatgccgttactaatccatcctcatttctctcgcaaatctccatcgtcggcggcggcgcggcggtcgaggtcgacgtcacgagagatggcggcggcggcggctggggtcacgtgccacctctgccgcgaacaccagatggagatggaatgctgccgcgggggcctgctgccgcgcggctccaccaccgcgctccccgacgccgccggcggtgaggcggaggaggaggaggaagaccgcctcagcgccctccccgacgacatcctcctcccgatcctcgcggccctccgctgcgcccgcgccgccgcgcacacctccgtcctcgcgcgccggtggcgcggcctctgggcccgcctccccgtcctcacgttccaccgcgtcgcccccgccccgctccacgccgcgctcgccacggtcgccgccgccggcggcgccgcccccgcgctcctcgacatcgacctcttcagccaccacgacctcgacccggcctcgctgctcgcggccgccgcggcggtggcgccgggagagctcgtcgtgaacgccagctggtccgcgcgaagcaccgagctgccatgcttcgaccgcaccgcctcgatcaagatcgacgtccacttcgccggcttcacgctgccgcccgccggagtcttcccggcgctcgaaaccctccacctcgagaactgcttcgtcgacctcggcgacatgatcccgcgctgcccgcgcctccgcaagctctccatcccgttctggaacgccaccgcggtcaccgtccgctcgccgtcgctcgaggagatggaggtgtatgccaatttcaagatcaccatcgacatcgtcgcgcccgcgctgaagaggctgtatctggatgcacgtcgcgggatcaacacggatgccggcggatttacgctctcggcgccatcggtggaggatctgacatggaactgcgagtgccaggccgtgagcgatagttttggtgtgagatggcgcatgtggagcttgagctttagctcatcatgtcttgacccccatgggattatgcagatgcagcagatggacaacaacggcgaagccgaaaccgcgcattcgctgtcattgtcgtcgtcgtcgcagcgacgccctcgtggtggcgtcctgtctctgaacttagagaccaatgtactatgtctcctctcgtgtagtactcctcaacatcttgaactcgtattgtcatattgattttcaaatcgtgctcaatctgttgtgtaggtcatgacaggtgattcaaccaggagctttgagcaagagatattccggtttcaagttacggacaacttttctgttttggagctggatctgaaggcacaagggcatgtctatggggcaatcgtcctgcacctacttggcatttgtacctctacacaaaggcttagggtgttgctagatgaatttctggtaattatttcttctgttaaatattgtattattgtctagtagatctcaaatttctatgtcaaaatactaggttgattcagtaggaagcatcactgactggccactgtatttcaattttcttttagtcgcaggactcatgctttgtaagttgccgttgcgaccagcccaataactggagaaatcaaagtatctccttgactgatcttaaagaagtagaaatcagaggcttcagaggacaaaaccatgaagttgatttgttgaaggtgctcctgagatgcgcaaccgtgctcgaaagagtgaccgtcagattttccaggaaggttacaccgagtgattgtcgatgcagggaactcagtggcattttagaggcctatccttctgtgaaatgcagtgtttattatctccaatctggcaagcaggttttcatatgcaggcagcaataggatgctagctcttggatgtaacagtggtattcgctttagcacaatattgtccaaactagaagttccaatttatcaggtaaactttgtcatgtttggtttatttttgaatggatattgctagtttgtcaatgagtgatggtgggagttatgtgcctattaccttaaatgatctgtgagtgcatatgctacacctatgttattggtgttagagtaatcaaataggtggtggtgtttccaattctccttccctaattgtgctacgaagcacatgctttagccgtcagatgcacttcgatgtgaaatagttattccacggataaactaaatggttaattcatccgaacttaggcaaggcatgatgcattgtgtgcatgtgtaccttgcagtgatacctgtacatgttttttttccatgtaataattttaaaaaaaccagcattagggatatttgtttcctaaaaaaaatttccaacatgagcaatcacttttcctataacctagttgttgttatgggcatatgaattgagaccagaattccaaaaggccggtgataaaaggccaaaaggctaaccattcaaacgtaaaactttattaatttttcactggaaactagtttttctagagaaagcggtattaatttgaagcctaaacttttactagaaaccagtttgtccagataaatataatttgttgggcaccatatattggttcaaacttttgtcatatatatatataatgaaagaaaattgaataaggaatggctcgtttagttcagctgtatcatttttctgcaactagtatacattcaattccacatgctcagactagatagcctcttattcatgaacttataattacatatatttttttattatatgtgctactagttcctcagtagataaaacgggatcaatgagaagagttcagattacggcaaccgataacttatctgtgagatgcatatataccaatgaaagacttataaggcacgtagcatatatagctacatatatatacaccacacatcggaatgggagtcatcgtgatcggaaggtgaactctgtcatttcgccgaccagtggcgaatctagaataaaaatagaggggtgctatgtataaaacttagataaaattaattaagacagctaaatatacatccatgacgtattttgctaatcaaatcgtaaaattaataaataaatagaaagagggtggcatcatataaaataaaataactctagctcgtcgtttattatttggaaaagtacttgttaaccttgcttctccactttaatgtgcagttatatccactaaattctggcaaacaaaattaatttgataggaatgatgcgcccatacactgaaagatttccaaacctaaattaccaataaagagtctcacgtttacatactagtacaacagatggattaatgtccagtccagctagctagaatatgtcgtagaggccctgacaataaagatataatgaggcagtagacagcaacgtttttattcctgaacctgactgtgaaatgcacaaccgtggagctggggctcgagccccaaaaagccccaacggtggatacgccaatgtcgccaactatctatgattcctgattggttatgtatctacaatcaacatccaggtttttatatataccaatgcgataaaaacctatctggattcactgtaacacacaaccacctcatcctatatgttttgaacaatgcaagcgttggaggcaattggagggctataggaaccagtggaaggacatcagggctagccggcctgtctctcggatatatcggaaggcaaaatgaattattgtcggagtgataatatatgacactaaaacagtactggaaatagatgctgccgcgactgcatgttgatgaagggaagaatgccgatgttgtgtgagcaccacatcaagacttcgaaaaccgtaggattgaattgttcttcaacactgtaacaagcgtcttttcaaggccattctatgacataatgcttaccatgcatggacgccaatttcagttcttttttgctagacataatactaatccctccagtattttaacgtataacttattgatttttcatataacgtttgactattaaccttattttaaaattttagtacaaatatgtaaaagtataacttaagattatacttttttataactagaaaaaatggccatgcgttgcaacaggtgaaggttatttcaatcttattattattatacggtttaattaatgtggaattcactgtgggaattcgattggatatattttttttcataaaatcatgagttgcaattaggagtccgatcatctcaagttagcatacaaggtttgttaaagatatttcttatacagcttattctgtatttccaaaacgaacgaatttaaagtccgactcaaatacgtatatgtttccaaaagcgaacgatcttaaaaactatgacgtaccgaagtactggcaaaaacactttaaatttttataatagtagagataaaacaagtcacagcaaaataaataatatttatattttttaataagacgaaggttaacatcacgtcaaaagttacggcgctataataatttttttacaagagtaaagggcatggacggtccttaaacctatagggttgtgtcatataggtctctaatcactcagaatacagatttaggcccagaacttgcaaagtgtgtgtcatctacgtcacatatcaccacaagcccttttaggatccggcggacgttgggttgggcgggtgccggatgtctactgtgcggcggtaagggagtggggccggcgacgtggggacatttcagcgtggccggaacagggattgagcggaaatggcgtcgtcggcgaggcgtgcggcgctgaacatgtcgcacggcgacgcacacaggggagcaggggagagacgcggagccatggctggcacgacaaggctcggcagctagagggtttgggcgcggctcggcgagaaacagcggcgtcgcggcgggtgccctacagtcttacaggccagggaggactttggcagaatccggcgatggaggccggcgatgatgccctctccggccattagagacggccatatgctagagctataagtttgttcagaatatttggcccagtgagagacatcatgaacacgcactactacagaaaagggattaagtgctggttggaaaacccccttcggtgctggttttcttaaccgacacaagggatgtgtcactgattgaaaataaaaaaagtgccggttagaaccagcactttttaggttcgatgaataaaaaaaagatgcctcgatgcgtcatttcgatcgagccgacgcatcgagccgtgcagttcgtcctcccgcatccacaagaatttttttggcaacattcatcacacaaagaaatttggcaatattcatctctctctccgcccgtgagccacgtcactcttgccgccgcgggctgtcccgactctcctctcgctagatctagcggaggggagggcgtcacggccacctcccctctgggcgccgggccgccgcgggctcccctccagccaccgggcaggcatagtcgcgggctccacttcagctccccaccaccgcctcccctcccgccggatctagcagtggggagggcgcggtcactgctgccgcctccgccggcaacgcgtgggagagaagggagggagggagagagaagagagcgagacgagagagaaggaagggagagaaacagagaagagagcgagatgggagcgagacgatgagagcgagacaacgagcgaaccttatccgatgccgcgtctcgtcatggtggggcccaccggtcggctctttcgatgccggctcggctcgatttatataggcacttataagatattataggtgtcagttttttaattaaccggcacctataatatattaaaagtgtcggttttttaaaaaactgacacaaaagtataataggtgttggtttttatttagaaccgacgcctataattacttaaaggttccggttttttgtgatttcaacctgtgaaggtgggaaaaggtttataggtgccggttttagtggtgccactggtcgtgatgatacgtcgacacctatttgatattttgtagtagtgacggccttacatcatttcagctaatccaacgctgatcgtgcaatgattaagaaataacattgatcgtgcagggcaaaccaaacaaattaaggaacccataccatatattaaaaacatactttgtactttaactagacgcctagacatagagcatcgactgcattttctcccaacaactagcaggcacatgatttgtgagtgcccatattaaatataataactagtttccattgcattcttcttgtaaccacttgcaactatatactgttccagcatacccaaattaaaaagacatgtaagttacgaatttataagggtgtgtacattcgtacaaccatttttatgggttgcttcctctgcagataaaaggagagcagaaagagaaacaaaagatgagaacatggcagccgagaacttctccacgagatctacacatacatgacgggaccagtgcttcagtggtgtatgtgtattgcagcctaaatacatggaattgggaggcattaggaagccgagaagtgcatctcttatttttcaaccttccaaattcaaatgactagcaggctagcagcattttcgatgttctgatgctgcaatggaacgtccccggtttaattgcaaggctgcctcttgctatgtagtctaaacaacggagcaaacacagcacaagggctcggagaatttaactatttgccacttttaggtttggcacatatctaaatgcccctcttatgttcacatttaataatttgccactggagagaggtgattttttaactatttatctctctctagtggcaaattattaagtgcgaatctaagagagacatttggataattgcctaacctaaaagtggcaaatagttaaattcccataggctcctcctagcagatggaagaaaattggttctatcagcacaagccaaaaaaagaagtcacggcgtgtgcatctgcactggttgaagttgcagtaattgcgtgctcgctaaatgctgagacgaagaccctgtttaggataacttgagagtgagattttactggcgataatctagaatctcatgttgcttctcattttattacaattattttcttgaccaattctgtaattatagcaaaagaaaatggaatgaacaaatggttcaatatatttcaggggtgctactcaggccactacaactaatagactacatgccctttcacgggaagtcttccatatagttgtaccatataattagtagataaaataagaccagaacatgtaaacagaactgacaacttgtacgcggaaaatatacatatctatgataggtttagtgcttcacaagctagtttgtaatgtagctgtacgcctacacatataggattgggaggcatcctgaatcaaatatctcaattctagtcggccaaccatcgaaacttcaagaagcatagacattgaatttgcaaagtaatgatgtaatcgaacagctttggtttcatggtaattaacacaacggcctcatccgttgtgttccaaacaagcaagctagcagacatggttaaaaatagatgggagctctacaggtagcctattttccgagctagattgtggtttcttgttctcaatgtcaatggaaacgagcattcagaggttcaagccctttaattggttcaaaaaaagttaacgtgttctaaaatcaatggtagattgacatcctcattagagcaggtaacataagcaaacaaacacacgtattagatctatcataccaatgcttcaagatgccaaccaatgcttcagtaggatttctcgatccgtcataccagggttgtcataccaatgtgtgtgagggaagtattcggatgtgggtgcaaattgtgtgcatgtgtacgcgtttgttttccgtgtaataaaaacaagaaacaagcattagggatacttttttctaaacaatttttctagattagcaatcacttttcctacaacatagcatatgaattggaacctgaattcccaaaagcaggtggtgacaggccaaaaggctaagcattcaattcaaacctaatactttattaaaatctcactggaaattaaactagtttttctatactagataaaatggtatttggagtataattttttctaatagaaaccaggttttctagataaaacggtatttggagccctggttgagatgacgtttctatcttggtggtagccacgagtttgcttcaatttatttcaaaggaacttggcactacgaaattcagaatatcaagactagcagataagtgaaaacattgttgctttggtgggaaaagcacaagtgaaatatatttagttaggcaccatattgtcatgcattaagaaataagagccatttgcgctcaaactttatagccatagtgaaaacaaaattgaataaggaattgttttcatttgtttaaaacacaaaaaaattgtcgtggatggaaatttcgcccctcttggaacatacaaaatactacgaaggctccctctacgcagcctaggacgtgcctacacgtcacgtgtaagacttaaggcagggtggctagggtttctatttttttaacgcagtcatgaaaatccgctcctatggggagtcaaactaaggccacggggatgctgctatactaggcactataatcactaggctacatgtcaatgcgctctcctctactttagcatactatatcagttttttctaactacatactagcacatgctatgtcatatcattgcattaacagaacaacaagaaagtacacaaactcgcaccccaccaccaggacggttgcacggcatatcatttaagaactttttttccattatgtgttctacttcctcaactgataaaacaagagcaataagaagcgagttcaaattatgctgatcgagaacttttgagatgtatacacctatgaaagacgcaatagttagcaggcatgtagcgtagctacatctacatataagaatgagaggcatcatggtctaaaggaaggtattgtgatttagccagccgtcatagcttggacatgtagcgacatccaggtttccaatggggtagaaacctaggattcaatataacacaacttcctgatcactctggatgtattgaacatggaagcactatgttggagaacttgagattgagattctgctggtgagaccctatgttggagaacttgagattgagattctgctggtgagaataatctagaatcttaagttgcttctcattttattataattagtttttttagaccaattttgtaattatagctaaagaaaatggaatgacaactggttcaatatacttcagctggtcgatcttaagcattttcgtctcccacatgctttcccatcatgtccgaatcgaatatcatcaaaattatgaattttctacttttaggcagataaaagaagagcacagcgagggatgcaaagaacaaaacatgggatcccggctacaacttctccatgtaatccacgtaccaaagtggtttatgctgtggaaaaaatgcatcatacggacgtcggattgcgaggcatcaagaagcaatggagcactcagtgagatgtctaatcatcatgaattgaaaaagtatccacattgagtttatagtatcctggtgctgttagacatccatatgcatggtttctgtataacacagctgcccccctttgtgatgttttcaacaagacatggcacgcatcatggagggcagtgacgagcagtggaacaacaacaatactagctagactactccttgactaacttggtaaccgagtgactgggattgatgttgaacactgaacagtggttttgatatcagagagttatgagttttgagagctgtgtgctttgtgctatgtgtttgtgttgactcccctcaccatcgttg

SEQ ID NO: 51361 - DNA, 19710 bp, Oryza sativa
ttctgtatatgtgaactcaaaaattaatgcgaactaaatagtacttaattgtaaccctcttgtatcttttatttttctcggtccttgtatacacatgatgttatttattactccttctctcccagaatataaagagttttagagttgggcacggttattaagaaaatagatagaattaaatacaatggagtcgtaattgtttaagaagtggaggtaggtggaaaaagtgaatggtggagggttgggattggttgagaagtgaatattggtagagaagctgttatattttgggacggagggagtacgtgtctatggacatttgctgcatctcttattcttaactttatttaaacctgaaagcttgtatttctttcccttgtctttcatccacacctcagcaaaaactctatccaatagttctttgaaacccatttaatttactgcccttggtatatatatgcacatggaaaccaagtatatatgtttcatcctagattctactaaaatacacgacacatatatcttggacacaaacaagcaagaatttaaatgctaactgaataacatcatatatatgcatggtgagcatctaccaacacatgtccatgccatccatgaacactcctttaggattggaagacatcaggaataccataggcacaatcgtatagcttagggcaagttatcctcagaagttttgcagctcacaaacaggggcagatccatggttgaggccttggtgggccgcaagacgaaagcgcagctgttggaggttggaacccaaggatccccacgtcattaccgtagcagcactttagttacatgctacacacccaccagatcaaggctatagacgaattgagcacgctagtattccgaggattttccacaccttgtaaaatccatgaatttacctcaatcgggactacaggaatggaagttgtcgggaataagaggactggactcaagcattccagttgctggtctcccatcgtctatcccgcttccatctcacattcaggttcatgttctcctcagaatcaaacctttaatctctcctctctctgcaactcggcaacatggtggagttggcggtgggcagtggcgaccagtgaagagtactttggctagtaccctccaggatcgatctagtcaggaactcaggatagatccagatccatatcagctaactattcatctgaattttttttcaaggctgcaagtttgtcaaagtatcaagaacatgaattttggtaagaagctacttcgaattggtgtcataaatgaataattagcagtacaaatcgagaactatatgcactcaaggaagaaagccattctgaattttggcaagaactatatgtattcaagaaagaaaaccattctgaattttgacaagaagaatgtggttaatgctgccaatttgttgtatttatgatgttggatgtattgaagattccttggtgtattatctctactacttaaaaaatctggattggtgatggtgaagctaaaacagacacgcgatccaaagtagaaacgtacgtcgacacgtttggagcgaaaaaaaaaagtacacgctcctccgcagcggaaaaaaaccccaagccccgcgacccgcgccccgccccgcgcgtcccgcgtcctaggcgcccctcgaccgcgccgcctcctcaccgccctcgaccacagtcgccccgcgcgccctcgaccgccgccgcctcctcgccgccccgcgccgcctcctctctgccctcaaccgccgacgccccgcgccgcctcctcgccgcacccaactccggttgcgccgtagtgtccaccgccgccgcccgccgcatcgtcgtcctccccatcacccgccaccaacgcctactccgtccacccgccaccgacaccgaatcctccgcccacccgcaaccgccgccaacgcccccgccgctgagtcagctccagatccgctgtcgggctgactcctcctcctcctccctgtcgcggacgccgccgccgccgatgcctactactccgctccgagccccatctagcgaacagagcagggatgggaggggcgccgtcgtcctactgcatccttggtgagcatccacatcctttttctcattcatctctctatgtcccacccatttttgcctggaattttattgcgttaaccatagcttctcttcgagatctggatgatgctcttctcttagttagtttaattgtttgctccccccccagtccaagttggatctgcccctgctatggataaataagattaatctgaatcacaggcccttcaatcccttctcatttgtaatcctaagcaaattaataagctacatagatgttgttcttgtaatttatttggagtaatcagtttaattgaatcacagtagcattgtgtttccccaatttggttttgtcactttcaaaaaagaaaaagacatttatgtttcacatttggtactctagcaaatttattcagttatctacccaatttattcaattgttctgctgtgtactgtagtctagccaatttattcaactattctgctttggttccgctcgttgtccatctgctcatagtcgtccactcactggtgtttccctggtatgtctctgaaagactgaagtggcatattttcttttgacgtaggacatacgaaccgagctcttgcaggccgcacaggttatcacaatgatatgtgcatgggatatgtttaattactcaataccttgtattttttttcttctggatatcgaatcaaacaaaatccgcatgaaaagctgatggagtaatggctgcaatgtgctgcataggaaattatgtttgcatgatcgtagtcttcaatattcaggatacataagagaggatgttatctcaaattagtttcaacaatatactcattattccatccctgtaacagtaatgcatgactccaaaagcttctgaaacttttaaccccatacaactattttcagtttttaataaatgaacaatgattttctgtaagaaacaggaagtaatacttacaccgggtgagctgaaatcatggttgtgtcgtcatgatataacaatccgtggacttgctcgtacagggaatacccgatcgatctagaataggggaatcaatcgatttctgcatcagatgcgctttctttttctcggttagatccgactgccggcgaacaagcctgatagttcctaagattcaagccatgaattttgttactagctaggtgttgcaacagatctcctgacatccttacccatattgcagaagtttttttcatttcagccttggaaatattcaaagtaagaccctgtactactaccacatcaaagatttagttgttcctttgtaatgacattattttttgacagcacgcatactccattcctgattcacttgatattcctaatgattttgattactcaacattatataaagacttctgattttgattcttaagtttttttttcttatcttaggattcaaatggtatttaattcagaatttggtaaatcacctccaaattcacaatctgatctttgatttatttctttcgacattttccaaatgtacagcaacattgctatctatgacatattccaaatgcacagccatttaggagattcttttagctaattcagcaataaaataaaccatgctgtaaatttgaactggtctgcctctgttcatggggctaaaagttatggatgcttagcccagatgaaatagcatcattgcgctctactgtatcaggattctcccttgagtcgtgtatttgctattttgttttgcttctctcaaacaattgttcctgatgttatgatctgatatatcatagttttaacgtgatacacaggtatagatagtataagctgtcgtatttcatgataaatcaattttcaatgatgaaccttaaccagatttggacatcttcaggtgttggacttgataaagcttggagatcatctcagtgaacgggaggatgctgatctctataggattgggattactggtgaatcacttggaggtattgtatatataatgaattcatgattgcatccttatattagagtaacatatgcccccctgtagagcatataaaataggtgtgatagcattagaagataaggtaattttttcagtaagaaaaaaattaaatcattttttatgtgtctgaaatctaaatttacaactgaatacaagctcttaatgattctctgcacttgagcgtgtccctgaaactgactgaaatctatctattatatactaaaagtccatgaaacttcctataaacgctctcaggccgccacgtggggctcctacaaacgctcctaggccgccacgtggctctgtcaaatctaaccgtcgattttcacttaaattggtggacccgatactttacaccattagattaaatttttcattgaacctccccttccatcgatccccggtttccctcctttttctgatcctattattaagctactctttcaccaaaaaaaaagacatgcgagtacatacgtgagtatagcacgatcagataaacccgaaagaacatactcctatacgtacttaatacatgatcagagaaacaccgaaagaacacatatatatatacttacacgtacatatagaaaaagataaaacatcatactctataactttacataaataccactgtcgattttcatttaaattgggacccaattgatgttttagaacattagattagatgtctaaaagtccattaacttccaaaaatgctcctaattcgtcctacgacatcctacaaacgcttctaagttgccatgtgatgctctaataaattagtgaaatattcttaaaattctaaaataatcatattttcattaaatttggtggacccattatttacaactattagattaattttcaagaaaaaaattcctttcctaaacccgggccaaccaaagcttgtatgtataagttactttttttaaaaaaagcgaatatacgtatgtacgccttatcttcattcaattcatttctccactttttcacctattccttctcctattttcatgccttattagttagataagcaataatatcatgttaaacaattaagcttcttaatcatacaactaatttctgatccgcaaaatctttaaattatttataactaaatttacagttgaagaccatatttcactacaatttagctttgaaaaaaaaagtcattttggtttatatttctggcttttgcgtgccattcaagcaattataaaaaacatataaaataatgataataattaaattaggtctacaatcatgaaaataaaatgaatatactatgagtaatgtttacagaatatgttagttagaaagcaaaacttatgcaacaaaataagcaactataacatctaactcacactactaatatttgatgaacttatgtctttagattattttacatttaaagacccatatccactgtaatattgattttgagaagaaatatgtcactttggggctatattttctgatttttgtgtgccattcgaataattataaaattatagaaagataatgatatatatcttatcaccatatatgacttcggaataattaaactagatctatatggataacagtaaaataaacgaatgctttaaaaaagtactccccattataacattagaataagtcaaaataacattattagattattagattgtagtgttcgtatttttaatatctactacgaatatactggaaaagacaagtaaaaactatagattttaatcgaacaataaatcattttttaatttttagttaaaaaactaatagcaactaaaacactacaacccgggaattattacaattatatgcccacataatctcctcccttcaactctctcttcctctgctcactcatttaattcctttgtctcctaatttttaactaagtaaaaaaaagatcaataattagaaagccaaataattataattctaaagttaaatcataattttaacttattcgaatttttttatttataattaaatagataatttaagatccatgttacccatatttcaatctataaagatgaaaattcgtcatttaagcatagacaccgttcctttgcatagtaaccaaatagaaaaaacacaaaccataacacaaaatgaaaacaagtactatattattgtaaatcattgtacatcctttgagcacacttaaggtgtcacgtgttatgtcttaaaaataaaactttacaaattggaagaaaaatcatctgaccatcagtttccacttaaataggtagatccattattttaacccaatagatatacatttaagaaaatcttaagccgcaatgtgttatgtcttaaaaattagaaaaaataacaaaaaatgtgagaaaaaaaatatatcaacggtttcacttaaatcatttagataaaatagaaaaatccacccctccacttcgccctccccccaaacatacgcacaacacggcactactcgtcccatcccttctgaccttctccactctatcccttcctgtttatatagccaaaaataataaaaatattaaaaatgcataaatttcaagctcatctgatttctaatctaaatattattgtatttataattagaacaatgatttaaagatccataaagactatattttgaactgtataaaatataaaataaagcaggtaatagaaaatgtcaatagggactaaattaaactatttagagaaaacatgataagttcataaaaatattggttcttacatttcactaaaattggaccaaccattgcatgttccattttcgtaacaattttaaaatgcttagacattaatggccttacatctatcctatatcatagcattatgagtttctccacatattattacacatataaaccacactaaggttcacagtatatagttctttgaaaagttatatttgttactattaaatttaaaattttggattcatgttaactaggtatattcttttaaaaaagatagtatagatcacaaggaagcgaggtatatgacatgtcttaattaatttatatataagtatgtaacaacttgcatcaacttaaacctactataaggagaactacttgatggtacaaataaaacatatttattaacaatatagttctttagaatttgtttaaaaaaaggcaaataaacattctattaaaaaaggacaaaacaccttacttctaatttatgattgatttgtcaggcacgttttccaaaaaaactaaatcgaacttccttctatatattaaagagatcatagataattatttatacagatgtatcaaatatgatatattttaaaaccaaacaaatatcttggaaaaattatcaaagcaaaatgccgaaaaacagcggaggcctcacctgatgtgtcttattcaaataaaaaagtacgtttaaacatgggaggtgtcaaccaattgatattctgtttatatatatatatatatatatatatatatatatatatatatatatcaaacacaatgtacaaatcaggttggaaatttcggagtaaaatttccaaatttcagaaatttcgatcatttcggacccctcagatatgatattatttcggccgaattttttcattaattttgataatatttgtccaaattcaactaaattttgttcaaatttttggaaattttataccaaaattttggaaatttcggtatttcagtgatgcccgatcaaatcggctaaaccgaaaagtttaaccctgtgtacaatacatccccgcgtgaatgcgcgggctatctttctactttatataaagaatatcgaggacaaatctatcaggatacacaatgtgatcgttctatttgaagatttgttctatttgcagaaccctacctctatatctccaaaatatgagaactgcattattgtagatataatttagtaatgatctgacataaatctagaggaaaaacaaaaacaatttggatttttctctttgtctttgacagattgcttttgtgcatttaaaaagataagggtttgtttaactaatttctttttgctacagctttcagtatagtttattaaatctgatgtgcttctaattaatcttatacaacatatacaaaatgcttctaaagaaatcttctaattaatcctccaccaccattcagtccgccgccccgtacgctggactatatagttattattaattgctattatctttaagaggcgcttttctttccctttgtcagataatcaagaactatcatgatcttttgtgatcaaaagcccatagtccactactatgttttactacttccagattaatggagtggtattgtggtttctcagccatggcaatgtgggtatgtaaacagttctcacgtgagcagtacattttctacctcattttgtgcatatgttttatcaaagaagtaagatacacaatatttcgctagccctgtggttggtttcagaataatgttttctctgaagtgaaaattagattacaattggtctatataccttaacataattacattaatatgtcaaaaataatcgaggtatttgctatagtttatttggagttcatatcaatatcaaaacaaaaatgtactctttagttcttcatatttgatatgtacatgcttctggaggatggagtattggagtgttaattagatatggtgtcccgcattaaccacattccgtgttgaatgcctttcatggtttgaataaagtgaaattatatactactgcacaatttctgcagttgcgtgcgtacaaacaaatctttagatttctaaaattggcatggatgcttatgacagcttttggctttgttgtcgtttgcagcgagcgtcgtcgtcgtcaggtcctccactgctgttcagtccgccgccacctacgccggtcctctcgcttccaggtgacgaactctggttgatggcatcgcactgctggtaccagggtaattgctggcgcaaccgcatgccaaacttacctgctgccactcccatgaatttactaattagcgttttcttagttttcatttgttggaatgatggatcgacgaattgatgatatgctccctccgttctaaatacagggatttctcaaaagattttattttagttactaattcagttatcaatttttgaattttgaattgcttaaattcctttcctgagcatctgattggctctggaataattgaagtgatgggaatcagtgcagatgcttctattgtggtacaaagtgtgaattcttatattttggaatggagggagcatatcatatatctgtataatttaagaattccttttttgttcgaaacctgaagttggacaatcaacttttgctttggaatttctggttctattcggataccaatctcttcgtcctcactccaaaatggaagtgattttcattatttacatgattacatctcatttcttaatatttatatgcaaaatcagaagagtgagattattcccttatagcttgtctggtgacaccctcgatttgtttctagggtctttgttcaattctaattctaacatttttaaggacggattggtactgttttgcagcatcttggcttagatttatttatgtgatgttctacatattttgctctgcgcaatagtgatctggttggagtacatacatatattaaataaataagtgctctcaattttgtttccgtagatgtgagtaagcagtttttttttttcatatgtttcagtgattcattttgctgccttcaattgtgaaatgagaaatacctgtaagtgaaggcctaagctcaaggaataatttgttctttttgaaaacaaaaaggttagcgttctaattctttccaattttttaattgacaacatgttgaaccattcatcctttctgttctctatatgatgtatttcaccttcgtaaacattttacagctcataggtagaatgttcaccaccaggcaagtcaaggagcgaagtatggggacagtgtgtgctcggaagatctttgccagcttgtgttttgacttctgaaggcatgcacagatgtgaagatatgaacttctaggggagctttataaaccgagaatagttaaggcaatacttgatttactttggactgcaaattacttgatcggataatcaatatgtggcgagctttacacagattggctttgatgaatcattaaagggctatcggcggggtgaatatctagctttgaacatgatttgttttgattcctgttgcaacgcacgggcacacaactagtaagttgtaaattcatcttgcaagcagctgggagaaatgttttgaacaatgaatggaatgcaaaatctttctaatacctgtaaactgaatgaaatggcttatgaataactgaattcctgtaaacgcaatggcttctagatcccagtagtattcagagtctcagacaagaacatgatgtgagagtaatgtcagctttgcccaaggatgcgaagaactcacggagcagcaaactcaagcgatgacacacacgcacgagcaacaaattgtagtggacacacacaatagatctctggagatgaacacacagaagtgcacacacacacatagttgttaaattcagaccggtgatcgaaacagtgagtctacctgttcaaaggctccctggtccaaccgcttgttcaccggtttaaccgtcggttcaataaataactacattacattctttatgaattttttggttgactcaaaggttaaacatatttgctatacaaccaacgctagctgctttctcagttggtacagagcacgttggggcaaactgaagtcagggaatcgaacatttttgctcaaaaagtatttggctcaaattttaaagatatagcaaaataaaattagatgaggtttggtcttgtatttcaacttcttgtattttatatttctcccaactccgtggatcccgcatgcttcaattacaacatgtacaaatggaatggcattaaagttagagaaaattcaagaaatgccattaacaaccgcacaattatgatatctacaaatacgatttcatggagttccataaaatgtcatcgtacaagcgactgattctgttaagtgctatatgatgaataatatatttaacggtgtgggatacacggaaccctagataatggtgatgatatttcaaggataaatcgcttgcttgatatggaactcgcactcgcccataatatttcttggatttgaatgtttatcgatggtattttttggattttctatgctttataagggtgtgcagtagtgaattattttttccttgtattttcttccccttcagtcgaaagagtagcagagagagaagcaagatgtatacaagcataagggaacccacaacctctccatgaaatctacataccaatgagaactttagttcgcttcccaagcatgtggtttagcgacatacgcaggattgtgaggcatcgtgaatcacaggagcacacatcgagttggctagcaatcaagacctgaggacgtatccacattgagcttgcagagtccgatcgatgctataaagccacatgtttgcactgtaacacaactgcctgtctgcctcttgctccaaattttcgacaagccagcacacattgaccagtttgtaaccaagctagagatgcaaatggttccggctgccatagctaatgaaaaatcagggttagctgagcagtgagagtcgcgagactatacatataacttatcaaatggattcatagaaaaatcaagtgtgagaagaactttaacaaagccattcaaagcctccagttaattaaacatccttgttttggtcccaattgattttcttgctatcgacagctttctgtagatgacccatgcgggccgcagcgatgtgagcaaactggtcaataaggtttcaagtaattaataaggttcactaaaaataattgagctgttcaataatcaactggacaaaatgacgtatattgatctatattttctgaatttaaactaccatcaaacaattaatttttcatgtgtgtactatttgtgtgtgtgtgtggccctgtatgtattgtcctgaacatattacaagacagtatattaactagccggcaacacgtgcatatgatcagtaaactttgaaattagagctgttgaccgtcaccatagtcgtatcttgccactactaatttgtcttagaatggcgaaaaataaaatgaaatctttatggggacagtgggagctagtacggcataggaagaagataaacgttggccaggtaggcattattagtcgatcgatttcaaagtcaacacggtaggtatctaggcgtaacgacgaggaatgtggttgggtcacacttgacattcggtaacaaaacaaactctgaaacctgacattgggtggctatttggctgaacgaatcgtccgaaatcttgacccttcccaaccatatatatcagccagtcctccaaaattaacctgttggggctcctccaacatgggcctaaaaagttttatttgtatgtaaaatgagaaatgccaaccaatacttaattgttcgcctctttgacagtagataaaacgagacgggagacaaagccaagtaaccggagataaaacttctctatgagatatacgtaccactaagtagtgatttagtgcttcttatgtagcatagccatgttaggattgggaggcatggtgaagcaaatgtgtgcattatgagttggtcaaccatttatttgtgttgaagtatcagctttgaagtcgcaaaccacagatgcaaaaatacctctctggtttacatttttcagcttgctcggatgaattgccaagcaaacaatgtagagggctgggacaagcactgcaacaacaacgttgtgatcaccacgttcctagaccagaaggcacgctgaagctccatacaccacctatcgcatgaattcagaccgttgtcaatcaagaacttccctatatatgaggcctacatacccatacgagagcttctgtgctttatgtacaagttcctgttgtctacacaaataggattgggagacaaaaggaagaaaatgagcatattacgaattggcaaatcatccaagttcatacgagtcatggtgttcaggagcagtcgtgatgcagtgtaacctctctggcttaattaactgcaacacaacagctttgcagtccagaaggcaaaataagtcaccacacgagaaatcatcttgacatggtaacaagtgattgtgcctgctgttctagtgaatggaagagatgggccagccatagttggtgaatcaactatagaactgtggaagcctacctatacatgaataaactacagtaatagcagccttttcaggcatccagaatccttaccaagccatgtccataacctcacttttactgctgaaaattatagtatgataccatttcgatttgcagtgctagctgctatgcaattagtgtaggatcgaatagtaaaaaccaagccaactagaggaggggtgaatgattgtactaccaaaaatcaaaacttttagcggaattcaaagttacccttgaagtcgatggagatctcgacgtagccaatctgaccgttagatcaactccggtctaaccgcagtgccgccactagttggactgcctgcacaccgccggtctgaccaccgtcttgtcactggttggaccacctccctgccgccgatgtgaccgccaactcgcttccggttaaaccgtcaggatctagaaaaacacgtattgatgaaactcttgaaattataacaactttattgcatcaaaatgtgtttacaaagtgcaccaacaacactccttaccaacatctcgactaaactcgaaacactaacttttctcttaactcaactctctctaaatccgatacagggagaccacatgctccctctctatttatacccataacatggttgcccctagccacaaatccaactcatacaaaaagtcctaatcccctaggaaaccttcccgtacaaaaaacaaactccaaactttccagacttgaactccaatccaaatttgacttcgctttccatgcgcacacaacaccatgtgtattccatatggaaaccttcaccaccacgtgcattattctctagcctatccatcccgcatgatatccttgaccatctggacctcaacttcccccaagcctagtcccgatccatcaccggctatactcccatggcttcaagcaacacctgcacatgaacaacaaagaaactccatatccaagtacaagttcgctccaacttgactcatatcagcacacaacagtattacatacgaatagagaccatctagaagtcatatccatgaagcaatctataaatctcacgaaaacaacccgaaaccaactccaacctggaatccgccgatctgaccgtcaagcaactcagtcagaccgctccaacaccactggtctgaccgacggcacctgcccggtctgaccgcccacacagagccgacaaccaaaaacactattcaccatattttcacaaaacactcacctttgacaattgtttatcaccacaattaaatcatcacttgattctacaattagtagatctcgaggtcataaacacccgtgtaatccatggggcagtgtgtcgacgtctagctactactggctgatcatggtctaaaaaatcggttcgaaattttggtaatctcggcccacactggcttgtagaaatgtccccaaaatttttaggtttttgtcaaatatttgtatgtttggtcacaatttgttcaaattgacctctgaggtgtgatcttccttcgagcgctagcagaaggtctgtccaatcatgtatgagcacacatatttattgaatatcatgtcaaaacatattgcctttcagtttgctcttcaaatgttgtgcttccctagctagcacgtggatattgaatgttatttaaaaacatagatatatacttcgggcagacccaagaccgggccatcctatggtgtttcttttatgagatcagcaaaccacgtagaaaatttatcatggacaattggctttcaatcccaggcccatggccatgaccaaggatgcccggggctaggttgcaagctttgtgttagcatgcatagactgaataatattaaagttacgaagtttataagagggtacgatgttatatcatttatcgttctatgaattttactttgagcctttgaatgcacataaaacaagagcgcgtggaaattgagggaaaaacaagcggaatctgcaaatcggatggccgactttataaaaaagaatcgggaggtcaaatgtttcaattgatcatatgtgagacattaagttctacatggtgaaacaaaagaagatcagtgattgaaacattaaaaaatttgtgaaacacagtgaagacacaagttgacacatatcgccattacttatgaaacattgacttttaatagtctcaaacatatgcttttcttttatcaaaatataatcatacgacatcttattctaaaaattttattagaatgaatacaacgatatgatcagatcgttgatcggataagtagtttatgagaacaattattctatagattgctaagtgcatgcatatgtggacgaagtggagagagagcaagtagtgtatggcatgaaagaaagtagtggcatgtagttgcttaaattttatgaaacgaagtggaatataaattgaaacatgtaactatctcgtatgaaatatatagttttaactgtttgaaacatatatttttctttcatcaaaatataatcgtgcgatatcatggtgtaaatatttagttacaataaatatcatggtgtaatcggatcgtaaaatagttaaatcgtttaggagaaaaatcttttgcagtgagaaggaggaatggagaaagatgccagcttgatacagccaccataccgtgcatgcggcagtgagcgaccgatttttcttctttgatcggaggcccgagcataagtattctcctaaagcaaccatgaagtcgtccatgagatgagagatttgattcacacatggatatatagcacaaaatcacgtagatgtataggattaggaggcatggtgaagaaaatcaatgttttgtgagttggctaatgatctgtgattgttgaagtcacgcattgagatatcatactcctgatgcagaaaaactcaagaacatctacggttcaaacagccacactactgtctctgaaactgtgccctgaaccaccatgaaaacaggatggaggtgtccggtgggagcaatgcagaaacatcagctcgcagacaagcaagaatatgagtctcccagctgaagtttcgacacctaaccgtgtgatgaagggataggattgtcaggatcagggttcactgcacaacgagtctccaccaacaatctccacgcatccaatgggtccataaaaactctaattgtgaaacacaacgacattaagcttccaacaaccttagaggcgtccaaactgagtttaattaattatcaaacaaaatactcgtagtggaggctcgatggcatagccagacattaatacagtcataagtagatgttgcaactgaagatcatagcatattttggtttgcgaaatcaatcatagcattggcatccagctgctagcatcgttgtatgggtaatagatccaatgcaacaaatcaataaccatttacgagaatatttaaggtctaagattgttggcccaaacttcataattgtaacaaaggaaattagaataaggaccacttccttgtatataacgttttttctcccaactactcttaaccattaattcttggtcagcatacactgattgaataaattccaaattatggactttataacggtgcacaattattcattgctttatcactgcatggcagtagttataagtgaaagtgtggacaagggatgagcaactgtcaacttctccatgacctccacattccagtgagattttatttgcttcgaatgtgcttagttagccacatacgtagaattgagaggcatggtgaagcaatggagtgtggttttagctggccatccatccacaaattttgcaatatcagcacggaggtagcaacctactgatgggctaaaacctctccggtttatctgtaacattgctacctctttcacttttcgctgatgaaccgagaaaacaatgcagagacctgggaaaagtaatgtaagaacatcagtggtaccatgttccaagaccagcaggcaaatggatcgcctggtgtagaaatcatgctcaagctcctcgcgatggtcccctatggtcatacaaggatggtcggggactcggggttttgctgtgcaatgagtctccgtccactaactttctaggtttcagagaatcagtaattgttaacacatagtggcaggcagcagccagccaatggtatatacttcccactttgcaaaatctctgaaaggtttccggaggcatctgacttaaggcggccacctgtgaaaagcactactacacatgcggggttgtgaggtctcggccaccgcctataaaattcattttcatagaggaccgtcttaagcgaccacatgtgatgatcctttttaaagacggtgctttacccgcctgtgcaaataccttagcttcacatgccttttaagcggcaatcaatggacacgtctctgtaaatgctttttatctgcctatagaaaacggtttcgcagtagtgtgttcatattgaatagcatcgaagttatggactttatatatgggtgtacttatagtacatcatttatgctttgtatttgatatttgagatttgctccggtcgagcaaaaagtacctcgaggtaccgctggtacctcacggtaccaaattgtttccggtcgttgaatctagctgggcaggatgggtactgttagatccaacgatcggaaacgatttagtaccctcaggtaccggtatctcgatgtactttttaacatatataggattgggaggcgtggtgaagcggaggtgtgcgttgtggttcaactgtccatgtttgttgaagcatcagcactgaggatgccaactatgcagttaaacctctgaagaatatacagctagagaaaagaaggggagaaaagttgttctcagatgacttatataggtagagttttgtagccaaaatgatttatatttggaaggagaggaagcagcggcttctgaagcatcagatattcaacagcctcgtatataaattgaacctgagtgagtttagaagagaaattctaccattatgctattcttaacagaaccgagagaagcaggaaatctatagcacattttggttttccatgatgcaaaagcaagaggcccagcacataatatacatatacaccaaagttcactaaaaaaaattgagctgttcaataatcaaatggacaaaatgacgtatattgatatatattttgctgaatttaaactaccatcaaacaattaattttttatgtatactgtttgtgtgtgtatgtgtggccctgtatgtattgtcctgaacatattacgatacagtatatgactagccggcaacccatgcatatgatcagtaaactttgaaattagagttgttgaccgtcaccatagtcgtatctcgccactactaatttgtctccaaatggtgaaaaataaaatgaaatctttatggggcagtgggagatagtactacataagaagaagacaaacgttggccagctaggcgttagtcgattgatttcaaagtcaacatggtaggtattgaggcgtaacgataaatgtggttgggtcaaacttgacattctgtaagagcaaatacaatagggctccagaaccggcgataaaatctccacgtcggctcggacgatttgctcgaggagaaaacggaagagagagcgagagcaagcgactaaataagcgccgggctaccacgcgctccaagaaaacaggcccactaaaaggaaggaaaggggagggagaaagagggagattagagaagatggagggtccactaagataaaaaatattagtgctatagtatttctattgtacacattagctacactgtttactatagatgacatggctatttttaggagctgacagtaggctatattattgaccttgctctaacaaatcaaactctgaaacctgacatcgggtggctgtctggctgaataaatcgtccggaatcttgcccgcccttccaaaccatatcagctagcagtaaacctgttggggctcatccaacatgggcctaaaaagttttattagtgatgtaaaatgagaaatgccaacaaatacttaactgttcgcctcttcgacagtagataaaacaagagtcggagagaaagccaagcaaccagagataaaacttctctatgagatatacataccactgagtgattcagtgcttcgcaggtagcatagccatgttagggttcagaggcatggtgaagcatatgtgtgcattatgagttggccaaccatctatttgtgtttaagtatcagcatcgaagtcaaccacagatgcacgaaaacctctctgctttacgtttttctatgtgttctgatgaatcgccaagcaaacaatgtagaggactgggacaagcactgcaacaacaacgttgtgatca

SEQ ID NO: 51362 - DNA, 27695 bp, Oryza sativa
gggtgagatcgttcagaccgttgtcagtcaagaacttccctatgaggccgatacctgtatgcgagcttctgtgcttcacaggtgtacacattactgtagcatacacacatataggattgggagacaaaaggaagaaaataagcatattacgagttggccaatcatccaagttcatacaagtcacggtgttcaggagcaatcgtgatgcagtgtaacctctccggtttaacaaactgcaacacacaacagcttctgtctgtgcagatgcaagaacatcatatcagctatgcagacaagaaggcaaaacaagtcaccggacgagaaatcatcttgacgcggtaaaaagtgattgtgcctactgttctagtcaatgaaagaggcatgccagcgtagttagtcaagcaactatagaatagaacagtggaaacctaactatacatgaataaactactgcaatagcagccttttcaggcatccagaatccttaccaaggcatgtccataacctcacttttactgctgaatagtattatagtactataccacttcaatttgcagagctagctgctatgcaattagtagatcttgaggtcataaacacccgtataatcagtggggcagtgtgccggcatctagctactactggctgatcatggtttaaaatttcggccccaccggcaagcacaaatctccccgaaattttcacgtttttgtcaaatatttgtaaatttggtcacaatttgttcaaattcagtcaaaatatgttaaaaattcaaaaaaaattggccaaaaattctgaaattaccgaattttggttctttcggtcccactggctaaaacccttgtttcgaaattgcccctgtggcttatcgagacgatgaacaagacggcggcaggtggagttgcatatgatcgtggttgcgctgggacaggatctgaggatctcatggggcagttgctccatgttagtggctcaaccaaaacaggctgtaggagtgtaggtatgtcataattaacctctatcccaaccaaacggtatagctctgaggttgagcattgagctctgaggtctgatcttccttcgagtgctagcagaagacatgtccaatcatgtatgagtacacatagctatattgaatatcatgtcaaaacatattgcttttcatttaatttgctcttcaaattttgtgctagtctctaaaacatagatatacttggggcaaacatagcctaaagccaataccagaatttatcatggaaaatgggctttcaatgctaggcccctggccatggccgagggtgcccgttgctaggttgcaagctttatgttgtcatgcatagactgaataatatttaagctagggagtttataagggggtatagtagtgatatagtatcatttatcattctatatagattttactttgagcttttgaaagcacataaaacgagagcggaaattgagggaaaggttagcaaccatgaagttgtccatgagacgagagatttatagcacacaatcacgcacataggattaggaggcctggtgaacaaaatcagtgctttgtgagtctcagctttgcgggcgtgccagataagctacagaactctgatcatcaggaggaggttggacagactttaaggagtagaccagtaagaaggagtaactgtaatcctagagtgtttgggccggaatggacctaacttctttgtaagattttgttttgcttgaaaaagaaggcacagtggcgccgccgatcctgtcggattggtgaaactatctcgtgttctcgagcgattattcatttccatctagttctctagttagtgtagctaacagtgagttggctaaccatgtatggttgttgaagtgccgcattgagaggatagatatatatcatactcctgatgcagagaaacatcagttcaaacagcaacacacactacactgtctctacaactgtgacaagaaccaccgcgagcaaacaggatggagggggtccagacggagcaatgaagaaacatcacagctcacagaccagcaggaaaatgaatctcccagctaaagtttccacaccaacagtgtgatgaagggattgtcaggattagggttcattgcaccaacaacatatccatccaatgggttcatagaaagactaatttgaaacagaacgacattaagctttccaacatcctcagagttgccaaatctaagcttaattaattatcaaacaaaatacgtactggtagtcgatgctcgatgacatagccagacaatacagtcatgaatagatgctgcaactgaagatcatagcatattttcagtttgcaaaatcgtagcattcgcatccagctagcatccttaatgtgcgagtaatagatccaacagatcttcatgatcaggaataattgtctaacagcagcatatagggtcaaggaagaatgaaaaacacagtggcggcggtgagcaaaggcacagagtcattgctggaacagaactcatgagtgttcaaccagtgtattgctctctccctcttcagagggtagcatttatatatttatactgagttacatgtaaaggaaattacaaccctacccctatctctctagctataccggggtggctgacaggtgggcccgccaacggttcgggagcccattcaccagaccaagagtcagtggcgcccattaaggagggcggtatggcgccatcatgatgctagtgtttacttgggtaatagcgggctccaggtaatgactagcatcggctttcacatcgccagtcgtgacgtgacgacggtgatggttggaggaagagtagtgcgcttttatagtgccccatagttattcccggtgtcctctgtaggcttcggctttggagccatggcaagagctctggagcctttgagccggctcatgggcctccagatcccttgaaccagctctagggccttcagaggcccttgactgggctttgggatcccccgggccttccggttgactccgaactcctgggagcgaactgccctcttcgggctcagctggcttcctaggccttcggattgggttctccctgcggagacgggctccatatggcactggtggcgggcctcccgacggggccctatctcctccgaagctaccagggagtgaatggtgcaatgtcgctctccttgccccaacagtcatcctccatggagtaccgcaactatgaaactaaatttaggccatcaggcaatttggaaatgtgttattttactcttagttaatcacacttaacaaactaatgaatcaataaccatttaccagaataagccaataaggtctaagattgttggcccaaacttcataattgcagcaaaggaaattagaataaggaccacttgattgtatataacgttttgctccgaagtactcttagccattttcttggtcagaataaactgattgaataagggtgtgcatttattcattgctttatcactgtatggcagtagttataaacgggagtgtggagaagggatgaacaactgggaacttctacatgaactccacattccagtgagaattttttttatttgctttgaacgtgtttagttagccacacacgtagaattgggaggcatggtgaagcaatggagtgcgattttagttggccagccatccacaaatttggaaatatcagcacggtggtagcaatctactgatgggctaaaacctctccggtttatctgcaacactgctacctctttcacttttcgctgatgaactaagaaaacaatgcagagacctaggaaaagtaatgtaaaaacatcagtagtatcatattccaagaccagcaggcaaatggatcgcctggtgtagaaatcatgctcaagctccttgcgacgatcacctatggtcatacaaggatggtcggggactcggggttttgctatgcaatgagtctccgtccactaactttctaggtttcagagaatcagtaattgttaaaacacagtggcaggcagcagccacctctagcatcgttacaggtgtcaatattcagttctataattcaacagaaaatatacagtgatcatgcctaggtgaagcaagttaacttgtaaatattattacttgattccgaagctagagccaatggtatatacatcccactttacaaaatcttggaaaggtttccggaggcgtctgacttaaggcggccacctgtgaaatgcactaccacacaggcggggttgtgaggtcatcttaattacgcagatcaccgcctgtaaaattcattttcatagaggaccgccttaagatgaccgcctgcgatgatcctttttaaagacggtgctttacccgcctatgcaaataccttagcttcacatgccttttaagcggcaatcagtggacccatctctgtaaatgcgttttagccacctatagaaagggttttctcagtagtgtgtccatattgagtaacatcgaagtcatggactttatatacgggtgtacttatagtacatcatttatgctttatattttctacttcgtaagatataaaatacaacagcggagagagtagcaaggtcaaaacaggggaatccataaccactccacgaaatctagataccagagtgagagagtaagtgctttgagcgcaagcatgcaagatggctacatatatatgttggattctgaggcgttgcgaatcaagggagcacagcaagttatgtcatatcacaacctgaaaataagcttatggaatcctgatgctacaaaacctccactgtttgtaacacaactgcttcctgctcttaattcacggtacaaattaatagtgtagatagcaacccaagaactgtagtcatagcctactccttgacaatagttggtaatcgacttaccggactgagatacattagctagctagagatgcagatgggcgctgctgccatggctaattagtggaagactagctagggctagctgagaaatgagaatcgcaagacaatataactaacaaaatacgttccatataaaagtcaagtgtgaaaaagcatagtagcatatataatagctattcgaagatctaggattgggacgaagagagtactacttcgtaacatatataggattgggagacgtggtgaagcagaggagtgcgttgtgttttgaccgtccatgtttgttgaagcatcagcgctgaggatgcaaactatgcagatacagttaaacctctcaagaatatatagctagagaaaaaaaggggagaaaagttgttctcagatgacttatataggtagtgttttgacgccaaaatgatttatatttggaaggagaggaagcagtggcttctgaaggcgacagatatttataagcgaaattctaccattatgctattcttaacagaaccgagagaattaagcaggagattataacacattttggttttccatgatgcaaatgcaagaggcccatcacataatatacaaatacatgttgttgcatacaagggattgagaggtataggaaataaaacgggagctttaggtatctgaatgtccaagaacgctttgatgcattcaattcgacgaagcatattaacatcataagcggatgttataaaaccagccccgaaattgacatcggtagctaaaacgcggaagaaaacgccataggagatctaaaacgatgacgacaccgagacacgatatttggtaacggagttcagccgtagcctacatctccggggcactgattacgggcgctcctccccgatccagcatatacagcatatcagagttacaacgactcacggccggtcgatgccggcagccgctccctcttgctatgctaagtcgccatgcggttacaacaggcacgcccctctatttatgagagaacctaggatagagtccgactcatactctagtcctaatacccattataactccaagtcctaaactgtaaccgactacgtacacatattcgacacaaactctaacaaactccaccttgacgaatatgccacgccaacctgaatttgttacttgctcgaacctccgtgtaccaggacttgagttggttctgccacagttcacgccgagccacccgacgagcctacgccaggctcaccgccttcaggatcgtgcacagcaacaccagcatgcctatcttccatgactccacctgcaacagcacttccttgtaacttgtacaaacatgagcttgtcctctcaccagtcataacagtcttgccgtccttcatgatattcatggtcttcctatcaaaatccacctgatacaaccaacttgtctcatgtaggctcccaagcgaaatcaaactcttccttagtcccggcatgtgtctcacatctgaaagtagcacctcgtttccatcatacatctcgaacttgacatcacccactccaacaacacgataactcgtgtcatcgcccaagtaaacaacaccaaaatcaccagatttgtatgaagagaaccactcccgcttcgatgtcacgtgataggaactagctgagtccaacatccacgcttctccagacttctcattagacactgtgagagtctcatgactgctgctatctgaatcatcaccacgagctgctaaacttgcaatgccacctttcctcttcttcagtaacgggcaattcctccttatatgtccaaactcatgacacttatagcaccgtgcccccttatccttgctcttcgacacccccgcttcatgatcatgctttgccttgaccagcaaactctcagcctgagaagcctccattgcctcgtttttgtttgatcttctcaagtctcgtgcaagcaacgatgaaattttctcctcagttttgacagtatccttgccgtgcatcagggtagtcaccacatgttcatatgacggtggaagcgagcacagaagaattatggccatgtcttcatcatcaagtttcacatctaacttacttagatccacaaccaactgattgaagacgtccacgtgcttcctaagatctgactcctcttgcatctgcaaaccatacagctgttgtttgagatacaacttactcgtcagcgacttggacatatacaggcttgccaacttgtcccaaatttccttcggcgttttttcatccatgaccgggtacatgacagaatccgagagactcaagcgtattgttgcagctgcctgcgccttcatctcctcccacttgccagcatccatcttttccggcatcgtctcctcaagagccttggatatcccttgttgagccaatagatccttcagcctcatctgccagagaatgaaattcccggtgccatcgaacttcaccacctcaaatttggaaaccaccatcgccgccatcgacgataatcaactcaacagctgttgccctgttaaattgatctgccctgattaattgacccaccgactaaacttgcacagtcaccagtcggacaaaaccaaccccttttctttttctccaaaaaaccggttcggtttttttttcggtcaaaaaaccaatcaaaccgagcggtcaaaggaatcagatcgattcctctccttccttcggccttttctcgctccccttcctcctgcgcacgcgttctcccgatgcgccgccgcctcctgctcctcacgccaccgttctgtgccgccggccccgcaagggaccaccgcgccgccccgcctcggaaaccgcctgggcgccgccacctcctgccgccgtcacctgcgccgacttcgcgaggagccgccgcgtcgcctgccttgggaagccgccgcctgccacctgggagcacccgccgtcgaagtccggcgccggttcctcgccgggaaccgccgccgccgccgcaagctcctgcccgagctacgacgaacgccgcgccgagcaccacgccgctgcacgccgcctgcaatgacgcctccagccgcccgtgaactcgccgccccaaaccacgctgcccacgaaatcagaggtaagatctcgcccttgccttgtggtttgtttcgattgcgttgttgcaatcccgtggtcctccgctgcttttatttgggaaaaatcgagtcccattcatggacagatcgtaatcctcgtccgattccccttccgtgcttgactaggtctctccctcaatctgtttctctattgtgctatgcatccgagttggaaacatatccgactccttccatgtcacaacctctccagatcgagtcctgtgcaatccgacttcctgctactcaggctctggccacgttccatggtcccggcttcaacaccaacacgtgcacaccgccatctccgtgacctcctcagcctccacgcacccgtacgacctctagcgtagccacctagcctcccgctgaacctcgccagtgacgaataccgccggtcagttgcaaccaatgcttattgctgtgctaacacaattgatcagcgcattgacggtctgaaattgactgcccttctgcttgattccgtcgcttttcatatgtgcgctttctccgtagcagtctgtcacgcaaatacctcgtcaacacctccaaaacagcctataggatccacacgctccgacttttgattgaacgccatcaatctaatcgcgagccgaagccgataagtcgcatgccgtcttcccagccaccgaacgatccgagcgctacgtctagccgtctccctgtcgaacgtagcttatcgaaaggcccgggccaccccgcccagagtgttcgaatccaccgatcgagaacgccgatcgcctccagcttcaatcaacccgagcatgcggccgcacgtctccctgtcgagagtagctcaccggaaagtccgagccacccgcccgaagtgtccgacccaccgattggatcgccaatcgcttccgccgccatcaacccgagcaccacgtctagtcatctccctgttgaaagcagccatcgacggttccggccgccgccagaagtgttcgatccaccgatcaagactccattgatcgccgccgtgctccaccttgcaccaatgcccctccctgggcattacagcaggctatgcggtgtggagcacctccattgcgcctctaccatggaccttctgcaggctctgataccacttgttataaaaccagccctgaaatcaacatcggtagctaaaacgcggaagaaaacgccattggagatccaaaacaatgacgacaccgagacacaatatttggtaacggagttcagccgtagcctacatctccgaggcactgattacgggctctcctccccgatccagcatatacagcgtatcagagttacaacgactcatggccggtcgatgccggcagccgctccctctcgctatgctaagtcgctatgcggttacaacaggcacgcccctctatttatgagagaacctaggatagagtccgactcatactctagtcctaatacctattacaactccaagtcctaaactgtaaccgactacgtacacatattcgacacaaactctaacagtggctatggttggaaaacaattatataacaagatcagattacctacggttggaagaaaaagaaattgaaagtgttggaccgataaaataatttgtttttccaaaattggtcggttcagtgaaataagcgtgtggagagtcatattgtccattcgttttattcaaaaacttttgtaaaatatgtaaaacataaaaatatatttaacaataaatcaaatgataggaaaataattaataattacttaaatttttcgaataagatgaacggtcaaacatgttaaaaaaaatcaacggcgtcaaatatttaggaacggagggagtactttataagaaaaattccatatatacctctaattttttattgaaaaagaccgtctcatgccctgccattgtcattgctcacagctccgccaccttgtgccccgccatcgccgtcgctcgctcgctcgctcatgagctgttgcttgttttgccgctgcgactcgccgttcctagcctcgccgccgacatatccactcacgagctcgcacccgccaccgtcgtcgccatcgcctgttctcggccagggttaggattggagcagcatagagaacaagcgacgactacataacctagtatatatagtagtatttttctttcaactacttgcaagcgtgagcttcttcagttgacccaaattgaacaacatattatggaatttatcaggatgtacgatccttcattatttctacatcctccatttcaaaatgagttaacctattgttcagatttgcagtactagcatattcaatattagattaacttattttggtacgaagagagtacattaattgttcatgttgcttcctaaccgataaaaggagaacaaagagaagagtaaccatcgtcaatggagaaatcctttgtcatatcttacatacccatgaaaggttcaatgcatcacaagtgtatttgtgcagtgtacgtagcctacgcaaaaataggattgggagtcaaaaggaagaaacgaagcatatcgtgaattggtcagccagccacattaccaattttctccggcagcattgaggtatagaaatcataatagacattagagtctagctctcggctggttgatcttccacacactgtaactgttggtgtagtttaacaaaccgatgaagcaatgtagtggagatgctctagttgtccagacgagaaatggcggcactgaagctggtcagatcaggatgaagcagcaaaggcctgccgttgttggccaagaaattctgaaactatcaagtacaccttcaggatcaatatatggtagcatcatccttttgaagcgtcgtctaaaatccttacgtaccaagccctgttagctcagtttttctactgaacatgaacacatttacttgtctatagctagctagtatttgtcgatccggaggttagaaacacaaacaaaaatgatatcgtggtccgaccaaaatgggacggacataccccacaatggcgccgtgtggacccaactgaaacattgggtagttggcgacagctcttttgggctgaaacttctaagttttcaagtgatgaggtatattctattaagtctgggctatattgcatacttatggagcataatgctgggatatagctagtcttgttgattttcattttctaataatctaatatagttgcatgcttcgccagactccaacacatgcatatattgaaagccatcttaaaactgacatcactaagtacttgccatactacactatatatgcactaatgtgaaatatataagttacttagacttctggtatcctactatccttcatgtttacaccctagcagcaaagatgagaattttttttatcttttagacttttttattttctaattttattaatagaactttccaaaacgtatttccaaatctaaagcttttggccgcgctagcccgcctagcgtggccaaataactttgttacgccacgtgcagatgtcgtggcagtgttgttctgccacaccagcctcttgcctctcggctagcatggctaaaagattcagtttttgaaaatatttatttggaaagatttattaataaaattaaaaaaagtctaaaaaataaaaaaaatcgaaagatgactcatttatttgaaatctataacacttaatatacatgttgttgcatacatgggattgagaggtatatataggaaataaaacgaaattaagctttacgtatctgggtgtccaagaacgcttcgatgtattctattggacgaagcattaacatcataagcggctacggttggaagaaaaaaattatataacaatatcatagctcctatggttggaagaaaaagaattgaaagtctacgaccaataaattaatttgttttttttaaattggtcagttcggtaaaataaactaaccgtgtggagagtcacattgttcgcttggaatgctactttactgtgttgtgctccctcatcatgaaaattgtttcacgatgaaaagcagttgtttcaccatgaaaggaaattatatgaaaattgtcatgggatgaaaacctgattggaacttggaaacagcgaaatggcacaagcaaagcgcacgtacgcgatgcgaggagacatactctgcctttgtcaataggatggttcgcatgaatcggactaccagcaatgactgaagcggaaaaaacgaaaatactcacgctcgggcgatcggcgcagggggagccggatcgggcgctcccccgcgcgcctctcccctcacgtgcgtacctgttgggcccaacacttctccctcccctttttttaaaaaagatgtttcattataatgttttactttttatagatctaatgttttaccaatgagagggagggagagagcggcggcatcttggctacagccaacattgcccaagtacaacgcatcctccgctggtgccgcgctcgtcgtcgccaccatctcctcctcaatgctgcgcggccttcgcgcgccgcttgccgtccaccaccacgccccgaccactgctcgccatggccactgcgtcccgccatgcggaggcaaagaaagggcgtggcagagcggatccggtgccgacgaggtggatggcgacaagcggcggggaagacagggagagattggcggcgggagagagaggcgccgtgtggagggagagagagagagagggagagagtggcgatgagagtgagggaggagaccgtcgctgggaaaaaaaagaggagggtgtcgtagagagggagaagagaggggtagtacagaaaaatacccactgtgggctttttgggttgggacacccattgtgggtttgtgtatcttcaccgagttgcttcaaattttgaaaaccccacctaggcgtagcctccattgagagatgtgtgcccctgggagtgccctcagttagtgagggcactctagtatggttttgattgtagatgcccttagcatatcatggtcactaccaagcagaagttcagcactaccttgcgtggtgtgaagtgcgccaatttcaaaccaaatgtgagtagactttgaaattagaggtgatggtaaatctatttgaccattcccagcttcaaaatcgtagcaattgtgtattagtttccacataagatgaaatataaacattggatctagcgattggtcgattgtgaggtcagcacgtagtatgaggagagacaagaggaagccggccagcggttacacttgttgtttagtaatgaaaacgactccaccaaacccaacatccggtggcttgcaaaaaggcccagcccagttatatgggtgatacaatgacatgtcctttgaaatctaatttgggcccaaccaagatgggccgcatggaaatcctacatgtgcgtagatgcattgcatatttctatacgccccatcttgtatgggtcataactgagccactcctaggctcacccaactggaattttttgggcttaaattgttgagatcttcttccaggtacccattttgggttcagactgtgttagtgtttaactttaaagcttttttctatttctcatctcttccatccacctcatcaaaaagataatgctttaaacccatttaatgttattgcttcgataaattcttatatatatatatatatatatatcatcctgatcaaattctaacagagaacgcagaacaaatctttgaaaaggcaagcaagaagtaggtgtacgtgaactatcaggtaattaggaaaacacatatggggagcattgatcaatgatctcctcgtcacccacaaatacctttaggcttggaagacatcaagaatacagtagggacacttgtatccaagggcggagacaagagtagagcagctagagcttgggaatttgatgaaactactactggctcagtataacggtgtttaggcatgtgtcttagggtttttaatggaacttcatgggttgttagatggcacgaacattgagtttctaattgttctatttgtatcagaagctacaacatgtaaagttgagttacattgtttgtcttcaaagtaaaagagacagaaaactgccccaaatcccccccaagtcctttgtttcttcctttgctctgaattttgtcggaacagctacagagtgcgcccaaagtgttcgtccatggttcttcccaacaaaactaattctaatgaataaataatcttttattttgcaaaatataatttaagaactgctgctccaaatttcataatagggaaaagagtaaaaaaattcatgacatttagaggcccagcactagcctaggaatttgcttcccatatatcttgtccagtgctcatgccatgttgaaatacttttcatttttctttcatcaaattgcatgcttcaccagcacgtccatattgaatgccatctaaacactaaaaatacatcccacaaatcctttagcatttttaacccgaaaacttgctaccacaagctttcccaggatgcacatactgaatctctctatgttgacgttttttttttggcaaacaaaaactcaactaacaatttgagtataatttgtggacaacataaatgctactcaatggacatatgaaagaaaagcagagacatagatgagcaacatgagaacttcagcttgagatatacataccaactagagattcagttgctactgctttacaagactatttcatagcacctacatataggagtgggaggcatggtgaagcaaagaagtgcattgtttgtctaccatccatcaagagtaaaatttttatcaacacgcagttcagatactctagatgcagtataacttctcgggtctatctataacggagccgccgcttcaattttcctattgcctaaccaatggagcaaacaatgtatagtgtctagatggctttggaaagcaatccaagaacatcagtggtagcttgctcctagtccagaaggaaaatgtgtcgcttgacgaggtaccactgaatcttcaccagctatcgtgaatgggatgatctgagttggatgtgcaaccaagacttcgccacaaaaatgggaaatagtcataccaagatgaagcaagctaagatgcatatattaccaattatatatgtatcccaatttacaaatcaattagcattactgtgcgatgttagagaaatatttcagatgattttcctactcagaaagaacctggtacatttgcacggtgcattaacaaggcagaagaaacataggctctgcttgtagaggcagagatgactattgccgggcacacacctgatgcgggagagcgagcatggctggaggtaagggtgtaaatgaataaaccgcgaaactcacttataggtctgacctataagtgggttttgcagattaaatacttattcccctggcttgaggtcgtcacgtacagaaacatgtcactcgtagccgtcctagctgagatacggtagcacgcgaaccagactttgtgaggcctaatgtctagcccagactatccaggccacatttaagccacatgcctagcccagcccagttggcaaggtaagtagctgaccgggacatgttggtgtgtaatgcacaaaatcgaacgaggaatggctctttgtaattcagatgttcctatagcattttcgctcaacaacataattggaatctacaaccagcggcgcgcggattcaccgccggaccagcacgcgggggaattgcccgggtttcgtctgcacgatccattgaagtctactgatttcgttgtgtacaagtctacagatttgctgatttctgacaaagttagcaggctaaactcttaattagaagccgtggaacaagcatgcttcactgtggctgaagtgattgagttgagtactagccatatgaatcatccttttttattacaaatcatcttgttgttcaactagtgaaaatttacatgcatgttaaactatgcttttattagaaaagctgctgtgtgttcaatttggtagtaaaatcggcatataaacatttgataagtcggtagtggttttatagagtttttattgatttgctcaggctgcttaaaatttctagttccgccattgtctgcaaccatgttttttcagcattcttttttttttaaacagtagatggtaggagttctaccggatatattagaagaagagaattgaccctatttataatgaaaaccgggcccaaaaaccatataactgcacagtttactaaagggaaaccgctaaaaccttgcacagaagacacaaaaagcctatgacaaaactacaaaccacagtagacatcgagagaagagcaaaaccttcaaggcgaagcctccaaggaggtgaacaacgacagaagccgttatcaacgcccacccaactgggctgggttttcacgcaaaaggggagagagtccacaaggcaacaccttcaacgaggaaacggcacccgtaggcgtcgatgtcgacgatcctaggagaccagactaggcttttgcctaagactccctcaaaaggtgtagagcctctaggaaaccagagccggagtgttgagtattatcgttgccccggcccatcggctaaacccgatgcagcagctccgactcagcctaaacacaaagactctagtatcgtagaggacaagcatcccgctcaacactcggcactacaacaggttcgcaccgacacagggcacttgaagcaacggcgtggccaaagagccctgactacagacaaactgaacctccaacacagacaaacagaacacctcaaccaccgaaaggctccacggccaggtctggaagcagacggccaaaaagaagggaggatcaccaaggagtgaaggaggcttggccggcttgaaaaggaactaagagctgagtcaggggcaacaaagacatcagtgtcttctatgaatccggcgaggatctccgggctttgcgagacacaccaaacaactgagcaaccacctcaaactaaaccaccaacgcagagagaggcgcgctggggcgaggagaagagcaactaagaagaaatgctagtgaggaagggatggggggaagggcaccggcgcagagagacggcagacgccccttttgctaggagacgacacagagaccaaaggaggaaggaggaagggaggaagagaataagaagtgggttgttgagggggtggcctcagcaaccgccaaagatgaagaagaggcaggagaccagagatgccgacgccctagaaggccgactcaccccgccgaccaccgaaaccggcaggcgccgcaacgccgccacgcgagcgcgacggtgaactccgccgcccacgtgccaatattcgcaccgccgcgcatgcctgtcgccactcgagcgccttgcgctgccgtgaccccgtcgcctgatgccacagcggccgccgccagccgcaccgtccaacaacaccgccacagacgctccatccagatccagcgacggcggtgccggatctgtccccgacaagccggaaacctcgccgctgccacccccgccacgggcgaaaaaaagccacctcccccatgcctgagagggggcaacagcgtggagaagccccgccgctgccatcctactcaccattcggctttgccagtagtgagctccagtggcggcgaggtagggggagggggtgacatggggtcagcaccggcggtagggtttcgcccaggtgtcacctgcgcgtgggagagggggggggagagggttgagtctaattctattatgtctaattctaattgtattatgtcttgtaatttttcagctttcacaaattgaataatattaaagtttcagcttttattttacattccgactctctggcatataaaaggagaggagatagagaagcaatactaagttgcgaaccgtattgtcaatcgagaactcccatgagatctacactaaatttagtggatcacgagtatcgtacgtgtagtgtagcctaccataggattgggaggccacaggaagaaaagtagtgtattgcaaattggccatccatccatatatgtcttgaggacgctattcattggggtagcaaactcagtagcttattaatgtagtccgaattaccaagcaaacatagtacaccgtagaggcctttggctagcaaagcaagattgacgacacatataatgctacacatgaaagcaagtaaagcatgtcgcagcgtttgaataagtgaaattgataaaatgtaattacggcggctgcaagctgattgagatgagagcaggaggagaacgctggtcatagtaagaagcaattgtgacaatcattgcgatattttacatgtatgcaaggaatatataataagagcagtcttttcaacgtcctttgcacttacaagttacaactcattttactagtaataatactagccttttaaattcaggcaacgcggtagctccacgttactaattagcaaaactaacacgaccaacaaacgaaaactaaataggtactttctccatttcacaatgtaagttattctagcattttgcacatttataacaatgttaatgaatctagataaatatatatgtattaatatctagattcattaacatcaatataaatgtgggaaatactagaatgacttacattgtgaaacggagggagtacatcattgctcagatgacttgcctattatattttctcacttcatatggaagtccatataaactctctaaattgttactccctccttccctaaatatttgacaccgttaactttttaaatatgtttgaccgttcgttttattcaaaaacttttgtgatatgtgtaaaactatatgtatacataaaagtatatttaacaataaatcaaatgatagaaaaagaattaacaattacttaaattttttgaataagacgaacggtcaaacatttttaaaaaagtcaacggcatcaaacattttgggatggaggtagtatgtacttgtgttttttctccaaaaactttacgtgccagcatattgcttagatgacttgtctattctattcttttacgttataggagaaagtccatatgtatatatacctccaaattttgattgaaagtctgtctagcaacctaaatcttaaaaccggacattcaaaccccaaaatcatatttttaacccaaattctcatactaaataacaacggaagttatatggagtggagtttacaagggtgtagcacgtactacgtgctacttcaaccgtagataaaacaagggtagcgcaagtgacaaaagcaaccgggaaaaacttcgcgagatctgagagagtcgatcgctactactgctttcgcacgaataatgtcgcacacagcttcacacacatatgattgggaggcatggtgaattaaaggtgcacatgacgacttcaccaaccatccatagctaagggtgtaggagcagcgaggtcgcaaacactctagatgcagtagaacctatctagtttagctgtaacacaagtgcctctctctctgttagtacgtccttgtagcttcgacgaccgagtaagcagtttagagcgttggatggaagcaaagcgataacatcagttctgcatgctcatacaccagcaggcaaatgaataacacggctgagagatggactttagcaggagttggttgaagcttcgacacctactgtgatatgaagtgatggctggggttggctgcactgcgtgtatgcaacacgttctacgtacagtactggggtctgatagaaacacttattgtgaaccacagtaattttaagccagcacactgcaccatggcacagatttgcccacagatgtttgtttgcaaaaatagagaatcaaccaataaccatcaatggggaaaaaatttatatatgacataggatctatcggcgcgcagtactttggcatgatgcagatcatatgttgggagttttacagattttgatggttaaactatctcttaacaattgcgagggcctgtttgcaagtgcttttggcatgtgcaacttttcctaaaatcagaagcaccccaaacaatttagatattcattcaaatgctaaaatgttgtagttatagaatccgggaaatgaactagaaaccaaaaactgggttttctaaatttttagaatctagctaccaatcagttatttcttaaaattctgagtcagcggtgtgtctgcaaagcttacctacgcaccatttgtcgccgaagattgatccattggatctcgatcaagcaacacaaaattactctcgctgcaacatatattttctcggctcaccacccgaaccctagatctagccgccagaccctcatccctcctcattcttcttgcctccgtcgttccccgctgccttttctccgccaacccctagacaacaaccctgccggcggccacctcccgccactagacaacaaaaccgccatcgctagttctctgggggcctttcgagggcaaggcggcaaggtggcgcgcagccgcacgaatcgattcaagctctagctagatgcagcactgaggtaaacatcctcacacataaaacttccctagttaaaatgcaacacaattgccccagcagcagcaggtagtgcatgaacaaccacgcaaacagtattctggagggctagggttagtacgacaaaggttgtgggtggcaatgcaagaacgctggaacaaattcacgggagtgagattgcgtgcagcatcacaacagagtgagattgcaatataacttgcctgtaactttttagagaaacactaggataaggtcacgggatataataccctcacctatgcatgcactgtgactttttttccttcctcgcttgcgtgaatcttggattgagtctaatgatctaaaattacgtgaaaagttacatacaagttacactgtatagtatgtatgttacaatataattacactacaattatgatactgtagttacatttgatattttttcgagaaattttgtcaagaaatgtaaataatggttcggaggtggctaggcgatgaagctaaagacctgaggtccggcccaaccacctgatgtacagcacaattctttccagcttaaccaaactgggctgcacttgtgttacaactatgccataataaatttaatagttttgagaaacacgattataattcaccttattgtaaggatgccattgcatccctttcaaaattggactcatgcttgatatctatttggaatccttttttggttattgtattttttatggaccaaaatacccctgcatacactttagatccatatgaacatgcttcattttagatcaaaacccaaactgcaacgaatcattgcgatgatatatctatcacacaaagagagaaaaaaaaagggagaatctaggataagaagaatttacgaaggaaaaaagggaagaaaaagagccagtcgaccccgagccggccatcccctccatgccgtgacctgccgtccccaagctcgcactgccgtcaaactcgatcaccggccccgacatagctcgccaccgccagatatgctcttcaggtctagctcgtgcctcgtacaggatggcatgaaaccaattttgaaagagttgaattagcatgatgaattatattagcattctttgaaattagcaaatttataatggtttggatccaatgaaccctaaataaaattggccaaatatacctgcaatcccattgaagcccaattaactggatatgtgagcctccctctatcctgcttgggcccaactgaaatgatcacggctcacttgggctgaaatttctgagcttttaagggctattttggtttgaagccaaaatgtgccttaccaatgcaaattgtttcgcactttgaatagtattttattagtgtttggtttgataccaaaatataccaataacatacaaaaagttactaaaattttagcacaccaaaacttgcctacgttttggtagtaccaatatttttggcatggtagcaaaccagacacatgctaagtgacaaattgttctttcgatgcccagcactagctaggccatggcaattgcttgactgtcccttgtatagtacacacgcttaattattgagcattcttccccacaaaaaaaaatattattgagcattcttcactagcacatgcacatgtacacattggatgccatccaaaggcttatgttaccatgtatcatatatataggagttttacccccaaaaacttgcaacatatgctacttgctacttctgtactagataaaatgagagtggagagaggcaggaaatttgaaacttctccatggcatcaaccgtccacgttattccaatgagagatttccacaattcgcatgcgtgtaccttagctatggaataacataggattaggagatatcgtgaagcacatgagtgcattgtgacccagacaagtatctagtcgtaaacctgttggagcgatgaggtctctagctcttgattcagtaaaacatctccagtttgactgcaacacagctgcctctacacttgtgtcctgaactaaacagccaagcaaacagcgtggagggatggagagaagcagtgcaactgcatcgaattctactctgctcgtagacgggaaggcaaacaagtctcccagatgataacttctttggtggagggatgaacgagacgtcgagacactgagctgggaggcaaccaacttgtgctttctcttacttaactaaatattgaaagtagctagcttgttgatggcatagcatttgaacatttgttttttctgcgtagatatatatgcagcagggtaacatgcagacatattagaacattttgaagctagaaccatccgtatatcccaattagcaagttcgtatgcctctcatatacggcatcatcgatccttcgttagaaaaaaatatagattacttgtacgaggaatcaaaatgcagaggcagcagccactaataaaaaaccctcataggtatcggctcataggtgtcggttcatttaaaaccggcacctattaatattttcccacttttgtgggatgaaaaaaatatagaactggcacatatgagtaaactatatgtggtagttcagagaacaaccggcacttattaatattatatgtgccatttaaattaaaaattgatacctataatatattataggtatcggttcttaaacaaaatacacccaatgaattaaactgagacgagccaaagacctggtgggaacttttatttgactccaccaacgcacctaacaatcttaaccactcataatgtctctccaccgacaccaaactcatctctctcacactcttctccgccgtccctctcctatgacgcctcctctccctcctctcctatggcgcctccttcccatcatctcaccgagcaactgcagccgcggtcatggtggcgtggaggccaagtcgggggattcggatcgtctaacttcgccctgtgaaggtacgaacgtacgtgtgcagtcacacttatccaccatccatgcaatccaccatccgctactgccttcaccctcgtattgattgttgaagctttgccattccatcttcctgctaggactggatgcatcaatcggcagtcatgcaccatgcttgctgcgtggaatatggaacacaactaaaatgagcggagcaaagtatgcattattgcattggattctatattgagcatacaaagcacgcattccatcaggcaattcataagtttcaaacaacaccactcattactaagcacaaatttacactggagagtcgagcgacaccgcaaatcaaagagattgtgaatagagtataggttgacaagaacaaaagcagcgccctagaatacaatctccatagctaaagtatgtattcagtgccatcagcagttggaaaaacagacaaaattaacttagcaaatttggtacttgggcccggcaacaacaaaaaatacttcagaggcggctggtgacagccccgtactggcagacgagctccggccgtgctagtggccactggtggcggcaatgacagcgctgagacatcgtcggactgacacttgagtgcgtcttgttgggttaccatcggcttcaaatagactttatcagcagttaattaagtgcatgcgtcacacgagccgttggattgcatggatggtggataagtgcgacatcacactcgtgccttcacgggtgaagttagacgatccgaatcccaagtcagggcagtttgcactgtcccacccactgcagtccgggctcttcctccaccgccggcgccgcaagatgcaaggcggccgtcggggtctctggagatctcctactcaagaccccttgctgtgcaaggtatgggatttttcccctttttgtgcctgtgattggtttcttgcatggtttcctcaagggactgatttcattgagatgggattgggtgtagttggcaaattggaacgtggtgcatcgcggatggcgaatacatgatgtgcgtgttctgcagtgaggattttttttttcatgttgaagttaaggatttaggggattattcgtgtggggttgatcttgatttgttgatttgggtgattgttgattctgcatgttcttaatctgatgttgggattagggcaatggatgttcattcttggtctgattttgggaaattggtttgggctggtcgaagcattggctcatagagccaatgctacgagccaacttctcctctttttctaatcgtggggagaataaaggtgccggttctaccaccagctccaatgactcaagggtattagtgccggctgcaaatcgacacctatgttgggtttgcaacaggcatctaagaggggttctgcagcagtgagcagcgggcacgaggaggcagggagattggtggcatggatgctaaggtagaggatctagcaagtaacaagtcatgatgtctagcccatctggcccaacctaactgagccgcatgtcatccgcaatcccgttcaggaccaaatattatgggccacatatcagccacaagtgcattccatcccacctgacaatggtgacagctagctaaactctcttttggggtgaaatatttgaggtacatgagggtgtacatagccaacaagataaaacaaggaatggttccttgtaattcagatgttcctatgccctttttcgctagctacttgcaacagaatgtttcttcagtgtgcccaagttcaataacatccaagttattatggactttatgaggtgtatgatcatacattatatctgcattgtatgtgttgcttcctcagtggataaaagctagagtataaagtgaagcaatacccaaacattgtaaatttagacatcctatgtgggatttacataccaacgataggttcaatacttcattggtgtaagtctagtgtagcctacacacattggattgggagacgaaaggaagaaaaatagcatatgttgacttgaccaatcaaccaaatcagatcaggactgcattgatgtcttaggccttcttctttacttcaactttttcgttttctgttagcacgtttttcaaaatgttaaatagtgcgctttttaaaaaaatctatataaaagttgtttaaaaacaaacaaatcaattatttatgtttataatagttaatattaattaattacttcctctgtttcaggttataagatgttttgactttggtcaaagttaaactgctttaagtttgaccaaagttaaactgctttaagtttgaccaagtttgtagaaaaaagtagtaatatttttaacccaagataaatttattatgaaaatatattcaattattgatttgatgaaactaatttagtattataaatattattatatttatctataaacttggtcaaacttgaaatattttgaatttgaccaaagtcaaaacatcttataacctgaaacggagggagtatgtgttaatgagctttcccatttcgcgtgtatgagaaaattttcctccaaacgtttgcaaagaacacacttgcaattttataacccatacacaatgtttaatgagtcattcggtttatcctaatgttataatacttaaaattggcggatgggtcagatgattttagaacaaaattagttggatattgactatttgtggaaggaatttttttacgagccacaagcaatttgggacccgaatgacaactgcaacaagttgtaggacctatatatatctgcgagcatgtggaccatcatttaaaacataggaccatcacaatcctcatggcaaatggacagatggaagtggaaccatctcatcttaaaacaggggtgagtccaacccatatcttgtttctgaaccaaacacatgcctagatgacatagacgagagaattttagggacttcgtgaccacatgctttgtcaagatccataaaaagaataacatttatgttaaaggactttataaaaggttctaccaaataaaaaggacagcggaaaaaaagtgggaagtgggcagctgacaacttctcgactagaccagtgcttcacaagcgaaccatgtagttacattacatacatagaaatgggatgcattgggagccaaaagagtgcgtcggcagcttgtcgtccatccaagatctcctgactaccagtgctttggttgcaaagtgttgatgcagataaccctctttggtttaactgtaacagaaatgcccgaacaaatcgatctcggtcaaccatgtaaacagtgttgaggacgaccggaaacgatgaaatggaaggggtagataaaaagctgattggctgctttcagaccaggtggaagttgtatggctgttatagaactcattgaattcttggtagcgggctcccaatattgtcgaacaaaaagtttccatagaaacagcactccctccatactcgtaaaggaagtcgtttaggacaatgtttaagtcaaacattggaaatataaatcatgatcgaataactctcaagttgttgagtttgaaaatataaaaattatatgtatagatttgtcttgaaaatactttcagaaaagtatacatatatcacttttcaataaatatttttatagaaataagaaatcaaagttgtgttttggtgaccgtgtcgctgtcctaaacgacttcctttacgagtatggagggagtatttcagaaacacagtaatatataggagtattttgatgtccattgatctacaacacgcttactgcaggcatacaaataaattcaatttcctcaagtactgaaattcagtggcagcagttcatcccaactgcacaatcgtagtgattgcgtcaaacacgagagatatatagtatgcacattggagagctaaccattagtcgatttcaagaatcattcaatgacacaaagtagatgatagacgtcaacaaaagcgagattttcagaagctgataaaggttttcaaaaggagatcattagcagttacccattcactcacaaaaacgactaggcttgaaagagatcaggaacgacagtacaacagccacaattgcgcagctgctggtcagtggttattacacttggagttcatacgaatcaaccagaagcaagcacataatagtgtttttcttcaagcatgcataatagtttttgcatcgaataataacttttccaaccacaagcagatttggtcctcagacaaaaacaaatcgacactatatatcatgtgttcagattctcaatgat

SEQ ID NO: 51363 - DNA, 12668 bp, Oryza sativa
tattggcaaaaagtgagaacaaaatctaatgagataaatgtcattttttatataaatacaaatcaatatccatattggctcaagccaaagttttcaataccagtcccaagctcaaacattatgtaggttgtaaggaacatattgttggaattaatagatgggccttagcccactcgaagtttaattctttgaaaaatcagaaaagtccaccacatgcgatggcatgcatagcgagtttagtaccaccttacttattctaggagagagggatctccttagggaggatgccctcctagccacttgaagtatgtgagatggagagaagagggggaacacacgcgcttgctcgcttgccgggccgggcaggcggcgcgcgacgtacgcatcgaatagatgcagcctgcttttgcagttatgttttgctgtgtgaaattcggatttgttttattttggaaatattctgaaaaatccgagaaaattcggatttgttttgttttggaaatattccgaaaaatccggtgcgtgaaaacagacttaaaattggttcctcacccttacgcagatgcagcctgcttttgcagttatgttttgctgtgggaaattcggatgtgttttgttttggaaatattccgaataatccggtgcgtgaaaacggacttgacaagggtgtgtaatcacctattatttatgcatagtatctcctccggtgcgtgaaaccggtcttgacaaggatgtgtaatcacctattatttatgcatagtggcttctagttctcggaaatattaaaaagagatagagaagcaataggcgagaataggctagctgggaacttcacagtaagataaataacaatactactctgagattcatggcttgctacttgcctatttggcatgcatgtaccgtggctacatacataggattcggaagtattgggaatcaacagagtgcgctatgagttggacaaccatctaatcccaaactagtgtccactgcgaggtagagaagtcctgatagagtaaaatctatctgttttcactgtaacacaactagctgttgatgcgaaaaacacacattgatctgtgagatctgcttagctccagtcaaattttggcgttaacatcagctcttcccacaggctcttatcaagcgagcacaaagtgcggaggaaagacttaggccttcttttcttcaactccaacattttagttttccgttagcacgttttttggttaaatagtgcgcttttaaaaaaatttctatagcaaagttatttaaaaaacaaaaaaaatccatttttaatgtttataatagttaatattaaattaatcatctcttaacgagctttctcgtttcgcgtttatgaaaaaaatttcctccaaacgtttgcaaagaacatgcttgcaattttataacccatacacaatttatttatgactcatattgggtttattctaatgttataatgtttaacattgattgacaaaattggttggatgttgactatttgtggaaggaattttttttaacgagccacaagtaattaatttgggactagaatgacacattgtaacaagttgtaggacttatatccatgagcatgtgggctatcccttaaaaaataggatcatcctattcctcatagcaaatggatatagatgaaacgtaccatctcatccaaaaataggggtgagtccaacaaatctcattttgttactgaaccaaacatatgtctagataacatagacgagcaaattttggggtttgccatgcactttactctgctttgtcaggattcataaaaagaataacatataacttaaggactatataaaaggttctaccaaataaaaaggatagctgaaaaaagggtgggaagtgggaagccgacaacttctcgacgaggccatgtagttacattacatacatggaaatgggatgcatcgtgaaccacaagagtgcactggcagcgtgtccatcatccaagatctcccgtgtaccagtgctttcgttgcgaagtgttaactgtaacagaaatgcctcaacgaatccctggagatcaacaatgtaaacagtgttagaggacgacctgaaaaaaaggatgctctcagatctctgcacgttggaagctgcatggctgttatagcactcactgaattgttagtagtgggagaacaaaacgttgccatagaaacagtatttgagaggtacagtaaataggactatttgatgtccatcaatctacaacacccttcttactacatgcatccaaataattagattcagttttcttatgacctgaacatggtattacactggcactggcttgacgcctgacgcaagagccagacagtaccgtggtgcatattgatgcagcaagacagggatggagactgctacaaaccctgaacctgaactttcgaaattgtgggttcctagatgttggttgtcccaggcatgcatcatatgcatagagtatatttttgcatggaagggatctcctgtaaaggggacttatttggagaactgtggatggtacaactatttttagataatggaagttctattggtctcagtcaattacatcaaagtgacccaattatcctaagaacactctcagcctctgcatagctaagatgcacacagctaaaacacactaaaagaaagacatcaacagtagtattaaggaccatcaattctgagactagatcgccactcatgtttccgggtaaaacaatccttgaggatggtacaactattgatgtaaagaatgataattggatccctaggattggagtggactgcttaaaccactgggtttaaggcaaaataatggtgtaatcaaagttaacgatctctttcccccagtaacaaaagacaatggagtatggaaagttaaccactggttccttttacttcagctgtacccgtagcatctaatttttgcaactactacttacaaccacaagttttgccagcatgcgcatattaaatgacattcaagttatggacttgacaagggtgtgtaatcatccattatttatacatggtatgtcctagttcctggaaagattaaagagagaaccaagaggcgagaattggctggctgagaacttcacaataagataaagttactataccgtgagattcatggattactacttgccaatttggcctgcatgtacctcagctacaaacataggaatgggaagaattgggaatcaaaggaacacaccgtgagtttgagaatctcatctaagcctaaactagtatccatgtagatttagagaagtcgtgatagagtaaaatctatctgatttcactgtttagggcatgtactaagggagagtcaggtgtgagctctatatcatcaaaggctattatcttaccgcagttgagacaaccattaatgtaccaaaataatcttatctttctcttctttcctttctttcaaaccacatccaacaaaatattttctaataaatgttaagagtcgactctgaactagtgttatgcgtaatgatcatgtttctctttccatccctctctttgttccatgtcatcaaatttatttgcacgataatagcgagagcccactagtaaagaccatcgtacataccctaacgcaaccagctctttccatgggctcttagcaagtgagcacaaagttccgaggaaagccaatggaagttaaaagatttcgatcgactgtagcctcctgtatgccagctagcgggcggacgagttgatcggttagatctgcactcatatggaaaggtgcctgtcgtcccttttttcgttccttattttttgttcacgttaattttttgttttccctcctatattttgtattttgtgtatataaatgccttggaaattttgttccgcatatatgaacttttgacacatctatatatatacatatatgcatatataggcacacccaatgaaatttccgtaagtatattacatctgagtagttttgaaggcaatcaagtatattcatccacaggtattttaaaactttatacccttcaattgaaagctgctcccagcatatggtgcacatctgaggtgaattattgctctgcaggaagccaagcatacactacaattatgtgcatgaatacattttttagataatgatgtgtaatacgtactggcagataaaaggggacttgacagaggacagaaaacattcagaactacaaacgggtttggagctcagacatgagagacacaaacaacacttttagtatacacatgcataaggcatacaaattaaggattggatcattggaaggtatcggcaatcaagctagttgctttgcaatttctaacagcttccccactacaaaaagaggcagtatttaggtagctaaatcttgctggtttactacattttaggctggtttctatctcaactggctagtgtgttttatgttcaagcgaatgcactatggagggtgcgtgcatgatgctgtcaggcgccttgcaactatattaccctggcatctgcttgagtaagctccattacaagaatctatcatcaacggtagcaccgatttccgataaattgatctgtcttgtacagatccgctgatcaagaaactttcatgtgcgaagaagatcagggggtacaaaagagatatctgaaaagtttattcaagacaaatgagatcgtgcaggatacaaccattagaaatttagaatttagccaggatataattaacttgatagttgacatggccataataccaagtatgcttgtagaaacaattttttcagtgttctccactgatgatataatcaatttagaccttccatcttttctcatccaatagacattatatatttgataaattttaccaccgaaactactagtagaatccattgaaaaaattgttggtagttggaacattttcttcagtagctaatagatatcataaagcaattgttcatataacttctggtagtcataatacttgtactatttatcgtaaaacattaccattagagataaccctaaaaatactcgcttgcaaaatgagaattcgttgggtgctgaatatgaaggacattgatactccaattgccccaatattagtctagtgaaatattttaaaccgttgacaaaaaatagagcgaaatttgattttgtttattggagtaatctaatactattttagctccgtcaactagtagcaagtgcatgcttgataaataaaggcatctaagctcaacgtacgaatgagtttactaggggagtacatttttgacagatttattgttactttggtcagataaaaagagagcgagagggcattgtgtcgtccctccacatagctgcagtcactacgccagatcagtcaatctttgatggtccatctctgatgcacagatttatattgttaatttaaagttttctttatactcttccacatataaactctagctgaagatcaaaattcagaacgtattggtgggagacgttaaaaagcgcttgtcatgcatatagtgaatttccaaataggattgggaggcattggtaatgaaagaactccgagagcgatggatccagcatccaagactttttagctgtagcagaaagtgtgaagcaaactctctctccatcgatttgccagttttcagatgttttggaagctaagttgcctctcgcgctctggggcaagtgtcagttgctgttcagaactgtgcacagtacgactgcctcaggtgaagctagctgtgttgtgcatgtagcttcgacgattggaaggagagatctagcagctgtacgactttccaggatggggttattcgagtgatcgattagggctctgtttagttccacatcaaaattagaagtttggttgaaattggaatgatgtgacggaaaagtttgaagtttgtgtatgtaggaaatttttgatgtgatgaaaaagttggaaatttgaagaaaaattttacaactaaacacagcgtaggtgttctaaacaaggataatcgctaaatgaatagagcatgcacccataatgctcttactccttaatggaaaaatctttcgaaatgagcttccctcgtttagtttttagagggctttatttaaagctgatgttcttctgcatatgtgcagaatgaagaaacctctaaaagagatagttttttattggttaccaacagtgtaatcttttttctagtctcttgtaatttgtaaatatctttttttctataaaatcacactgcgaggcaaagtcatgcagtatttccggtaaaaaaaatattcgtcatgtagataagtaaccgtcgtaagcgtaatctgcataaaatctcgatcttaatttgctttctacatatagtagtataatgcggcatagcatatatatctcctacttcctcttccaataaagctatgacaaagaaagccaatcaggggaggagtcgagtccgaacatcatgagaaggaattaatctgaaagaagtatataacgaggcatcaacagaaacaaaatcatgcggatcttccattgtaagaaggcacgatgtaatttggcaatgcactcaaagcaatatgggtaaaaatctaacaaaaagtactagtaccatacttcgtcttaacggtccaacgaaagatcgaagacgatacgaaacacctttcaatacgtgaaaattctagataatgtgtatacaagggaaacaatatataataatgactcgatggaaaattaatctgtacttttacttatgtgcataacttatgtttaattgtcgaaacaagattttggcaatacgaaaagggggtggctatcaagctagaaaagtggatgggttttgagacacagagttttatacaggtttaggccctctcaatgagaagaataccctactcctgtgcggagattgatccaccgagtgtattattgatcgtatgatctggaaaaaaagttatgctccaagagacacccggacccctccttatatagggggaggagtccatattacaaggtacaacccagtcggatacgaaactgactaagaggtgagtaaagataaaatataatcgtaactgactaagactcagggtatttccttgatacacaagtttggaatttaacccgagtcccttaaagatattctatctacatacagtacccctatacctagtcggatatacatgccatgtgggtatggggtatccataatctccacattaattttcttaacaaagttagtgatcaccagtcattgtttataactaatttatacttgtaccataagttgagtgaaagttggggattttctataaagtagtgaacattgatgcaattcaacaacaatgtactgaatattttctgttgaaacattcgaccaaaaaatctatacctatactaattgggcactttctacgaactctcacgttaattagaaaaatccatccgttaatcgagtagacagtgtaatcttaaccgtagattatcaatctccttttaatcgttttaacgtgatgggcctggcaaagcccattcaatctgtcctactgtcacccacctacgtataccttttcttttttttctaatattcttttaatcctttttaacgtgatgatggaccagtcaccagggaaacatctgtctggctgtctcccacataagaattttaattctttttctgtttttttcaatacgcgagtactactattttctttcagtaatctgttgtcgtaagtattcttttccacagctgtacgtccaaaattggtagaacggcataattgcattattcggtagatggcaaggattaacgcgtcgacggtagtccttcttcatatgcagatggctatggcgtacgtcctgcaaactctccagctctgatgattttctcaccaagagacatcgttcgaattgatctctctgcctccggttgatattttcttaacaaagatttggttcaatttcttttgtttaattcataactcagctatgccatcatttgatcttataaattcaggtgttatttgcatgtcgatctagaattaaacaagttcacttgcacccaataagatcgggagtggccagtacatctgcacagcattataaggaagaagcatatgcacacacaccccttaatacgcacctaacaaatgcatactcaaataaacggagattagctgtaaaaccaaaaaccatagccttcatatggatggtaagtgaatccttacataactttcaaatatgactaatttaatattttttatgttacttggcatcatatcctacaaatatgaagaactgaagaaaacaacacacacatgagacataagattaatcctatttcgaattacatatatagatatatattttatattatactccatgtggttaggtgaatcttattaccagctgatcaacttcaagttgagaatttgtttttaaagtaaacattccaattgcaatatgtaatctctttagcttttcaacattgtctaaaagcaagattccaaagtccaaaccaaattaaaagtacaacacgaacaaacatgcatgattaattcttaatttcgaaattattctatcaagtaaaattctcgatcgttactgaatactaaatctaggatcattaaatcatggaaaaacagtaactaacacttgaaacaaagaacatttcaatacttattaaatagtattaacttcacaactattaaatcatgaaaaacctataatcaaggtcccaaaccgagtacaactctttaatagttaaattttggagctattaaataacaatattctataatcaacacttaatgtccatactgggtatagtcgtactaactaattttaaaatttcaaattaaataatgaaaatgataaaccatgactccatagatgcgtgcaaatcaacagttattaattcttatttttaatattattaaatatagaaaataaaaaataactagcagagaaaatattaagatggatgactcaatatttgtgtatttttcatttttcaacaatcaatcattctgctgtgtttagaacattaatataaagtctacatgtaaatttaataactaccgtattggacatatgataaaatttcaatattaataataatatcccgtgcaacgcacggatagacggctagttatctgaatttaaagacattgttcgattataccagttagctagctgacattcagtatgtgcgcaacacactatcgccagttccctttgcttgatttcatcgcatttaataagtttggactttataaggatgtgcaatcacacagtgtgttttcaactgtatctctccttaatttcctagaagataaaaatgaggagaaatagggtgagaacagggcaactcacagctagcatctcggcaaagaccagtgcttcacatgcttacaatgcagttacgttacaaacgtagaactaggatgcatcgggaatcaaacgagtgcattagcagttagccaactatccaatagttcttatccaagttttgatgctcttgtttagctgtaacacaactacctctgccaatagcttgtggccttccggtcaaccgagcaaagcattttattgcttttagtttttcagtctctgccgtctccatattttctagacacccaagagtcaaaatgtctcatagaaatagcatggttgtgcttcagaggtgctcattgggaacttttttcatccacacacaaaacgaggtagctcattagcatatcattatttaagtattagcttaaaagcttcaaaatggattaatataattttttagaagtttttctatattcattttttggaaaaaaaattgtaccatttatctgtttgagaagcgtgctaacgtgaaacgatggggtagaatttgggaaacatgagttacaaaggcagctaagtatgaaacacagtaacagcagtatcgtaattccgaagccaatctctacagaattaattcttacgcatgccgtcaaaataaattcagttttctaattgaacatactaggtaactaagatgcacacattaatagattttcaattcagaggcagtagtttatcccaatgcaaaatcatagagttgtatccaatataagatgaaatatacacattggagatctggccagtactagttgatttgacaatttctctcaatgtcaccaaggagatcatagaacacgaggcagctcatacacatgaacaaaagcgagaatatctgatccagattaagggtgtgtttaattcacgctaaaattggaagtttggttgaaattgaaacgatgtgatggaaaaattggaaatttatatgtgtaggaaagttttaatgtgatgaaaaagttagaggtttgaaaaaaaagtttgcaactaaacacggtgaaagaatctcatatagagagccctatagcacatacccattcacacacaaaaacgacgactatgacttggaggataccggaaatacagcaggcacagttgtgaaagctacaggccagtggttaattcactttttggccgtgtttagttcccctattcccaacttcctatcacatcgtatcacatcaaaaacttttctacacacataaacttctaactttttctccaaactaccaactttcttccaactttctaacttttccacatctaaacatagccttttttttgaagcataaaccgatcaggcaacagcctcagcagtacatttattcgatagcaaccgagagtacaactgattttgcaaagaagcccccgaaagtagggaagattacacttaaaacacaagggatgcaaagaaggacctgaaaagataatgaaaaagcaattggagccgtggcccggctgcagaagatgacgcctaggctcgaacccaaatggggcctccaagagtaggaggttgaagaagccttgacaagcaaagataatatcactcgcactttatgaatcctttcgccggagacgaagaagatggccaacaccaatgcaagaagctcgccagagaagaactgggcggccggcgcaaccttcttcttcttgggctagaggacaagtctccaaacccgagcaaatcagcggaactcctagttgtaggcgttgaaggggaacccagcaagtacaagagaccccgatcgatgagaatgccggtgaagtcctccatggccgcaagccgggacaagaagagcgaaaatgccggtggccttcttgagccgcacaacgaacgtgattaacccgactatgggagagacccaactaagctaaagctatacctattaaaggagaagccggacaccctcccctcttactggcgaccggagagccgccggattccgaaaggaagaggacatgaagaagcactagtatgaaatcgtccatctatgacgttttgctcgtgacgctgtataatttcgtattgaacagagcatatctatgacgaaatttcatgttttgtcagggatcactcatggtgggggtagacattgaaactccatgacgaaatttaaaatggcgtcaaaaaaacaatagataatttcgtcacaatggtgtgcacgattcatgctcctttattagtacaatttatgctgtaatagcaaatcaggttgtcactggacccacatataattaaagataaagtaggtcgctacattcgttttagttatagcccatgtgaactattttttctaaaaaatatgctgcacacctaggggtcgaaccaacgacctgtggaatggcataagtcaagcttaaccactacactgcgaagatctttcatgctattggtgtctcaattctagttttttttttcacaattcttgaacgcatgaatgattgaatgttttatgcggacgacctaggacctgcatcacctgctcgtggggttcatcataaagtgtggtttatctttttaatctctggctaaaacttgtaggtagtttttctccctatactaacttcaaatttgattattcctttttctaaatttttctaaattcatgatctatcaatttattgtgttattacaactattatttttgtcataccttaagggacttttttttcaccctgggagacgctccagttaattcacttggagttcatatgaatcagccagaagcaagcatatggtagtatgttttcaaatatgatattcctgcatcttcagacgccatgaaatatgcataaatataatattcgaaaacatacgcaggaatatgatgtgtcgttctttatactttgttagaagttgttatatttggttttcagccaagagttgtagcttatgttgaagtaaatgctatctccgtattttaatatataacgccgttgactctttttataaatgtttgactattcgtcttattcagaaaaaacttatgttattattatttattttattgtgacttgatttatcataaatatttttatatttgcacaaaaattttgaatatacgaatggtgaaacattggtaaaaagtcaacagcgttatacattaaaatatggaggtagtagatattatcaattatcttaaaaaaaggtgtgatcacttctcttaccacgaagggggccttgctcttcaaacagaacaaaaaacgggcaatttcatgtagttcatattctcatatttcgtgagattttgttatcttggatggctgggagattttattgaacaggcc

SEQ ID NO: 51364 - DNA, 2274 bp, Oryza sativa
ggcgcgggtgataacagtgaaatttggtaagcccaaagttaccatcggtttggagtcagtatcggcttcaaagttctagaatcagccgaagggagtcaagtcgccacgatgtcatgttcttggtggagtcgaatcaatcaaaggaagcttatctagaagagttcgagttcaagaaggatgcgatatgacagttatctgttaattaggcatagtttgttagtttccttttatctttaggaaagtgtgtttagtgtccgataagaactttatcttttcctttttagtttctttcttgtccgacaaggactagtatctccttatgggtataaatatgtacacccggggtcattgtaatctatcaatcttcacgatcaatacaattcagcgcatcgccaccctttttaccttttctactttattttatcgtccggcgtaacttggcacccgacggagggctgcatcggtgttcgatctccggcgaaggggtaagtccaatgttccgtcggtctaggcagttgtatcgtctacgtcggcgtcgttcaaggctgcatcagtatattcgacctcttggattgctctggtttggatgatatatttgcctacctatttatcatatgtctctgttaatctagacttagcatatcaatttagctctatcggctgcttctggttttagggtttctgccggtatcggctaaatcgtgttgctagattagattagcttagacatctaccaccttaaaaatcagtcaacggcttgattgtctagatattatgtttcttttcatacttagtgctgcatcacttaagtttgatctactaagtcgtgcttaaaaccataatctctatcctgcttattgattgccaacaagggtttcatcgcggtttcagccggtgagttatctgaacgttgcattggctcataaggattgcacatacatgtaagttggatttagccgatgacaacaaagtttcactgtttaatctaatcttgtggatttcatgacatcggacctccagccgatgtgtgctttaaccttcggatcgatgcttatttatcatatcattgctagccgattggtttatactggattatattgttattttattgcatcatcatcagccgattgcctttatatcattatctacattggacatatagccgattgcatagaccctatcgctatcggctggtatcggcatcggctattattggctaccaggctggaactactccatcggctgtctagccgattggctgttttgatctactacttgcatatcttgtcagttgcaggatcaaactgactggcacgcccgcatctcatcatatttggacctgcactggagctaagcagatctcccaggccggtgtgttcgattttttcgtcaacagcgggcaggcagcctgcggcggcggggggcacgcggcgggccaggcggcggccggcggcggccggcgcgggtaggcggcctgcggccggcggcagcgggcgcccggcggggccatcaacgcaggcggtagccggagtcctcccgttttcttgcctgcagctggagtcctcccgttttcttttttcttttttttttgtgatttgtgattcactggatgtataatttctagaatttgtgattcattgcatagatttgttatgtgttttattttgtgtgtaatttatttaaggatttgtgatgtatttgatttgtgtgtataagtaacttaggatttgtgaggtgaatgatttaggatgttacttgatttggggatatgaatctcacctgatttgggagaaaataaagagattaatagtaaattaacaatgaaaaaaaaaacaaaagcggatcaaccgggacgtggctctatcatctttagtcccggttggtaacatgaatctttactcccgggaatctgaaccggtctttagtcccggattccttctcccggttcgctacctgggagtaaaggtagttgtgaaccgggagagatgtggggttctccagtagtgatatataagattggcatacgtgaggtgataccttgaagagaatgacactgctagtgttggcaccagtaaaaaaaatggttgcttaattttctggacatagacatacagtagaaatggaaggtattgggacaaccactacaatctaatagaatcgataaagagttaaggcattccttcatgctatgggccctaatatgagctcgacatattcaagttatgagcatggccgacaagtttatagctaggctcgatcgagcttggctcgatc

SEQ ID NO: 51365 - DNA, 7405 bp, Oryza sativa
  unsure (1)..(7405): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccattccaggtgctgttctgataatagctattgctagttccatatcctggagcagtctgatgaccaccagcattgtaatatgtgttacttgtgggaccaacgtaagactctgaattctgaaatgaagtaagaggctgatgagctgcacctgaatgttgatttgttcctccttgctggacagaagaaccatttgtagtttgtgggtaactataataatagtttgcatattctgcagcagtgtacccatgttgaagtgaacttgagtaaggcatgtgagaatgagtcgcattttctgtgcccatagttggctgagcattatgaggtgcactgcttgccacactctgattgtctcccgaaaccgaaacatccctttgtggatcatagtaaactgtatcttggctttgattgttcactggatagctccacgggactgtagctgccccagttgaagaggaccatgaatgatgccctaaagctaaaggtggataagtagatggatttgtctgccccacaatgctgacctgccattagcaaataaaggggtcatgaactcatgatcatttatataatggcataatgcacatagcaacttagttacaaaagccatgaccaaaagattcatcctcactgcagctttaaccatttcagtaattcattggcaaaatgctttaagtcagtactatattgcaactagaatgattcgtacaactaggcttccatacaaccatagattctcagaattaacatgtagttctacgcatagcaaagacgttcaaatccgatcaaacttctgctctaatttttctttgcaaaaattcaacgaagccaccttgcatgaatagtttagttcccttggctaaattttacttctaccaatcacccacatcctcaaattagcttaagtttggtacagtaattagcataatatcaaattcgttgcatcctaaatagacactaaataaacgatcacatattcaaaaaaaaaacaaattcaaaaatcaatagaacatcagacgaggcgcgtcatctacctcggcaggagcggcatcggatccagcagccaccaccccggcgccgtggctcgccatcattcctccccctcccggagctccaaccctagcgaaccggtcaaccgcccgccgccacgccaacgcaacgcaacgcacaaccgaaccgagctagcgacctcgattcgtcgagagcgaggcgagaagccgatcgatcggggggagagcagccgcacgcgaacgaatcgaaacccttaggcaaaggcgcggtggattcagggaggattggaatcgcgcgtgaggtttttttttttgtgtgtgtgtgtgtgggaagatgcgggaagcgagaggagaggcggagatgttgccagctacggaaaggaggacgattttttttcgcctttttgattcctttttttaccgcgtcgcgtcgctttgcggtttggtcgggtggtgtcgtcactagtgaggaggaggcggcggaggagagagaaggggacggtgagatgcgttcatgggccgttagatttgagcccatgggccataaatgattggtgggcccagcccatttggacccaacttctccacaaaaaaaaacggctgttctttttgtttatgttttgaagctattccattaatctctgccactaatgttgatatgatttcaagtgaattcctgtgactctgagcaatgctatgccattttcagaaattgccattgagagtgatgtgcaagagccaactgccaagtgcagcgtcagtgcgtcacactcactcactgttgttaaaattttcctgcggaggtctgttgaaactaaagctcagatgaaatttcctgaaactatccggatttcaggctaattcaactgctagaaccaactgaaacaaaagcacaaatgaatttgctgaaggaatacaaatgcaactgcagtaacagaaatatacaaacaaaagcacagatgaatttgctgaaggaacccaaaggctactgcagtaacagaaatatgaagtccgaaatattaaacgaattggatctatcgtcaaattaaagcgactcagacaccgtttgacattatgcaaattcgctgttcttattcttggtcaacgatggtcaaatcaatactactccctccattccaaattgatctacatataatttttttgaggttattcctaaatgatctacatatttgtgttcattcattaggtctattcgttatttgtgcattggagtaaatagacattgatacatgcatccatgcacacaagcatttataacccacatgcaatattttaatttgctattggctagaaaatagtggggatggtgcatgcattgagtttattgctagagtaaatatagaatgagagagttattagctttttttttgtcttggtgtacctatggaatatgtagattaatttggaatggggggagtatatcgaactgcaatgtagctagatatcaaccacttgttggaattaatgaatgggccttagcccactcgaaaattaattctttggaaaatcacaaaagcccgcctcatgggatggcatgcatgtggagtttagtaccacattgcttattctaggagatggggacctccttaaaagggaggatgccctcctagctacttgaagcatgtgtggtggagagaagagaggagaacacacgcgcgtgctcgctcgcctcgcctgacagggcagggcaggcggcgcgcgtgcacgacgtacgcgtcgaatggtccgccaaaattggttcctcaccttgcgctccttttgcagttttgttttgctgcaaattcggattcgtttttgttttggaaacgttccgaaaaatctggtgcatgcaaacggcgtggagtccggataagttacgcgtggagtgaagatcgtgcgggcgccctgatcaagcgacccttctctatataaaccgacccgccgtcttctcgcaacacacgtgttttgccgtaaattcggattcgtttttgttttggaaacgttccgaaaaatccggtgcgtgcaaacggcgtggagtccgaataagttacgcgtggagtgaagatcgtgcgggcgccctaatcaagcaacccttctctatataaaccgacccgccgtcttcacgcaacacacgcgaaatcaatctagggtttgcctcctactctgtactacaccgtcgctcgtagactactccatcccgctcgccggcgtgcaccggcgattgggagacgtggagtccggataagttacgcgtggagtgaagatcgtgcgggcgccctgatcaagcgactcttctctatataaaccgacccgccgtcttcacgcaacacacgcgttttgctgcaaattcggattcatttttgttttggaaacgttccgaaaaatccggtgcgtgcaaacggcgtggagtccggataagttacgcgtggagtgaagatcatgcgggcgccctgatcaagcgactcttctctatataaaccgactcgccgtcttcacgcaacacacgcgaaatcaatctagggtttgcctcctactctatactgcgccgtcgctcatagactactccatcccgctcgccagcgtgcaccggcgattgggagagcaggtctccggaacctctgccttcgacgtcctgcaccgggagaaggcggcaataaggtttttgggaagcgtttcgcgcgactgctccctgttcgttcgcgacggctcgccttcctcttcgctcacgtgcttcgtgccttcgtagacgcctgcgaaaagtttcgaccgagcagccggtctttccaccacctcggtacgtgttcaatatgttgcgtatatttgatctgttcatgttatactgtatagtttccatgtgtagatctaatgatgcgttcatgctaattttcatctataatgtcatgatttatttatggaataaattaaatcattatatgcctataatctcaacaccactaacctatatcaacctcaccctaaataacccaattcgctttaccccaaaccccaaaggcctattaaaatattcgtgccaccaccagggaccaaccaccaatttgcacattcaacaaaaggacagatccataacattggccctgaaacatgtttcaattcaaatcccaggtgcaaacatcatctgcttcacagtttcatgattcaggtaaaccctacaaaactaaacggcgaactgaacaaggtggattccacggccagacaacatgggagagatgggggatggaggcacgatcgatcagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagcccggagatgcgcttcacgccgcccctcctcgccagcctccggatcgccggcttggtgatcccctggatgttgtcgcggagcaccttccggtgacgcttggcgccgcccttgccgagccccttgcctcccttgccgcgccccgacatggccgccgacgacgacgattccggtggctcgccgcacgagagagagagagagagagagaggaacgagaggaaatggaggaggagaagaagcggtggtgattggagtgggatttgggggaagaaaggggagggggttttaaaaggggacgagaggatggagtggggaggtggctgccgttggatgggtagggagtggacggttgggatctggatggcgagaggagacgcgaatcgctgacgtggcgtgaggcgcggatcggtgatttggcgggacaggtgcgaaatttcgtacgggaggcgccagttttatttttcaggctgccgcgtggcgcggtatttggagtttcgaagtttgcaccggaaggccatttttggcacagctctagcttcagcccagtcaaacagtttcagctccaccaaaactgggagtggagctgggtgaagctctctcacaaaataaactagagttgtggactccactccaaatccacctcctggagttaaatttaggagtttgagctgtaccaaacaggcccgaaatttcgtactccctccgtatactccaccgacttggatcaaagtcaaattgctttaagtttaacaaagtttataaaaaaagagtaacattttcaatccaagacaaatttattatgaaaatatatttaattattgatttgattaaattaatttagtattataaacattcctatatttatctataaacttagtcaaacttgaagcagttttactttgaccaaaatcaaaatgtcttataacctgaagtaaccatttatatccctttagaattcatcccaaaatataacaatttttccacctattttttcttaactaatcataatattttaccatttaaattcttcacctattttctcttttcaagcaaacacgttcatctcgtatttaattacacctactttcttaatactcctgtctaattctaaaaagatgaaccagtcgtaattatagctcattttcaaaatgtacgatgtcgttaattttttgcacaatatatgaccattcgttttattcaaaaatttaatataaatatgtaaaaagtataagttaagattatttttttaattgatattaaaacaagtcggaacaaaataaatgatatccatataatttttttagtacaaatggttaaaatttatgaaaaagtcaatggcgtcatacattttaaaatggatgaagtacatgaaaaaaaaaggtgttgtgttgttttactcaacaaagtaactttctgttcagttgagggttaagataaagaatattttcccactgcgaggaaaaagataaaagatatttgctctcttgccacaattcacatttcacctggctacttatataagcaagatatattttactcgtggaatgacagttgatttagggttctttcagtttggagggaaatcgattacttagaattaattactattagtgtcattcggttcataataatgtaggtataggaaagctaaaggaaaatttcctttggtacgagttgtaatgagaaaacatagaaaaaaatttatccacacaaacatcttggaaaatttctatgaattgaagtgtgtatgtatttatattcctccattcttcctatttatatgtgtttaaattcctccaaaacaaacaagcccttataaagaaatctcgaaatgcttgttcactttctaggagtacagtgcaagttaatttcgtgcaagcccatctctgcacacatacgagctatgcgaccgtatagatccctaaaattaggggcccaaaatatgtgtttcaatttaaatcaaaatattccgatatatttaggattgtgtattcctttttttttcaaatttatctatttctctccactaaataggattaaccgagttgtttttctcaactccggtaagtgttcaataataatcatgggctacatcaaaggaaagaactatatttagcgacgacgatatgaacgtgcgttctaattctaaacaataacgattccattttttcatggaaaaagtacgaattaccccctgaaccataaaaccggacattcttcacccccaactaggcaaaccggacgaattacccccctcgactgaatccgcaggtggttttggtctacgtggcgtacacgtggcagtccagtcagcaatttttttttaaaaaaattgggggaccctcctgtcagtgtcatacctctccttcctctctctatcttcactctctctctctctctcacgggcatcacaagggccaaaggtgggcggtggcgtgagggcggtggatggaggcgcgcaggggcgggcggcgagcggcggcgcggggacgtgcggcgctggcggaggctgactagctactgatttctaggcgaggtcggcgccgccgaggacgagcggcacgccggcgaccgcggaggcgagggcggtgacagggcgactgcagtgggcggggccatgccgcctcccgatcgcccgccacgctagcctcgcccacccagctgcgccgccccctcgtgctgccgtccacggccatccccgcgcgccccacagcgtgcgacgggc

SEQ ID NO: 51366 - DNA, 7628 bp, Oryza sativa
ccgacgcggaggccgtctcggcggcaccttcctcggtagccacgaccgccgccgtggcggccgacatggcgaagctcccctccatcgtggcggccgacgcgacgaagctcccatccctcgccgccgcctcacctcatatcccgccaccgctccgtgtcgccccttgcgccgcccttcctcactgccgcgctcgcctcgccacagccgctgccgccgccagatgcagacggcgacgcgctggtgcacggggatggcggctgacacggcgaagctcccctccttcctcgccgccgcctcgcctcatcccctgccaccgccgccgccgccgctccgtgtcgccacctgcgccgcccttcctcgctgctgcctcgcctcctccgccgcctgccgccgtggtgccgtgcgcgttcagagagtgagaggagagagagaggaagtgtgagagagagaggagagagagagaggggggaatagtgttataggggtatgacaggtgggtcccacatttttttaataactaaaatgccgtctggactgccacgcgtatgcgacgtagaccaaaaccaccgcggattggatcgagggggtaattcgtccggtttgcatagttcggggtaaagaatatccggttttatggttcaggggtgtaattcggacgaccgtgatagttagggaggggtaatccgtactttttccttttttcatttagttagaaaaactaaattgctacaatgatttttcagttgtttggtcgaatcaccatatatatgtaggtgggcggcggaccaagcggttatgattgccgtgaccagtgaggcgtcctccccgcagctctctggtgggtgcggcctccgttcgtctgagtgacgatggcacaatggtggggtgacaagggcttagtgtctcggcagctgtggttgccctcctcggtggagtagaagagccttgcacgtcccagtgtggatctgcaacggaaaccaaatgagccagtggtcaccggagaggaggaagaagctcaatctagactggtgcattttttttcgatgtttcaaccaatgtatctttgatgtttctttgggttggatcgaaatgttgcattggatagtttgatattgtttcatcgatctgtgcatatcccttgatattttaacggttgaagcttgatgttttgtttgttggatcgaattgtttcaatcatgattcacctatgtttcagcatttaatagattgaaacattttttttatttaacggtgaaacattgttcgactaagagtgacaagacacttgatttttgatgaaaaatcagatgcccgatttgtagtctcctccacaggactcttctctaaagtcaagactatatgtgaaaagagtactttgtgaacaagcacacgcacgtccgcctcatcgtttcgcttattcgaataataatttatgaataagacttttatatacgtgttcttagcaatctaaaagcaaagactgaaaaataaacttcgatataaaaaaacccaaaatcaactccaaatttaagattgaaattttaatttttgggtgataagcataagcataagcgaaaagataaggccgatcaatcacgcaaaataaccccccatgttaattttcgagttttcttctccaaaaaatcttctgcattccctttcttagttactgattttgtgctttagttttaaacacatgatgatctcatcaagagtatatttcatgacatgcacctatatgagatatgtagaacacatttttctctgacttttgcatgttttgaatctactttccactttttggctagtttaagccaataagcccaatagaaagtttacacattatttttcttttatgaaattattatttttattttgcttgaaaattttccacataaagtttctctgtcgaaagtttacaggtagaaagttcacatatgtaaaatttctatatataaagtttttaggaataaatgtctatatttggccaccgagacacgtatgtgggctaggggcctctaatcaggaaaggaaaaaaagtttaaatgggttaagaacaagtggggccatttgcattgaacccgtggactttgagatagatgggctcgacaatctggatgaaacttttcccaaaaattaacaattatttggttatgttgctcaacttgagaacatcagcaagcagcaaaggtcgaattcaacatgaataaattggttttcaactaaattgtttgtttcaatttgaatttcaaataaatggtacatatgtcactcttaacgaccaaatttggtaatatcagtatcggagatgaagattagattgaagcggggtcgaagatgaagattgtcgcggaaacagagtaaaaatcggctgaagtccggatcggctacgattggatcggctgagttggagtcagatttggttaggtgatgcagccgattccaacaatacgacttggtgtacgacatcgggttgggttgaggtgcttcaagataattgccacgcatggatagagtcctgggaaggcaattgtatctattagttaggatattttatgtaatttccttatagatatgcttgggcaaaagtctgccgtaaagacttgtggtatcttagagtttgttagagataatagtcgtgtccggtatggacatatcttgtaattctcgggtataaatagaccccgagccctatgtaattaaaaacacacacacgttcaatacaatttcggcgcatcgccacctttttgctttagttttatttcgacgagttcttactttcgggttgagctgtatcgtttcgatcttcaacaagaggtaaaacttgttatgatggcttgtgttatcgggattagtgcttccatctttatgatactctaatcttgtttacgtaattcgtcgagttatcatatatcgtacataatctctggcaatatcactatctaacctacaatcggctaacatctgctagtagagggcagccgattaggttagattttgatgttgatttagattatataagatatccaccactctatgaaacttccagcggcttgattgtctagatattgttcttcttttcatacttaatgctgcatcagttgagtttgatctattaagtcgtgtttagaatatcaatctctagcctgccttctggttgccgattagggtagtatcggagtttcagccgatcttatctgatttaaccatattcgctctatatgcttcagtgacatgttaaatccgccctttatgtcaagatcttattgcatttaagtatattaagcttttgtttgatatattatacttgttttaatatcctgatatagagtagtatcgaagtattagccgatacatgctagatctatatgatcggctatgctataaacatatatagtcctgttattaatatatatttcgatccaagtgatttatattgtcttggcatggcgaccgatctatcccaatcacttgatttaaatatatatcgatataagaactatatattggtaatatctacagccgatcgagtaggtttaagtctttattatctatttatagtcgccgatcgattcacatatgacatcggctcaaagataaatgatatgtcatcgacacttagccgatcggctatcatttatagatttaaccgcgatctctctgtttctatttcttgttgattgcaggatcaattcaattggcacgctaacacacccgaaggcgagctttgaacctgtactctcccaggcctcgtgtttgacgtcaacagtcgcggtaaacaaaatgatggtaatcctgttgctcatactactatcgtactaactgaatagagacattccatttttgcaatagagaagcgaccatggacattgaagctatcggggaacgaggagggaacaagcccgatcaaccgccgaagtcatagatggtgcggccctgaagcttgagcgcatatacgacatccatggccatgacagtcttgcggtgagcatgctcggtgtaggtaatggcatcgcagatgacattcttgaggaagatctcgagcacgccacgagtctctttgtagatcaaccctgagatgcgcttcacgccacccttccttgcaaggcgtcggatcaccggcttggcgatgccttggatgtagccgcgaaagacaatccgatggcgcctagcaccacttgtaccgcgcccagaaatggctaccgactagtggagcgcgagaagtgctagtggaattggaagagaagtggcactggtggtggtgcccagagtgagatttcaaagagagacgacgaggggttttatagaggataaaggtaggagtcaggcgatatttgccgttagatgtgaagaaaatgggcggatgggatcaggattacgggagaggtgccacagatcgctgatgtggcatgagatttggatttttttacttggcgggatagatgtaaaatttcatacacgaggcgccatttttattttccgacagtggtgcatggttttttccaatttggagtttgattgggggtcgagataaaaggaataattaaattcttggtacaaaagccacatttcacctagttttgaaagtaaattctattttacatcttcaactataggccaagttcatcatctaaagaagctataggctgagttttaaagttgctcttgagtgcaagcgaaccgacccatgaacccatatatttgtaatctataagtgggttgctcatttatttgtactgtaagtgagttacccacttataagtaagtggtacatattagtgggtagcccacttatagtgctatataagtagatttgtggattgtcccgtttgcacccttacttccggctatgtcttcttcgttttttctgcatgaatctcccttcctccggtgatgcagctgaggatttgtattttgttttctacttgaccattgtttcctccacgagtttctgtggtagtttaaggcaagattaatgctagcaatttagtggtcaagttagcatcttatgaacccattacgcatgcaaattcaaaacggctggcaacaaattataagcccaagatttgcacgtgtatagtagatttgcatgtgataaattgggtgtatccaattgatgatcagagtgtacaaagccatacgttttaaaccatttagcatgttcgttattatcacaacaaaaaacatttacttgttgaagccccaccccccaatttacattgtccacggcctctgagaaacgtcaaaaaaaataactcaggtatacaactccttccacatcaaaccatctctggtttaatcacctgatccttcaaattaagcgtttaacatttgatcttcttctcgcttccacaataatatcatttgacaaagtttcccttattattgctcctctgcatcttcttcctcctcttcctccccttcctcttcttcgttgtcgttgtcgtcgtcgtcgtcgtccgaggaagacgacgacgagctatcagagtgatctgattttggtgcaggggaggcagatggagctggggctgggacgctggcagctggtggatccggtggcagtgaggtcaggaagcccagcgtcatgacaacgtcggccatcaacggccgcacggagtcttcctcctgcaagcacatcgcggccatggcgaccacctggttcaatgcctttgctgcgtactcgctcttgatgagtggatccaccagctcgtgatatctcttctggtctttaaacatcggcattgcctgaaaaatatgcaatgcagatcgcaattcacaaagatgccattagcaaactgaatcataatgctattgctataatgctattgcatctttcataatttctttgggagaaatgttgcattatttctgttcaaaatgcaaaggtttttaaattcagatttcggcatgcagaatgcagaatcgatggtatatctgcattgcactattgcatcgaccaaattggctgaaaataactgagctaaacatcacaatttccatggcgaacttacccaggcgaccacgttctgctcctccgtgggcttgtcggggtcgatggctctcctgccggagatgagctgcaccagcacgacgccgaagctgtagacgtcggacttcatggtggcctggccgctgcggtcgtactccggcgcgcagcagccgaacgagcccatcatcggagccggcgcgttgccgcccacctggccgagctgcgcgagcccgaagtcggacagcttcggcgtgagggcgtcgtcgagcaggacgttggacgccttgaagtcgccgtacaccaccggcgggctcgccttctcgtgcaggtactccagcccctgcgctgcgccgtacgccaccttcatcctcgtgcaccagtccatcggcttcttgtccgccggcaaatctgccgacgacgacgatgcaacaataacagaacaatggacaatctcattatcgtcgtcttagagtattcgttcgcgttgcggcgtgtggtgggtgtgcgtaccgaacaagtgttcttccaagttgccggcggacatgaactcgtagacgaggagccgctggtcgccgtcggcgcagtagccgatgatgtcgacgaggttgtcgtggtggagccggctgagcttcgagacctcgtccaggaactcattgttgccttggaagccatgcctgtccagctgcttgatgaccacggtctgatcatgcacaaaaaaacaaagaaaaaacataattagttcttgtttatgcgaagtgatcactgcgctgctcgatgaaatagatgtgagattgttggtgagcacgtacctgcccagtcttctccagttgacccttgtagacccggaagaagccgccttctccgatgaggttgtacggcgtgaagtggtcggtggccgcggcgagctcgcggaacgcgaacgcctgcccggcgatggcgagccccgccgaggcgtcctcggatggcttgggggcctgatctgcatggagagaccgcgcgcgcgcattagccaattggaagccatggtcaatgtgggatcatcgaactagccaagaaatcggatcgaggaagctatcactcaccgggcctgggcggcgtcatgggcgcggccgcgggcgcgggcggcgtcatctgcgacgcgggcgccgcatccgcgtcgtcgaaccgcgccgtgtcggcactcaggctcttcttctttccgccgccgaagcacgggaagcagctcatcttcgcgccccctccctgcctccccgtggcggccaccaccaccacccctgtccgccgccgccgccgccgccgccagccaaagaagaaaaagaaagacgcacggaccgaccaccgaggagcagccgcgccgcgccgatcacacaaccatcgcgcgcgagcccgcccgtctcaccacctccgccgcggcgcgcccacctcgtggcacgccatccgcgcacacacgcacgctgtcgtcctggccccccacgcgcgcacccgatccgcccgcgcgtccgcccgcgggaagagagaagggggcgatcgatcgatcgatcgcgccggggcgcgcgcgcgcgtggagggggggaaggagagggcgatggggggttgggggagatggaaggtgggggaggagggtgggagattgggggag

SEQ ID NO: 51367 - DNA, 19464 bp, Oryza sativa
gggcggggggacgtgcggaccacgtatttgaagggagtggtcgacgacgaccgtcgtggaggggtcgctcccccgtttcggccgttgcagagcagagctttgtttccagcgcatttactccctccgttctagcagccccaattttttttgtttattcatatattatttgaaattgctcattactaacaaataaaaaagagtataatatataccggttcttaaatttgagaggagatatcgattagatccataaacttgtaaagtgtacattcaagtttatttaagcgtaaattatactggcaatgcttaaacttgtaagcagaaaagcaggttttacataggtccacgaaccgtatattgaggtctctaaacttggtttattctattatcacggtccaaaatcttatttgatcgtggtcttgtctacgtggcatgtcatgtagacgacgacatgacatgttattatttttttccctcccttcttcctttttcatttctctcttcttcgaccttttccttcaacaacagcgatgcttggcgacgacggcggccggcgcgggaaagcttgaggtggctccagtggaggaagaagataaaagaagatgaggaaaaagaagataaggaccgccagtgtattctactctttaattaaccacagtaagtccaaacttcatttgactgaagatgaccgccaacgagacgctccacgtatgccgcaattttgcatccaatagcgataattttacatccgtccccttcctcatccaatactaccctaaatcaccccctcttccccaaatacatcaaatctagatgtatgctagagcgcaagaaagaatagtggtacttagatacacaagcgtcgattcatcttctcccccaaagttgaggtccatcgcggctgtcgtgtcaacagtggagccgcaccacacacctcctatcgaatgccaccactcgcgcggcccaaaatggcgcctgaataaccccgcaacaccgatgatcgtcggtgttacctactcccttaccattctctctcgaaactattgtattgggaaagaatcagagtgatttgggtgttttttaaggggattcgggcggggtagtactgaatttaccatcaactatgacgcagagagggcgggatgcaaaattgttgcctacgtggagcttttatatacgtttacttaacaataaaaaattattagagtaaaacttttatatacctgtacttaacaagttaaaaggttgttaaaagcaaatacagtaaagaaaactaggatgagaaaaatcaaatttaaaattaagttctaaaatttaaatttttttataagaataactgaaataatggggtgtggagttaaaaaatttaatctaaggacatcttttaacagttcttacttacacaccaccattcctattttgatcaatttttcttcatgtgcttttaatggattctaggaacacaccggtgtgttcggaacgcctggttcccaacactaagagcccgcacaaaaaccgaagcagcgattagcgggtgattaattaagtatttactattttttttcaaaaatagattaatttaattttttaagcaactttcgtatagaaactttttaaaaaaaacacatcatttagcagtatgaaaaacgtacgcgtgaaaaacaagggagatggtttaggaagaggtgctgccgaacacagccttagagtaggtacaataagtcactttagttggcgatagtgcatgcatgctaatgtgcttagttggcaaagaaattgggagagaaaaggtgtgagtgggtgactaaataatcgccggctgcacacatgctccaacacatttttcatggggctctcgatggtcagctcccttccatggttttccaaattgccggtgcggtaaccatgaaaaaccgtgtaaaatttattaaaaatttaaattattttttaaattcatttaaatttaaggaggttaccgcgatttttctattaccgtaccccgtggtaagaacagtaagtcgaatgaaccttgtcccttcccgagaagaactagtggacggaataatttgaagtgaagaagaaagagaatgactggattaaaaaataaagaatgcatgcataaaaatttatgtgtaggtgatctagtagttaactattgtatttatactactcttattaattatttttgttggtgatgtgaatattgtaggtgatctaatagttaactattgtatgtatactactcttattaattatttttgttggtgatgtgaatatttttatagctaacaacatgctgtattattagacttgctcttaggccatttctaacccaaaatactagacatagtttccataaactccactagacactacttttccaatgcaaacaccactgtcactattccatacttaaatttaatgctacttatctcacatgatgtcttggatgttatgtagaaaacatgtctcatgcaagacatagttttcttctttttcctcatttattcacttgccatatcattttctatcttagatggcaacttatttaatactatggatatcattctagtcattgggttaagaatgctcttactgacagagtactttgttattccactgttccagtgacagccaatcaggcaatcaccaatattaattcattgatatcgttcgtccattcaatcattcatcaaatgcagactgcttgattcgttgcaatcgtccattcaatcattccaatgcatactgcttagtgcgtgcatagcacggctgcatccatccagtttccagactttttttttctcaaaacttaattattttcttaagatccagttctcgttttatatcaagctatctttgcacgtcgacctcacgatctttacgggcacaaatgcatcagatattcagatctttaacaatcggtaaacttgtgaagataaccgaaaaaacataaacggaagcagaaaccggcacaaatcgtagtcgtgtaagccacggggagaggaggagaacccgaggccgccgcgaaagacggcagccgggatcacccacaactcgagccccccatggcaaaatcactctacgcccccagaacaaggccgtcaagagtggattcgttctcttgcagccgaaagaagaggcgaccaaacaagcacacacaacaaaaagaaaaggagagattgttccataagtaagaacaaaaaatattctgagaagaagatgcagatttcccttctgatgatgatgagcgagatggatgcaaagcagtaagcaagcgagtgacgaaagtgagtgtgtggatatggcgagatgcagcacgagctgttccgcggatgggaacggcaggatgaggcggcggcagcggcggcgttgcgggctagggatttcgtggggaggtctgcggcgtttataacggcgagatggggagggttttagcaaggacgtatgggccgggcccagggcgttctgttcggcctcactgtcgtactgggctttccacaaaggaataagttcatttaaggtcccttaacttgtcaacgaatttgattttcgtccttcaaccgaaaaaccagatacaacgggtccctcaactatcaaaaccagtgtagatgaggtccctcggcggtttggatggcggttttggctgacgtggcgcttatgtggctaatttgactcggtcttaatctgacgtagtattgacgtggcgtttacatggcaatttgatccgaaaaataataaatcgacccacatgtcagtttcaccaaaagaatgaattaaaaaatggtggggcccacatggccccacatatcattgtcacccctcctcttcttcctcctctctcaccgtctctccactctcctccctccaggcgccacggggccacggggaggtccggcggcggcggccagcgacgcgggagaagggcagtgggcagggcatcggcggcgggagcgctgggtcttcgctcacgacgtcggcgcggaccctgcgcgggggctcgtggaggagatcggggccgcggcgccgcccgtctccgacgagctagagctcgtgcgagcgcggtgccgggagctgcacgactgccgacgagaagcagaggaggtttgaggtgtacaggagcaacgttgagcttgttaagaagttcaactccatgtgcaatggctataagctggctgacaagaagtacgttcgccgacctgacgaacaaggagttcagagccaagatgctggggttcagacctcatgccgcaattcctcagagcaatgcctggagagagcagtgatgatattctgccgaagagcatagatcggaggaagaaaggagcagtggtggaagtgaagtaccaagaagattgtggtgtgtgagcaatagcatagtaaataaagattcaaacctgtaaaaatgttggagattaatcgatggaaatctgggtgttgtgtggatgcaggttcttgctgggcgttctctgccgtggcggcgatagaggggatcaacaagaacggcgagctggtgtcgctgtcggagcaggagctcgtagactgcgacgacgaggccgtggggtgcggcggcgggtacatgagctgttcgagttcatcgtcggcaaccacggcctcaccagtcaccacggaggcgagctagccgtaccacaccgtgaacggcgcgtgccaggcggcgaagctgaaccagagcgcggtcagcatcgcgggctaccggaacgtgacaccagcagcgagcccgacctggcgagggctgtggcggcgcagccggtgttcgtcatcgtcgacgccggcaacttcatgttccagctctacggcagcggtgtctacacggggccgtgcaccgccgtccgccgacgtcaaccacggcgtcaccgtggtgggctacggcgagtcccccaacactcccgccactgacgccccgcccttcccccgcgtcgtcggccgccgccgccggacctccccgtgaccccgtggcgctggagagaggagaggggagagatggggagagaggaggggtgagaatgctacccaccattttttaattcattcttttggtgaaactgacatgtgggtcccatgagatttattatttttcggatcgaattgccacgtaagcgccacgttaatgctacgtcagatgaagaccgagtcaaattagccacgtaagcgccacgtcagccaaaaccgccatccaaaccgccgagggacctcatctgcactggttttgatagttgggggacccattgtatctagttttcggttgaaggatgaaaatcggattcgttgacaagttaagggacctcagatgaacttattccttccacaaacttcattggcaatttttggtcctgcctgcaaatctccaatctgcggccccatttggtacagcttcaactcccaactccaatttatctagagcccaaactgtgtcaaacagtccagatccttcattttttggagcggagttggtggagcttctccacaaaattgtgctaaggggtggagctgggtttttgctgctccaccgctccactccaccccaaaagacccactaccttttaatttttagtgtatttacaccaaaatgccactgaactaccccttccaaccctatctcctccagttctctctcctcctctgtcttcctcggtagacacaagcggtcggcagcggcgggcggatggcgcggcggcgagggccacggacagcggcggcagcaggcacgcgagcggtggcgcggggtcgacgacgcacgtgcggtggcggcagcggcgccgacaagcaaaccgccggcggcagggcgggcggcgacagcgacgcctgccagctgttcgacaaaatgccaacaaaggacttggtggagtggagctaaccaatctagccaaacactttctattctacttcagctcctataggagccagctctaactggagttggagtttagagttaagagttggagtttggagccctaccaaacgggacctgcgactcacgcgcttctatcaatgcttccctcccctcccccatttttttatgaaacctaagccaaccgagctggttttatattcagaaaagtaagcactgtataggggtcaccaacggtgacaggagaagaacaaggggaggtcagcacaaagggaaaaaaatacagcttaagggagtaaactaaggtgctattctcgtgaggatttttgcaccacatactgaccatacatgatttttttccaggatttttgccactagctgagggatttggagctctgtgtctttgaagactcacctatttctctcgcaccagatttcccagcagaagagcatgtgtagcgattgcatccctttcgtgtgaaacttgctttgctgctgtgttgttcttgattctcaccaatcgattagcctttcttccgggttatgaaccgggaaagattgatcgtggaccattcttgccgtcgctttgtcccaaatctcccgcgtgaatggacagtctttaaataagtgttgcgccgtcttcaaattcctgtaacagaattgacagaaattgttgtttggccactgctgaagttgcaagcgatcggctgtccatattttgttttgtaggagtagccatgcaaagtttttgcatttggatggcacccatgtcttccatatgaaggtggcagcccttaagtcttctctgccggcaaattgagccaaataagctgattttgctgtgtgtttgccggtatttgttcatctctaggtgatggtgtccttgatttcttccactaggtttatctcccaggtgagattgaacaccatgaagtacgtgttccaacttccaacttccgacctcctagtagttgagcaccaactttcgttcgaagggtagcttcgtggcatgcttcatccacaacaaccagaacctatggtttgattttgtatactacttcctccgtttcacaatgtaagtcattctagcatttcccacattcatattgatgttaatgaatctagatagatatatacgtatagattcattaacatcaatatgaatgtggaaaatgttaaaatgacttacattgtgaaacggagggagtaagttttatggttaatgttagatactaccgcgagaagatgcaacaaaacaaagcaagaataagagaaaaatatcataggggtggatccactcgcaaaagacctcatgagctgagcaccagcttcagtcgaaagggtagccttgcgacagtcttcgtccacaacggcctggaccggagcaagagcaccacccaagacgtggggtgttcttctcttttcacaagcacggagtgacaagaatcacctagaaatcaaacccatgccttgaggtcttgggcacaacttggtaggcaacgggccattaatctaccagtacgtcggcggggaaatgtgaggtcgatagtatctagcattgtcaccatacacgctattataatatcgatatacgtagaaattaatgtattccaagtgaatttagtaaacttttagttatgtgtcaccaagattttattcaacatcaaccataaaatcaggtttcattgaaaattccttaacaaaggagaggatggatggctaattttcttaaaacacaaaagctttacgcgtcaatatattatagaagctatgaaaattcatttacaagatcgcaccatgctagcagcaggaactagggagtgggaaggttacaacgacagaaaactaagtgagacatacgccaggaagatacaaaagatagggaggggagaaggcaactacggggtggtagatactcgcaacagagctccagcgccgggctctgatcagactcaccagaggtgcgtctcctacaagattccatcgaccaactggggataggccgatagggtaagcgtttctctctttccacaggcaccaggacacaaacaacacaaaatgagtcgaggtcaggcgatgtgtaattgggcggagtttagttccaaactttttttttaaacttccaacttttccatcacatcaaaactttcttacacacataaactttcaacttttctgtcacatcgtttcaatttcaaccaaacttccaattttggcgtgaactaaacacatcctggtcacgcatcgtcaaacgctagatcaccatattcttttcaaaagaatcagcaagaatatatagaacacaaatgtggaaattgatacattcatatataccaccacacacagattgatgacatatagttacatgctcgatctgtacataaatgaaactcaaagccccaaacagtcacacgctaagcatacacgtagtaacacgacacaatcttctcctcagtacgaaaacaacagaaatcacacaagaatccaagagaaaacatgtacacttgagtactgaggagaagatttgtgttcggcgccacaacccttcaggctaccaaccagccgcttctcaacatcgcagcaaccggattcacgttcggctgctggctaatcaaaaccttgggctcggaggccgcgagcgtcgcggcgtcgacctctcggccttcgccttgctcggcgacgggacgctgctcagcctgtccgcggagcccagggaaaggcgcctgttgatcaccgacggtgaggtcacctgatggtgatcgggcgccgtcctctcggcggtgacggggacctcgatcgccgccggccgagccgccttggccttcacggacttggtcgtctgcatgtagctcggcgtcagcggcgccgcgtcgtctctcgccgggccgccgcctcctcctccgaggctcagcctcctcggcagctccccggaccgcaggctcgtcgtgcgccgcagcgagaggaggacgacgccgcccttctcgccgtggaccgggctgacgctccccgccgcgcgccgctcgcagctccgcggccgctccggctgcaggctcgtcgtgcggcgcaggccggtcgtcgccgtcgccgacctccggaacgggctggcgcccgggctcgacggcggcaccgccgacgtcctccacggcgaccgcggcgtgggtgtcgacggcgacgggcagctcggcgggcgggtgaacctggccaacgccggcgtcgacgtgggtatctgcaccgacatgggcacccgcctcccgctgccgccgcctttcaccgccgcggctgcacggccgctgttcgccggcgtggtctggctctcccacggcctcgccgccgccatccatcgctccgcccagctccatccccagttggggttgccggtgtccatgaacattggaggcggcgaggctcgcgcagatgaaggtttcctgttactccactgctcgcagaaaccatacaaagttcagaaaaaagaaaaaacgagcaagaaacaggcgatcggatgtactccgtagcacggatataaccatgtcacctgatgagaaaatgcgtatgccaacgccctttgccgccttaaagcggcttcttgcttcatcgtcagcacggtctcaatctgctccttggactgatgtccatggtcccagctttcaccaatctgccaagacattagcattgccagttttctttactgatttgttacaacggcaaaagtatgagttttaaggatacggatttttcatccctcgaagagatatcccctcgttatttacatatcatctaaatagttagtattaaaatattttttaaaaataataatatagattaatatgaaatgtcactttacaaacatgcacaaccaaattcgatttttacaagttacaataaaaagaacaaattaaactgaaaataattatcttacattcgtatctatatttgtagaagttaagttttaactcatgtttgtggagtaatatatttcatattaatttatcttgtcatttttaaagtctttttgataactatttaagtgacatgtacgaattgagcggatatcttgtgacgaaatgactttcctcgttataaggtctgaagatgcaaatgacaacagcatgaaacgatgcgatgagtgacaggagcaagtgatcatcaatgcattattgcacctttattctgtcaaggctctgtttaacgtggacctggcttttcagggccttcttgtcctcctccgtcttcacccgcctggagtgtatctgggtctggaccctcgtcatcgtttgcatgcagtacaaggcttcgtaggtctggcgcttcacggcgagcccctccagcagcagcatcaaccgatccaatcccctcgcccgttgcgatctccttccctgccatcgagtgttaaaatgttcccaaatcaaaccatcacgagccatgaaaccatttgagatcggcaaaaaaaaatgatgaaacgaacagcagaagagagggtcaattaccaggtagaccctgcatgctttctgaatcttgacggcggcgagctcctcggcggaacgcgccggagctcttggcgcggtggtcgtggggcgggtcaccgccgtggccgtggccgtcttctgtgcggcggcggcggcggcgtccgaggatttcgcctccttgatcccgtcatcccgctgccgatcaggcggcgcagcttgtggaggaggaggatgatgatggtgaggttgctgccgagccgacggagaggtcaccggcggcgacgacgtggacgcgctcgacttgctgaattgcagtatcttcttcagggtcgacctcttgcccttctcacgttcgaaaacatccgccgatgatcagtcaagttcatgcagaattgcgcatcggcgatcgaagaagatttgatggtgagaagtagtgcgatttaacttttttttttctctgtgacatttcgttaccttcttttcgttctcgtggctgtcattctccgacgtgctcagggctctctgcacggcgtcgaaccacttcccctttttccccatctctcctcttctcggggctaaattaacgctggcaacacgagttcaggggttgtaaaagaaggtgaatttttctcaccgttggcgccgccgggatggacacgcagttattccggcgatcaacctcgacgacggcgacttatccgccaagccgtgggccccacatgacagccacctccgaatggcgcctgtccctacattccagtatgtccacaccaccccctcgccgcgataaacgcgcgcgcacgttttttttttaactccggctcgagaagtctagtactagatcctctccgacatccgtggccccacatgtcagttccccgtgccaccgtatgggcccgtggcccatgggcccaaccggcccggcctctcggtccatttgctctcgtctgcctctccgaccacgaccagagctcgcctcgccctcgccgattaccagttcaccacgcccgcgcgcacacggagaccgaggccgcgaaaaccctagcgccttcgtctacctccagctcgtcgcgcgcggcggatggtgatgagctcgcgctccctcagggctcgcgactagggttctcttctcactccatcgctagcggcggctcagattgggaggtattccggtgtttttttggtgctaaattttgccccccgtattggtgttttgcaggtgacgcgacgctgcgattgaggtcggcgccggtggccgtggatcgcggcgcgatggagctggagggggatccgaggctggtcggcgttgcgttgggggagtacttgacggatggggaggaggtgatggtggtgggaggggcgggggaggtggccgtggcggcccgtgtggtgaaggtggatggggggaaggttgtggtggccatggatgaggatgccgctgcaggaggtggcgtcggagtcggagtggtgagcgatttgctgtacgcgacgggatcggcggcagtgggtgaaggatacgggggtgagtgtactgacaacatgcaggagctgctggatggaggtggtgcagaggagaggatgttgggagtggaactcggtggctttcgtggtgaggcagggtggacgcttatgccggtaggagatgctgctatagagacttcagaggaaatgtctgatcctgtcacactgcaatactctgaaacaggtaaagctttgctccaatttggtcactgctctgatcaattgggatgctctgccggttgattctgacatgttgttatcatcacctcgcatggcgtcactgaatagtataattgcagggctcacaggggatgatcagcgtgccaaataccgcctccctcctcttgacggatatggttttcgagcatctggtcttgtgtggagtaaattgaaaggtcatccttggtggcctggtgagatatttgatacttcagatgcatctgagttggcactgaaacaccagaagaagaagggcagtcatttggtagcatatttcggtagcaatacttttgcatggtgtgatgaatcccagttgaagcctttcatgtcaaactattctcaaatggcgaatcagagcaattctgatgccttcattagttcagttaaccttgctcttgaagaaatctcaaggcggatattgtcagggatgtgttgcttttgtcttccagaagatctctctgacaattgcatgtcttacatggttgagaattctgggctcagggatggagttacttgctctaaagttacacggtcagagatcttggaatgtttcaatgcagaaaattttctaagttatctcaggtcattggctctgttccctggtcaaggaggtgagctgctggatttagtgatagcatgctctcaacttacatctttctttcaatctaagggatgccatgaacttgcatcatttggaagtggcagtgagttggttgatgatggcatggactcttcttccaccaagaatgtcttgttgccagaagctgtcacctatgaacagaaacctagtgaaggtaagcccaaaagacgtaggataaaaacttgtgttaaaaaacctcagaatgatttagagttgacagaggaaaatcccatatccagtttgaacaatgagtgcacttttgttgattgcatgggcttgaacatcattgggaaagttaaagggaagagaagtgaaaagaggagaaaatatgtgccttctcctgaggtacatacaactgatcatgggcaggacgactcctggtctggattctgtttaaacaatgatccaactgataccctcggggaagcaagtgccaaaatgaggccaagacgtaagcagagatcatcgaaagaaacatgtgcaccttcatcagatctctcttcccatgtaccacctctgcaacttggattgcttggtcctaagaaacagatacaactgatagaaagataaattatccatgccgatgaacagagaattgatgagatcatgccctccgcacttgttttgagttttggcagatcagctgctcttccctcaaaattggatcttattaggttgttcagtcgctatggacctctgaaagaaaatgagactgaagttcaccagaacacgaatactgttaaagttgccttcaagagacgttttgatgctgcaaacgctttcagtgttgttggcaagtatagctattttggaccttcgctttgtagttttcggcttgtaaatttgccattttccctatccaagttaagccctgaagatcctggcacggaggttcctggtaagcatctgttagttgcattcacaattcaatgagcaaaaatataagtcttacggtaccttatgatatgtgtttcttgtagcttgtagggagtctggagtggatattgtgcatgttggcatcatcagcaaagttgataaagctcaaaatctgtagagaaagcatcagcgtttgatatggtcgatccagcagggcgagctaacaaaattgtaggtgagggcacggctgaagaatcagatgagaaaatcagttagcttttcttccattaaaacttgtttatattcaggtttgtctgctagatgaaagtgttgtctcatccgggtgatgcattttgtatagaaaacgggaatccgacactagtattaaaatgttagtcttcagtaactagagcatgtatatagtcatgctttttctgtacaaacttaaggtaaaccactgtccgtttatggcaattagatatccttctgaccatattaagattaaatcaagtaggggaacccttggttgtttacactattcatgatcagctttgggagcttttgggcaagctactgagatgtaacttgtgttacttgtcgtctatgataagagaatgcactgtctaattcctcgttgatgccggaagctaattgtgtttgcaccactgtgggtctgtggcatgaggtatatgaacttaggacggttccattttgaaccctctcatcccttcagccctggaatctgtgtgctactaactgatttgcagccttgcagatgagtgaagtgttggttgagctcatttatcgtaaatttctattctattggagagagatcacaaatttctcttatccattttttttcctaatgtcatttgtgatattgattctcgatgttagctcattttatcctcttttttttggtcattcatcaatgtcttttatacaactataaacgcaaatgttctgtgaagaatcaagaattcatggcgcgtgatcttgatcgagatggagaaaatgagagattgatcgacgatgtaaaggaagacaactgctagaaatcaagcaaaacataagcgatcttgggcttcgttggctatctacgctacgcaattccgtatgatcataagaccatttctgactcgtatgcacattgcctttgacgctgaagtagcgtgctaacagccacgacgcgggtgaaagagagaaacaaactttccctttttctgaggatagagaaacgaattctgtggaactatttttcaccactttaaccagaatttttttataactttcaatataattttttgaactttttaatcgaaattgaaatttcacaaaactttaggtacttcgacaaattattgtaaaactataggtttagcgcaaaatttctcacgaaactacatattttaagatggtgtcataaaaataaagattaagtagttaatttatcataaaactacaatgtttatagctctaacataacggcggtgtaaggaatttaaaccatagaatgtgtaattttgtgataacttcaatatgagatttgtagtttttgtgatatttaaccttaaatatgtagttttgtgataaatttgtcataaaatctatagtttggtgatagattgatcaaaagaacagtggttttacgaaatttactcatcaaaaaataactcccactacaaagtttttgattactttcaatacaattttttataactttctccagattttttttacaactttgataatacaaactttttttttactttcaatacattttctaataacctttctctgtgaagaatcacattgaaaaataaaaaaatctataaaaaataatgtttgcataaaaggacctcgtgcaggcttagggtttaagaatgtttttttttttggttggctccaatgttaagatcatgaggagagagatgagtaaaacttataaatagattaaaaaaacaaaaaaaatcaaacaaacatgtaaagctgagatgcacaaaccatagtttttatgcctcttttatactttcatacagggttttcttagcaaagtgttaaactgaatgaatcttgttaccgttatcttattaatctcaagtgctacaataggcataccgagttaacaaaagctctctttccaatatagtcaaacaaacaaagttgtaattatatatactaaacaacttaaaattttacaaactatttatttaactggctaaaaacgcttctcataaaactcgccaataaaaaagataaatcatttataattgcacggtgtgtacgacactacctctaactcataattttataccataactatcaatagttaaaacaatatattttataccgtaccttaccagtaaaattgtatactcggagcattagtctattaaatataggaaatcactatcttatggatatgattttaatacaaacattcatgtagtagaaatatcacttttttgagggatcgaaactcgcagcccttgagaaaacaattaattgtgtaattgtcataaacaaaaaatcatacaacactcatcaaatacactatatcataaattatgatataggagtagtactactttgttttccttctggatcaactggttccatcccatcttggcatctttccttccattgcctctctccacggtctcacctcaccgtgcaggttgctgtgcaccccccaaacgcaaacgcgatagagacgctcacgactgcacttcctgcaggctgcactgcactcgcacacacctccaccctcctcctcccctcccccctgttcactcccgcatccaattcccccccatctctctctctctctctctctctcatccatcgccccgaagtcctcctcctcctcctcctcgaggacctcgacaccttcctagctcaccgcgcgcgcgcctcgccctcctacgcaggtaaacccccccgccccctcgagctcgccatcccgcgctgatctgcggcctagggtttcagatcgagggggggaaattccgcgccgctgaccttctcccgcctcgatccctgcagattccttcgccggtgggggtggggggagaacggcggcggcgttgttgcgatgagctcgacccacgtggctgtcgaggccccggatccggggggagacgggggcctcggcgaggcgaggctggtggatgctgatgctgctgctgcaccggcggcgggggatgcggaggggagattgggtggtggtggtggtggcagctcggcccccgccgctgcgggggacgctgatgtgacgatgacggaggccgtggaggaggaggtggaggtggaggttgcgggtgatgccgaggcggaggctgcggtggtggcgggggatgcggcgggtgatccgttgtatgggacggagtcggctggtatggttgtggatgagcccgttgacgccgccgagggaggggtagatgggggagatggtggcgaggaggggttggaagcggaggctagggttttgcagggtgaggctgcgacggagcccgttccggcaggaggagatgttgccattgcttctgaagtggcggcggaagcacatgattctgctactcctgagcatgccgaggccggtaagcggaccgatgacagtttgatgtactgtctcttactcctttcgcgtcgctgaataatggttactacatttcagaatccaatgatctcgaagaaaaccatgttgatagaggaaaagataatggcgtggcggtggcgcactgtgacgacgaaatgcagaataatgtggaggggagctccgagatccaagaagatgatggagctcccacacttgagcagcaggatgatgagtctgaaatgcccctgccttctagtgtgtcgaattttgaattatgcgctagatacagccttcctcctcttgataaaggagaatttcgagtttctgaccttgtctggggtaaagtaaaaagccatccttggtggcctggtgagatttttgacccttcagatgcgtctgagttggcattgaagcaccagaagaagggcagccatttgatagcatatttcggtgacaatacttttgcatggtgcgatgaatcccaattgaagccttttgtatcaaattattcacaaatggagaaacagagcagttcagatgcctttgttagttcagttaactatgcccttgaagaactctcaaggcggatattgtcagggatgagctgttcttgtttaccggaagagctatctgacaatgggatgtcctatatggtcgagaatgctgggctcaaggatggagttacttgctctgcagttaaccggtctgagattttgtcatgttgcagcccagaaaatcttcttaattatgttaagtctttggctctgttccctggccaaggtggtgacttgctggaattagtgatagcttgctctcaacttacatctttttatcgatctaagggatgccctgaacttgcatcattccaaacaggcagtgcatgggttgagaatggtgtggacccttcttccatcaaggatgatgtggttgatgaagttgtcactaatgaagagcctcctgctaatgataagcccaaaagaggcagggggcgacctcgtaagcagaaacctcaggatggtctagagctgacagagaaaaagtcaacatccaatctttctactgataatgcctatgatcatcctgcggaaaggcagatggatatggagtttgatgaatttgacggtttacagagcaagaagaaaagaagccttgactcgtttgaagatcctgagaccaaggcggcagctccatcttttggtagttctttcaagatcggggaatgtattcggcgagctgcaagccagctgacaggatcttcatctattgtcaagtcccagaatgaacaggtgcctcataagaacatcgctgaaacagaaaatggagattttgatgtctctagtgatgatgctatcaatgagcttagtgtggagaagcgtgcaaaaaggagacggatgcataggcaccacagtgcagaccccaaggaattgttatcacagctgtgctcagtggctgtggagccaacgcacggatatagtttctctgcaatggtaattaattacttcagtgattataggaactatgttgtttctactactactgaagcaaatatcgttgagaaaactactgcaaaaaaggggagaaagcggaaggttatgccttctcctgaggtggagacaactgatcacatgcaggattcctactggtctggcttgagtttgcataatcacccaattcatgatctcagaagagcgagtactagcacaaggccaaggcgcagaaggagatcattgcgggaaacatatttccatgcacaacaaaatctacagcatggactattgagtcctaagaaacagatacaagtgatagagagatcaattatccatgttgatgaaaagatggttgatgaggtcaagcccactgcacttgttttgagctttggtaggtcaagtgctcttccttctgaaactgatctggttaagatgtttggtcgctatggtccactgaaagaatctgagattgaagttcatgccagctcgaatactgttaaagtagtcttcaagaaacgtgctgatgctgaaagggctttcagttttgctggcaagtttagtacatttggtccttcgctccgcagttaccgtcttgtgaatatgccattttttctcagctcacaaaccaataatacagaggcacactctgagtaccatggtctggagattccaggtaaacaatccttctattactttttgtaagctagtgtaaaagttggttaacattttagaaaatatttgcatgtttaataataccacagggcatttttttttttgcaggtcccaagtga

SEQ ID NO: 51368 - DNA, 6100 bp, Oryza sativa
gaagtacaggttgaggagactactacaactgagaaattgtagaggataaagaactagctgaggagacgacagaaggtgaaactacagctgaagtacaggttgcggagactacttcaactgagaaaattgtagaggataaagaactagctgaggagacaacagaaggtgaagctacagctgaagtacacattgaagaaacttcaacaactgaaagaactgtagaggataaagtggtacctgaggagacaacggaaggtgaagctactgctgaagtactcgaggaatgtacagccattgagaaaattgtagaggataataccatagctgaggagattacagaaggtgaaactgtagctgaagtacatgttgaggtagctacagcaattgataaagctgtagaggaaaacacactagctgaggagacagctaaaggtgaaactacacctgaagtacacgttgaggaaactacaacagcagaggaatctgtgggggacaaagcagtagatgagacaacaaaaggtgaaactacagctgaagtatatgctgaagaatcaaccgagaaaactgtagaggataccacagttgaggcaccagatgagaaaactaaaacagccaatgatcctgtagaggatgccaccgttgaagagccagataagaaaaccgcagccaatgatcctgcagaggatgccacagtcgaagagccagataagaaaaccgcagccaatgatcatgtagaggatgctacccttgaagagccagataagaaaactgcagccaatgatcatgtagaggatgtgactgttgaagagccagataagaaaaccgcagccaatgatcctgtagaggaagtcatccctgaagagacagataagaacaccacaaccaatgatccagtagaggatgtgactattgaagagccagatatgaaaaccgaagccaatgatcctgtagaggaagccaccgttgaagagccagctgtggaagctgggacaattgaagagattgctacggctgaagcacgagatgagaaaaccatgataaccgaggaaactgcacaggatcccatggttgaagatgagaaaaccatgacaaccgaggaaaccgtacaggagcccatggttgaagatgagaaaaccgtgacaacggaggaaactgtacaggatcccatggttgtagatgacaaaaccatgacaaccgagaaaactgtacaggattccatggttgaagaaggtggtacgaatatcgcagctgctgaggaaactgtagagcatgctgctgctactgctgaggctttggctggacaagcaagttcaaccgagcagaacgggtagcataagctggattcttgtaggttttggatgatattgcggcagtcggctcaactgattcatccaatctggatgtcgtgtggaatcaactctagcaacatagcgatattagtttctagtaactacggcgtatttgctgccttctatataaaccttacatgtagttgtcttgggagcagcagcagtgtgtcacgaatagaagagtttcttcagaaacggtggtgcgacagccagtggaccagctactggattagcatccgaattaagccatgttctttcctactacattttaagggcctttgggccaatctaccggggactcatgattcttgtaccaatcttccattttgtaaactggctgtgttctgtaggttatttctcctttattccatcatagtagctcatatttttcaggctgattctacatttctggttgcaacttatctaatctcatcatgaaatgtacattttttttccctagctgcttgattacttgtttatctgtgctagaaaggttgatgagtggtaataatgtccatttccgcttttccttgtcttaagtaattatgtttgtctaaattgcaaccagttgtactttgatggttcagatagtcagtaaacgttatttttctgtaacttctatcgagttgggctgaatcctaacaggcatccagatttttcagccctgtttggtattttatcccctgcgctgcaatagcatatataagtccaggcaaatttttctaacgcaaaatagcgcccacccaattggcgaacatcaaggtgctcacaaaagcttgatcacggctagattggatgaaattagctcttttttatttctttttttaattggaaatgaagcatgctcacaaaagcttgatccgatcttatcacggctagattggatgaaattagctcttttttatttctttttttaattggaaatgaagcatgctcacaaaagcttgatccgatcttatcacggctaaattggatgaaattagctcctttttatttctttttttaattggaaatgaagcagccaagttttgataaagcaaccttcagttagcaacttggcgtaggtaacataaactgagcacgtccccccaaaaaacaagtactccaatagataaagccaacatcgttcacatttcacggtaaatgtgatacgccaacagcatcgcactcttgtttggacttcaagagcgaccacacatgggagggagagaatgggaatcagagtaaaattgctaccattacagagagcatctatttctcaatagtacaacacgctagttcaggacgaaatacaacatgaatatttatgcctcccaatacagattatatggaaccgaatgacagccaaagaccaattgttaaattatcctgaatatacatacaacaacagagctagaccacgaaccgaaactatcctcacggggagtaatttacatctgagaagcagccttggctcgacgcttccaagcagcatcagttcctggttgacaaacatgggacctagaggtggtagcaagttacttccttcactgctcaccatgaggtgtaggtatatatattagctaacgactgcagcaccaaataaaatccacctgcgctattagcaaatgtgtcggcacatgaaccattcccgtacaagatatcaaaaattcgaaatagcatatggttcttcgacggattaggtatacctagcaacagttgcatgaaaaggtcctatcttcagtttgagacatccccattatggtactgggcaaggcaaaagaaagaaaaaaacatcagcaaacgtatcgagatcagatgagattatgcaagtggcaatatcttatgccagaaatattgaaaagtgaactcttacactcaaacagtaactttgtgcatgtttcagtttttttaatggattttgcccagatctaaccaaaacaaaaaaaggaagggaaacaagctctggctggatgcattctgctgaaggaaatgcacctagatttatggatttatcattcatttactgttcatacacaaaatatccagtaattctttgatctcagtaactagacaatgaatcaacctaaaagggacagtccaacaacatactctctgtaccaaaaaaaacaacttgctttgaatctggacaaacatttgtctagattcattgcaaggaattgattttttttggtacaggggaagtagaggatggagaggccaatcatgtttactactccaggaacttccaaacagtagaagtctcctaacactgaagaaacaaaaggacggcacaataaggagattaaaagttatcttctcatgtgtctctttaaaatgaccagtggcagtagaatggtagcaggatggcactactagatatttaccagagaatctcacgttcatgttattattagaacaaatataggcataataaagctgataaatctaaactaaacgtactacatggccagtaaaaatatcctaaaacaaagaggaaaaaaatcaaacacaactgtgaatcaactagctaatggaactccccgaagtctaaaccacaatattgtcttgtatgctcccaagacatgacggtatattcagcaaaatactttgacaacgatcaaccatgtgtatatgcatactgccagtaattccaaacaattgaagataaatcacctgaggttgcatataacccattccttgattgtatgctgcttgttggcccatctataaagaataaaaatagtgtaagttcacatcctgttggacaggaacaagaaaacaaacaagcagacactaaccccttgggcacttgaactgcttcctccatgagaaccaagtacatcctttttcacagagccatcaccagcctttgcagttaatttactatcaccctatgttttaatgatgataaaagagctgagcaatactcaacacatctcagattttgtgtaggcatgatagtacaatcatgaatcataatagaattcttggtcttaaccatagtaaaagagtgctctgcttgctgtatggtgcagaatcatgattcatcttgtctttttacctattgattttcaaaggcatgtagcatgcaattttttggcccatatagaattgatacagggaaacttgataaaaaatttgtttcactcaagactatacgaagcatcatagtacatccaattgacaagaacaaggtatatatacgatctaaaactgatggaattattggatcccatgaagagaattctatatgccttcaaaatttggacatagctagctgcacaggtgagctaagctcatgatgcagacaggattgtatagatcaataattcattttcaaggctgattttatttatgaactttatatatcttgaacatttgcatcttagtgtctatgaaatatgaatgcctcttagtgtctatgaaatatgaacacaaagaaaagcatggatttgtaggaggcactcatcatcaagcaaaaaaatcagtagcctatggaacatgataacaaaatagttaaataccacgtacctccatctgcaaccagcacagccattcaccaaacaaaaacaaacaagagaagccatattagattgataaaggagacttaacaaacgaaaatgacaggcatacacaaagtattaatgttttaactccaggctacactaaaaaaaatgttgtagagaatttggtctttttttaaagctacactatgatatgtcgtgtaagtaggaagttttatcttcaggtaagtaaactttcagtgtaaaggtgatctttttataggatctctggttgattcaaaacattttactgtatttgcattggatcttataaaatttaagattgacggtaaacatggtaaatgaattaaatagcattttagtagctcaacgattcataaaaatttggacttggtacaaggttagtaggttactgcaaatgatcactgctgtgttttcaggtccaagcaacagctttcaattaattaattaatgtactaacaccatattccaaccattcctttcacggtataaaattggaatcataaagcaagatttgctgacaagaatctttcttccaaagcaacatgagctaaagaaattagctcataccacaaacattacaagttatccatccgtcctcaagttgaacaaattactagagtatactccctaataatattaaggttaccaagcaagttattagtaattcagacacacctcgaaaaagcaaactagcgatgtccctacctaactcgcaaagcaataactaaacctttttaaatcaacagagaatcaccccaattccaaacatccacatcagtacgcacctctctgtacttctgcaggtagaccttgaggggctcgatgtagtcctcgaagcccagcgtggccatcgcccacagcaagtcgtcgccgttgatggtcttgcgcttctccctctggcatttatcgctcgccctgtaatgttgccccaccacaacaaaaacccagtcacatctcatcgccgccaacgacaagtcaaacaacgagctcaaagctcaaaactcaaaagaagacagagcagagcagagcagagcacaagaggggggaggacgagggcgacgactcactcgctggtgatgaaggagatgaactcggagacgcactcctgcacggtctccttggcgtccttggcgatcttcccgttggccgggatggccttcttcatgatgcggctgatgttggcgatggggaggaacctgtcctgctccctcacccccccac

SEQ ID NO: 51369 - DNA, 7898 bp, Oryza sativa
tcctccccccgggctccccggcccatcagccatcccacctcccccctcctgcaccaccaccacccaaacccaaaccctagatccatcagtccccgcatcccaaaaccctagaaatgggattcgagcgaaggagagagaggcgtaggcgtaccttatatagaagcgcgggcgcgcgcggagagggcgccacgtggagaggagagagaggggggttgggcgcgaggtggtgaagcgaggaggagagagagagagagagagggggagaggagagagagaggaagcgggggtgggaacggagcggaggtgaggcggagaggcgagagggggagatcggacgctggagaagagaaggcggctgaggcgggcgcgattgaaggggtcggggtatcagggccgttcgtggaggggtatatatagggcggacgcgggcgccgccgcgtggggggtacgggtgagggtttggctgactgggtttgcctggccggtgcacggtggaccgggtgtaggggtctaggggaggagatttctttttttcttttttgctttttgggtttttcttttgcctttttgtagccttttgttttaggttttttttagaaaaaaaaagttttggattgaggtgagtttgtcgtttggtgagagtgcacacaacgtgggggttttacagttttacatcacaaatagaatgtgagatttgccataaaaaacatttatgatttgctttttttttcccgcttcttcctctgatacacgaggcatttgattttatgccgttcttaatatacgagtgaacatttgttatatatcaccattcatcagtggagggtaattagccgggaatattagaagctaccgctgctatacgtgacgctgacctcaattatttttgactggatggagtattttattaaaggttttacattgccataggttgtaaagcagtgtcattgtaacaacaattaaatagctacttcaagcgttaaattttgttttaaaatatagctacttcatcacttgttatattatctcaaccaattacaaccatatttcgtatagatttttcacataatttttcatctaaactaatcacaattatcactcgtttaatttcatttcgcttcttagtttctgtaaaaagttctacaagtacttgtatttttaagcaaagtgaataagttaagtaatacctattgaatacatacatggataattggatatgcttgtaaatcgatcggcagtgatgacaagtccagaactaaggtatgcgcatctaagccatttaattatattataggtcagcttttactaaaacgactagaagactgtgatagtcctatgaaaatatcaatactgaacgataggacgacaagatatttacaaaaggcagacatgactaacgtgtttttctgagggaacaaacagatggtatctgaacagacagctttatgtcaagatgttccaagcaaacaacattatctttttggacagaattactattacaattataactaacaaagtatttgaggaccgaaaacttttcttcagaaatgattatcatctcttgcaccgttgcacgtgttctaccctttcactttgcgtcccgtatgtgtaaagtcaactgcggatcgcaagatgttgcagctaaataacaaccttatcatcctcatcctcggacacaattacaattaaataagatcggcaagatcaagctgcctgatactgcaagtgattgtgcaagtgagaattttcttttaggttttaaggcttatggacaaagcaacaacatgaggggagtagtatactagtagttagtatagcatatcatcatctccaggacctatacttaaccggcatatattcgacagatgcgcatgattgccttccgctatttaaccgggacagacagacacaggactcccatcgcatctggaagcgaaccgtgtcgccattttctagcgacttcggccgtccagcgaagcaaaacttttggcgtcaacgcgaagctttgcggaaacacacaatgacacaaacacaacagcagctcaaaagtgaatgcagacacaacctcatgctgaagccaacatgaccacgaacacgtacatgcgaaatgtgtccccacaaaggcaaggcatgaccttatcgaaaactttaaccctgcctatatcaaaattttcgttgctaccgattttttgattgggtagagaaccaacccaagcatagagcgacctgttgttgaaaaagaaatttacatcgtaagaattgatccgtcgtgaaatctctgcaccacgagcagacagtcctgaaactgagagctggtaacaaatgcttccaaacgtattaggcaatataagctccaataggcgaacagaacgatggatagtaatagtattgaagattttcaccagccacgtatatttacaccaaaagagaaggtttgcatcaacagcagcgagctaagctgagagtcgccatgttcgcgactacttgagcacacctacaggcaactaccactatgtacagagaaggaagggcatgcgccacctcagttttttccctttcctaacatcagctccacccgaatcatatgtcttggtaagttaagcagtgaaccacccacatttacaccatgttttcctacgtgatacttacaaaacacacatttctactgcgtgtgatggcatgcgcagctagatgctatcagtttcaagtcaagataagtggaaggacccctgaccttccgtaatcgcgtagagtagtttctccctcatcttgtcctgcagattgcgtataacaatttggtgtcaatgcaaatagtactggaaatcaagaactaatcacggaataatatctttaactactttaaaatctcagtcgttctccctccccttccaaaaaaacggctctagaaaagcccatgaaagaaaggcataaacaaaactgaattacttttttatcttcggatatgttgcacgcacaggcatgtaactagtctccaaaatatgcaagtgtggttttgagattttgacttaaacctaggcaaaaccgtcaattcgttctagttatagtttagtagatgatgtctcatacggtgacataaatgagggattgatttaatttatgaaaattccagaatataccagtggactgttaaaaagctaatcagaacagtagtatgttacagaccttggaagaataggggggtaactttagataattagcacaagtcatcacactcggaaggtcatcatcagcctcgttgctgttatgctgctgattatattacaaaatattagggaagatagtaagaaaaaacaaatcctaaaagaagtatataatgaaaacagacctttcggacaaccgtcaacttcggatttagcgcagctaacccacccggtgggagtcgaggtgaacctgttataaattgcaagaaagctctgcgttgatggccttcaaactcctgtataacctccaacaactgcaatgtatttggcatgtaaagaaaagagcctttactaccatttcagaataaaatatttaaccgtctaaatatatgaatactgaagaacttacattaatgacaggagggctgctggaagtgtagccatgatcaaactttatatgatccacaagtttcgcaaactgttcacaaacaaggatcagcaagggcggtagaatgaacacagaagtaacaacaaactccacaaaagaaaggcgcttacatcccacgtatcttgttcaccgcagagtaatcgctccagctcatcctctgagaagacctggagcatgcttaatggaaatacctgcatttcccaatgtcagtttcacaataaaatggattcctaaaggacaaatgccaacaacacagctttcctcctaattataaattgagacggagggaacggcacctaaaccctcaacatatctgaatctgttcaaatgaattgaatggcgatgaaaaattctaagatagcgattcgccctacctccctgcccatttccatactagcatatcatattgctaatgaaaaccaccatgaaacatacctcattgaatcctgacttaaaagcttccagctgtcttgcaattccacttctaattgttgcatcaacaacaaaagaaacatactgttctaaattgtcagcacttacctgaaagcaacatgaacaattaagtaagagtctaatcagctaagaaactgaaagcattgaagtgtatgctcatatgcgcttacattatccaagctattttctaaagaaagaacatattctggatatcctggaagagcgaactcaatagcaagatcctcaatcctgcaacctcgataagacaaatcagatgtactcttgcagtccccacttgaacttgattctaaatattttctccgagcagcaagtgctttaaactccataagggtcattgctagttcaggatcaaatgagtgaatgtcatatatattaagttcctaagaaagaaaaaggttatttagagacttggaaagtatgaaagcatagcaaacttcatccagggattcagtccaaaatacctgtcctagtataagcctgtaaaatgctttagaaaatggaatgtcgagaattctgttgtctttaactgcctttgcaacgacctgaccaaggaggtggaactgtttattcacttctgagaaggaagaacaatccacatgggtggaccatggtttaggaaaaagtccattaggggcaaccacaaatacagaaccaccatgaacattatccaggccagcttcgccggagagctcccctctccacatgcctaaaccagacttctgaaactcatgacttatcaatgtatagaattccatcgtaggacccaagcctgtgcctacttcctcttcatattctacttcaagcattgcattactccgagcatgtgattgcatcactttagcagcagaaacaagtatattgtcgcgatcaactttgaactttttccgtgagaaggaaggcaccctttctgtcattacaccactgccacttgtatccatcatattcccatgttgtggggtcaaagaaccaaatgctgtcagctggaaatacttccatcttgcctcaaaagaaaacaagaagggacatgcagacatcagttcagtgcaccataaaggcaggcaacgagaccttaaaaccaagggatcatgcatctgttgctccagtttatctgtcaatttagcactgacaaactcctgctgtggaactacagaaacatcaactttcagatcatcaaggtcagttatgcttccatgtacaaaagcacggtttctctcatcagagacgaggtgaaaagagtatcggttcaacccctctagaacttttagcataaacaatatgtcatatgatggacttgatctgtcaagtttgcaaggaagtttgccaagcaacaggctagtgaagaaagggagcgtctgacaaatatatccagctttatcgggatgtgctggtgttgttgcacaagatgaatacttaagaggatcatcaatttctgggtttgtagccgttctatatgttacatcatgcacaatgcgccaaaactggttgtccaatattatgtcagaacctgcattaatctgatcctgcaggattgattgatacagagtaacagattggtcaagctcttttcctttcaagctaaataacaattttggttgcgcagcatgatcacttgtgtttgtctcttgttggcctgcacctgcacatgcattgcagtattgaagtttccagaataagaggaagtatgcaaacaagagtttaaacataagtgtttcacgatcgccagactacgcttactgtactactcctgtacttaccagatgacgaaggccctttatttgagcctggttctacagatggactttgatttcctattataacaccctgaaaaagagaaccattttagtcttaaaagacaggatggccatcgaagtaatttacaacgctgtcttttgtcagatatagcatagcaactgctctttttggtacagaacatgttgctctggaacagcaactaaattaatttgaccaaagatgtttctgaaatattttttttggatacatgaaaacataacaggtaattttagtacaaaaagtatacatcattagactcttttaacgtctttattaaaaactagcacggtggcccgcgcagattgcgcggctagcatcattatattttctctcatataatagcatatatgttttctcattatattattaaaatatattacaatgacaacataattttaaattttgcaataacttttcaaaactactaatgtgtaataactactctagtctcctcttctaatattccctattttttaattctgaatttcagctatttctaaattgtatttctatatgtactctgctttttttttctgagattaatgtgagaatttctaggccatgagagcgaacgtggaggctcctttttattccgaatttagttggttttaaattccaatatgaactatatactctacttctaaaattccttattttttaattccaaatttctatttttttcttaattgtatttctatatggactctatactctacttctaatatttcttatttttaattccgaatttcggttatttcctaattgtatttctatatggactctatactctacttctaatattccttatttttaattccgaatttcagctatttcctaattgtatttctatatggactctagtctcctcttttaatattccttattttttaattccgaatttcaattatttctaaattgtatttctatatggactctaagtctcctcttctaatattccttattttttaattccgaatttcagctatttctaaattgtatttctataaggactctagtctcctcttttaatattccttattttttaattccgaatttcagctatttctaaattgtatttctatatggactctgctttttctttttctccgattaatgtgagaatttctaggacgtgagaacgaacgtggaggctcctttttttcccaaattttagttagttttaaattcctatatggactctatactctacttctaatatttcttactttttaattccgaatttcttttttttttcttaattgtatttctatatggactctatactctacttctaatattccttatttttaattcagaatttctattatttcctaattgtatttctatatggactctatactctacttctaatattccttatttttaattccgaatttctattatttcctaattgtatttctatatggactctatactcctcttctaatatttcttattttttaattccgaatttcaactatttctaaagtgtatttctatatggactctgcattttctttttctccgattaatgtgagaatttctaggtcataagagcgaacgtggaggctcctttttttttccgaattttagttagttttaaattcctatatggactctatactctacttctaatatttcttattttttaatttcgaatttctttttttttcttaattgtatttctatatggactctatactctacttctaatattccttatttttaattcagaatttctattatttcctaattgtatttctatatggactctatactctacttctaatattccttatttttaattccgaatttctattatttcctaattgtatttctatatggactctatactcctcctctaatattccttatttttaaattccgaatttcaactatttctaaagtgtatttctatatggactctagtctcctcttctaatattccttatttttttaattccgaatttcagctatttctaaattgtatttctatatggactctgttttttctttttctccga

SEQ ID NO: 51370 - DNA, 3347 bp, Oryza sativa
tggtggaggggatgattcgggtgaggaatatctttcctggaggtcatcttcaagatatttgttttcagaagcagtaccattggccgatgattcaggcttctgattgcttgtgcctgtacaaattttgggccacaagaactcttcaatagtgtgcaacaaggaagagatctccaaattaacaacattatcatagctcgacaagttggtttgatcttcatccttcttaaatcgaactcggatacatggagtaatcgttgagtgcctagtagggatatctgaaatattgttcctcggcttgaaattatggctcattatcactgggaagttgtcaagagaagtaagagcattctgcagtttccttactaacagtgtcaagagcatatcaccccagccctgctccattcttgaaaaagatatctgagtaaatgactgaaacctttttagcacggcaagaaaatgttcagtattgtaatcatttgggattctctccaattggaggtacttgccattggagagatagttagacaaggatttgatcaatccactctcaagaaattcaaaggtagtcattgtttctcccccatgaagctccatcatcacctcacttaaaatgtcagtcaagtgctcttcattttgtatattgtctcggtttaatgacttatcagcagaatcgttcagaactgcgcagcaagttttgagcttttgcaaaatctctgtcaaacccatctcagagttcactgcttcggtagtgaaataggttgtcttcacatgccttgcgaaagtaaaaaggttgccctttccaatcatgcaagtccttgtttcagcagcatcagatctgggataatcaaatgcatagcagaaacatgtaggcttatttcttatgataggctgattctctgattgttgtgcttcatctgagagattagtagactttgaacaatcttcttgcataagaagagcctcaactgcatagacaacaccttccttgataaaggatccaaggtaagcatcaggaagcttttgcatgagaatttcgataagctttagtgatgagaatagcacatgatgatccttccgagacaataaaccagccaagaaactgccacagagatcacaaaaataaatctatccgtctaaaatcggcaattttagcacaacaaaaatgcaattgatcttgcttatggctatcatgtaaaaaatagaatcttgccttggtatgttcgcatccttgagcaactcttgaagcatttcaggtttactgaaataacagatgttttttacaattgaagcacatccatagcaaatgtatgaatttgcaccagagttgactgcctgcacgaaacaacatactcatttccatatttcagataacaatcattattatgacttcttgtgattgctatcaacggaccttgatcaagacaggaagaatctccatagagaactgacacaaaaaccttggttcatctacaattattttttcttttgcaagtaccatctgggtatcttcaacatctcttgctgcagaaggaataagttggtttgctaatttcaaagcttcattgacctgagatcagcacaattaagtttatctcaaatcatgtacattttacgaatggccctcgtatataatcaaatgaagtaaattagggtggtgcatacatggagtgacttgttatgcacaccaatgcaacttattagattcaagttctaatgtaacaaggtaaattagagtggtgcatacatgacaagtaacttgttatgcacattagtgtgtagcagggacaaacatgtgtcagaggtcagatatcagcaacctaaggtagaatggcgctaagcacaaagtgatacagtgcactaattgggtgatgaataggtcacatcagagcttataaggaattaaaaagactaatcaatccatcttgtcatggtgtagtgatgcccataaaagccgttacatcttgaacaaaccaaatataatatatactaattaagtctacagataagggtataatcaactgataataaaaaattgcactaaattgcaaccaaactcaattgatatcctactgctgctgccaccttctagtcttaaatgtctggaagtaagaaaaccaacctggttgctttggttttccaaaggcaggtaaggcatgccatgtgagagatctgaagtaaccagaattctgcttatggtgttaccaacattcagctcaaagagagacttcacagccacaagtgaattgcaggctagcttggcgagaagcccaatcaagttctgcaatcaaaacaaacaacaatcaatttcctcaacacactcgggtacatgcatagaagtttaactgcaagcatacactgcatgttgatgggctaagagaagttagcccgccagtattgatcagaggcaggactttctctatcacaccctggtgacagaacatgtcgagaagctccactgaactactaaatgaatccacgatgtttatcaagcaacttgcaaccttctccactacctgcaatgttacatcactttaaacataagcacaagttgcatacatacccctaaacaagctcagtttgaagaatgaacaatggtaccatcttgtcctcagactgcagtagattacacaacactggcacagaatccatcacaaattgggagcaatctttggggaccttcttacaggcattcgcagcagctgagaccgcaaccctctgaacaatacaagtaagaatccaattggtggatgtagtaattcgtcagcaaaatatggaaatcgcttgcgatgctaacctggatacttgcagagaagaagtcaatgtacgtgagcacagcagtgatcatgccagcctgcaagcacggcgtcggctgcctctgcgatatcttctcgaatgcttgcaagcactgcgcgtgacacgatcgcatacaacacgtcaggccaatgtgatcgttcgatcgggtcgtcagagccgctcggttacctgctcagcgacatcaaggtactcgatggcgaggagacgggagcagagcagggggagcaggccgtggcggacgacggcgtcggcggcgcgcggcatcgcgtcgcagaggtacgtgatggcgcgcacggagagcagcatcacgtcggggctcgccgccgccgccggcgcgccatcggcgccgcccccgaccagccgcaccagcgcccgcgccgcggcgtccgtcgggaagtatcccccgacgtcctccccgcaaaggagagcgcctcgcagagctccgtcagcgccgccaccaccgccccctcctccgcgccgtccgccgccaccgccgccaccatccgctggaacctccctcccccgccgcacct

SEQ ID NO: 51371 - DNA, 2793 bp, Oryza sativa
atatatacacggaggcgtgcgtgggtgggtttagttcctagcggtctagccaccccacccctcctcctccgcgatcggttttgaaaattgcggggatttcaaccgattttggtggaaatttccccgtgtttcgattcgattctactacgggttcggctccaccgccatactgtgtgttgtgttgtggtgtggtttcgctcgcagcgtgtgggtgggtggggttgggttgtttcggctttttggggcggcgcgcgtcgacgtgttgcgctcgtgtttgctttgggtatggtgtggtttgtggcggattggtacgctgcgggtgattatgctgattaggagggtgattggcctaggttgtgtttgttttgttctttacttccagcaaaaagatgacatgctgactatgatagtaggatctcacaaggcatctatttggttagttgtgtaggtttttgtgaaaagggagacggcgacaattaatcttttgtcaatgaaaggaataattgggcttctttgctaaggaagtaatcctttgttagggaaggattgaacttcattattaaggaaaaaaatcctttgttacaagttcagatacatgcagttgccataaaaaacgattcatcgggaataggacacatacgattatttgaaattacgcgataaatttaatgttcacgaatatttatatttatctttacctacttaaaatattgataatagtacttctttcctttggttgtgttagttgtcatttgttctccaatgatctggtttagtttcctatttagatatattcattgtttgactctacgaaaagtttttcctctttccttgagctgatttaggagggtgcctttggttggttttttgaccctgcttttggctttaaaagggctcaaaagccatagctgcatctacccaaaagctgcttttgctctagtacaaattgaaagcacctccaccccttactttcagctgcttttgggtcaaatatttatccgcctgccactggttacgtggagaaaataacgtttagcctcgttctattccgcatcgcgtccgctctgtcgcccccttcggcatcgcgtccgctgccactcgctacccgtcgtcgaggtcctccagacctgcccgagccagctaccggaccttcgttgccccaactccggcgagtccaggaccattgcggcgcgagattcttcacctcccctccccgtggcggcgtggctcccccatccccttggtcccatggccggtgacggggcgggagggcgtgggaccaggagcgcgatctccaccgcccatctctgcgcccctcctccattgctggctgcaagcgggagctcccgagcgcctgagcggaggaatagggtccccgacagaggaacagccgagaccaagcaggattcgtgtcccgcggtcaagggcgcgggtgggattcttcctcgacggccgcgggcgcggacgcagctcttgccccggtggctgatagccaaggccgcgtgtgggattcgtccccgggtggccatggcaacctcgcgtccatggtgcttgcctcctgttccctcgtcccgtgctgccttcatggccggccacgcgagcctaggatgtcctgcaactggctggcgagcccaagccggcgtgccccgatagtgagtccccatgcgaaccgtgtgaggaagaagatgaatgcagtgaggctgacaggcagggtccagccgtaagtgagagaagtattttccaaaagccacagttgatcaaccaaacgggcttttgtcttcctcgtagctgcttttccaaagctacttttgcaaaagccaaagcccacgtctgcttttccataagctactgcccaaccaaacacacccttactccttccgcgcacggaatatggaggagtaggcgtgcgcggaaggagcaagggtgtgtttgctacaattcttgggttttttggtctttttttaatctttcatcccccacgtgatcaacacaaacgaaacacgcgattatagtgagattaattaagtattagcctaaaaaacttgaaaattgaattagtatgattttttaaagcaactttcatatagaaaacttttgtaaaaaaatacaccgtttaagagtttgaaaagcgtacgtgcggaaaacgagggaagtgagttgggaaagaggggaaaagaacacaaccctagtgtgcctcctattctccatcctccttcctctatacccctccttgtccgcccccttatccccacatgtacaaataattgaagtatgcacgattatttaaaaaatatacggtcagttttgacgttcacaacatgctgtctttatcgttatatagtttaaaatttaataacatttatgtcttttttgatttgtatatgttatctttcgttatccattagttaaagttttgtttcctattcgactttattcatcgttgttgtttcatatttccttaaaacgatttcatcctcttgcatgcctgatttttagtacccaattattttacttcttagttatcgcctttttctcgttcattatactcgagcatagtcaacagcaatcttacatgccccatcttctccacctcccctccccgaactcctccttgtccgctcccttttcttcctctcctagatgaggagcatcaatgttatatatgttgtacttgttagcacaccttttaccgtcatgatatgggctattttagtcggacaaatcgttgaaatttaaaacccatattgacagtatacttaaaaaagtataaatgattaaaatataattttaaac

SEQ ID NO: 51372 - DNA, 12513 bp, Oryza sativa
cagttagatagcatagagacatggactagttgtaaaaaaggaggaaaaaaacattttgagccaagtccatgcatctctcttggtcttggagcacatgaacagctgattatttttttatctgtgtgttagcatagattgtgttcgaatgaaaaaaacaaaaaagacaggtaaagcgagatgagccactaattattttaaacctagaaataaattaatatattttttctataacttttttttaaaaacataccgtttagagcacccgtaatggtaaagtaatgtgccatatataaaacatttacatctcagcaatagactacattaatagtaaaccactttaatggtatatctacatgggtatctatagctctctaatctattgcctcgtttttctctatagactatctccaggttagtagatagctttgctctctctcttcatttaatctcttccaaatagaaaaatatgctgacatagatcttttgtagagagtctatagataatcattgcgggtgcccttatcagtttggaaattgtgtgcgtgtaaaacgagagaaaattcatctctttcttgctcagtacaacgcagcctcaagtaggaaggaaaaaaaccatcacgatttacgaaatacagtattgaagacctgctgtgaattgtgaatttgtgattgggctcgaacgcgggccggagaggggagagctcctcgccgctgacatgtgggccatagtaaaaagtgggacccacatgtcaggtctgcttccgcccgctgagcttcacgccgtcctcgctcgccgcgctaaaaatttcgctccgcccgccccccaactctcctctcccgccgccgccgccgctgccgcgcaactcgccggagagagaagggagcggcccatttctcaggcgaacatgtacgacgatggtcctcgcaagggaaaacccggcggcctctccatggacgccgccaccgccgcggggctcgcggcggtctggccggagtacttcccggaggagagcgagttcgccgcggacggccgcagcgcgcgcctcgccgccgacctggtcgacctcttctcctcccccgacgcgagcgacctcctctcgcgagtaagcggtggctcccctcccccatttcattcctctgcggcgttgcccttcgagctctcctcacggcggaccggcggtgcccatgctagggttccgcgcttgtggtatggtccgattgttgagatcggttcatgcgtgatcggtgttacaacttagaatatatcagtggtggcatttctcgataatgtctacgattttagcggatggacgctccaatcgttaattgaaatgttctggaaatcgcaactaaagtgagtactgtgagcaattcataaatgtttttctaaggaatcttcgcaagtgtttactttgtcttaaacaagagcaagtgtttaagcttgtaaaggttcctgttatagtgttattacctatttaatttagctcgttcagggagcttgcaactcgatgttaatgggcgtttagtttctactctcttaatgccttaattgcgaatgcatgaatttcatatgaattaggaaacaattcaatcattgcaagaatcttaaaatgcgaatttgtaatttactctctttggttaatgtggttactagtagttaccacttacaacttcatggcttcatgcacaggtcgaagatgatggtgatatcctctcccttccagttgatttccagcagctatcgaatttgacctggattactgaagctctccaggaaaatccaaaagaagccttgctttccatgggagctgcagttcatctggttgatgtttctattcatgttttcctagaattaatgagcctgttacttttgtagtgctttcatgtttggtccactatacctgatatgtcagttcttgatattttcttcagattgtgtgtgctagcagggacttgcagttgggcgacatcaacaaaatcaatatcaggctttacaaccacaccaagactattgccttgaagaatttaaaagcggcgtatattagtaaatgtcattctgccttttatcatcgcgtgctaaagtttgtgcacatataaatcaaagtactaatttgtagattcacttggcagagaaacttgtgacagtgcgtggaacagtcttaaaagtaagtacggtgaagcctctagtgctgcagctgaatttccaatgcatgaaatgcgctacaaaattccctcgtgtgttctgtgatgggaagttttcacctccagtatcgtgcagtattcagggatgcaagagcagaacattcataccaatgagatctactgcaaagttgatggattttcagaaaataaggcaagtgataaataaactactacattatcctttatttatggtactaaagcttttctcatattgtttccaaatcaggatacaagagcttgctagtggtgaaagccatgaagaaggcagagtgccacgaactatagagtgtgagcttacagaggatcttgtagattgttgcatccctggagagactgtaacagttactggaatcgtcaaagtactgaacaactacatggatgttggaggaggtacaatttttgagaaattaatatttctttgcattacttctttttctaaaccttgtggatttactggctcacacacaggcttcaaattttgcgttttcattggcaatcattggcaaaaaatgtttatctataaatgcctcagatttgttcacaacacctatagaggcacatatgctgtcagcatcttgttttatttgatcattaatctgattggatgttaatgttctgattagagagccttggccatctaccatgtgacattacgattttttttttctagatggagcagttgaaaagaaaatagcatttgagcaaagcaagaaaatagctttctatttttttgtttcttccagaccatatatcctaaatctgatatatagaaatcagaatcaccagatcaactcatggactactgagcataaacagttcattagaagcattattatagtccatgttaactatagggaaacctatctaatgctgtatttggcagcatgagggtatctattttacctctcccccactttacattcttagaacttgcaagatcatttggtctttgttagatatatgcatgctttctatgagctccttgaatttaagaatcaagaaattatttataggataatggagaacaaattagttatgatgtacagccttactattgtttgacccttacccgctgatgccatatatgcagataaactcttatttgatctgagcttccccccttctaatttcttaattttacacaatatttcatttgtatcttcagggaaatccaaaagcaggaaccaaggtttatactacctgtacctggaagcaatttcagtaagaaactcaaaggtccatgctgcttcaggaaattcagatgctgctagtggatctttcggttttcaagcttttactgaaaaggatcttgaattcatctccaaatttaaggaagaacacggtgctgatgtttttcgtcaaattcttcactccttttgcccctctatctatggacatgaacttgtaaaaggtattggtattatacttatcttccatctactatttaatgtggttaaagatttaaatttaattcactctgagctgacccaataacggaatgaaatattttggtgaaacctaccgctccccttaatttctgtttacacgaaatgagataacaattcctttttttctttttattcaattagttctggaccgctgcagcattttctgcccaaatgatcttctataggaactctcttgtgctgcatgaaaaaaatgagaatgtatctcccaagctcctaaactgtgatttttgcaaaaactttctatatataaattgcttagaatacttttcaaaaacaacttttgcactttgtaataattaattcattcgtttgtacccttgaatattatcataaaatcagataatctatcatctattcatctattcagaacaatcaaactgggggtggtgaaattgactaagctactggtagttcccgttctctgagatatgtgtgttctccttttcaactagagcatacagcacccattctactacactactgtttacaaacatgccagcccttcttggtccttttcctgctttgcattttattgctagatacaactaaatgaatatttccaatttttcagctggtatcacccttgcgcttttcggtggtgtgcagaagcactccattgatcaaaacaaggtcccagtgagaggagacattcatgctgttgttgttggtaatccttcacttatagagggtctaagcttcttggtaagaattttcttagcatttctcacagtgcaattaaaactcttgctcaatgcaattctaggtgatcctggactaggcaagagtcaactgctacaggctgcagcagctgtttctccacggggtatatatgtttgtgggaatacaacaacaaatgctggtctaactgttgctgtggttaaagattctatgtcaaatgattatgcatttgaggctggtaagcatatgagattgtcctttgtcccttccctagactgttgtttaagttctgttacctaactggctgtctgtcctggtgggtttttgtcttaaaacctgtgagtggaacaaaataagtactcccgttgttccaaaatataaggatttctagaactcaaaacattgtactccctccgtcccataatataagggatggtatgtccagattcatcgtattaggatgtgtcacatccacccaaaatcctttatattacgggacggagggagtaccagatataagcatttctgggcactgattccaacgcacagaaatccatatattttcagccaatcagttgtttcatgttcgagaggggaatctaagcaattcaaaatttgacaactgagatgactaaaagggaatcttttcccttaacttcattatttgctaaaaaaaacctagaaatgcttatattctggaacggagggagtaggatgcaagtgggtctggtagtattttttttcttgactaatttaatggcacatacataaagtggcctatcaaataattttgaccctttggtttacaggtgccatggtccttgctgaccgtggaatatgctgtatcgatgagttcgataaaatgtcagcagagcatcaggttttaaccttgtataagcttcactctgaaatgttaattagaaagccctaacctgccacatcatgtttctaatgaatttgagttcataggctttactggaagccatggagcagcaatgtgtatctgtggcaaaggctggccttgtggcaagtttatcagcccgtacttctgtgctagcggctgctaatcctgttggtggtcattacgagtgggtccttgtgtactgcctgtcattcttgatccatcatttccgttcatattttccttttcaattgatattgattatagtttgattgtggaccatccagtccattcacacatagccagagataattaagcaccaatgcattcagcaaggtgaccgggaggaatagagatgggtccataaagttagcaagaaatagcagcatacggattgagtccagttattttgatagtcagcacaagatcttgatagagtttgtttcgtatgacttcatattcatataaagggttacatcgtgcatccctgtgatgtaagctagtacatcgggtgttaaacacttcagaaaagagagtgaagggctgaaggcgacggtttggatggaggccgcttgcttgggttgataggaactaaactactttcaacgtgagccatgggtcatggcagatttcttgtactgctagtatgttcaattgctgtagtatagttgggaagtgttggctactggtgtttttgctgcaagtgaataagacaaacacatagtataaaaaaccggaccgggggtcgacccgctctggccgtcggttcaccggtcgaaccgccggtttatttatttattaatattatatttgatttgcattaatttaatatagaaccatcacaaattggtggaaatttgcataaataaaccagtatatctattattacatagtcacaacataaaaaaataaatgtggtgtggtaacataataaattcatcatgtcatattgccataggaaaaataaaaactggttcgatacttaaaaacccgccaccggttcaaggaaaaaccgcccggttcaccggttttttaccggttcgattgcatgggtggtcttttagcagaaccgaaccaccaaggtggccggtttcggttttttctggttcaaccgccggtccgatccagttttttgtactatggacaaacctgcaagtaataccattctccattcatctcaaattatttagagtacattttgcaaagctaacatttatgtgaaactatcatagccctacgtatttaagtttgagtttttcttttttggcataactacatatttaggagcaaaaatattcacaaacctatgaaacattgtatcataaccttgcttacaactcgggttcactcttcagtgacgaaagctaaatatgtcctgttacctagggtggatgggggcacatcatattagccacctggaatagcttgttggttggggtgcgtatcagcactaagggcattatttgaggaggtaaaggagtcgatgggagggaaatgatgcgtggatgctcatgatcttgaatctttaattgtcagcggcgcagagctgcagcagaagtcacagtttcttgcgaaagcagttttgtatgattgttctggattctagaatgctaaggctctaatttgatggagttgtagttctttgagaattttttgcttctaaatatgttggttggtgacgtgacattcaaacttgtttgttgtgatggtttttgtgcaaaatttgtaattatgcagaaaatataaattatttatggtgtcatgtcttcattttattgatgcacccatactatttgtttgttcgatatgatattttgtgtgttttcaattgagatgcttccctgctagatattaaatttgcgtgttactgccaacttaacagttaagtacctttttgtagccgagcaaaaacagtgaatgagaatttaaagatgagtgccgccctcctctctcggtttgacttggttttcattttacttgacaagccagatgaattgctggataagagagtatcagatcacataattgcagtaagtgaatgttaaccatgtttcctgttctcatctgttaagtatatatgactgatatgggatatgctcacatgatgcaatatatctgtatttagcaagaaaggatatgtatttagggaaacatgcatagttaaataactaaacaattttactatttccgataagcagctccactccaatgatggaggccctttcacagccaacaagaggataagaacaggtattttcttggtttattcaaaactgatttatagtgccttcttttcggttgccaatcattgttggttttcataactaaaaacttatccatcattgttgatttgggccttctttcagtgcctcaatttaatgccagtacagagtttggtgtcggtagaacttcattagcttcaaggctgagattgcaccctgagaaagacaaggatttctgtccattacctggaccattacttcgcaagtatatatcttatgcaagaagccatgttaacccccgaatctcgtaagttcctctttcactcataaaatgtcataaatgcaaactgttggctatccctatcctttttgcctgtagtgcttcccctaaccttactatttttcctctttaagcatgccgtcgccagcagctgacagtctgcaaaagttctatttggatttgagaaaacaaagtgattctgctgatggtacgcccatcacagcccggcaactggaaagccttgtaaggttggcagaagctcgtgcgcgggtggatctaagagaagaagtgactttagaagatgctaaggtgaaataacttaaatacttgagtgctgaaaaggttgctaagtctctaatctctgttgctgggtaaacctgacttcttatattattaaatcaaacttaaaaaacaacaagttgtgccatttcacccacacttgtgcaaattatgttcacattgcagatcttttttgtttgtttgtttgtttcctaattcttcctactatagttctaaatttgaaaatctcacatttgcaccacctgattagtaacttcttccagccaaaggcagatagaaatccagtgataacacaattgaacaactcagcagcattaaagctgaatgatatttttaaattgttcattttttttacatgacaggaggtcatagacataatgacggaatccttatatgacaagtgtgttgatgagcacggtgttgtggactttgctcgaagtggtgggatgagcaatcaaaagcaatcaaagaaatttctccgcgccttaaacgagcagtgtgatttgcagaaaaaggattgcttttcaatgaatgtaagtgtcatggcaattatgcttcaaatgtcttttttgctgaagatttcttgtttcagttgtcgaattatacaacatcacaccagtcaaatcaattaaaatggaaaaatggacacaattcttattctgctctaattgaagaatattttcctttgctactttttgagcatttttgttcttttggtgtgtggtttgtccagtgaaagaagatatgcagctttcttgatttgtttacagtatttagtcacaaacaaagcattgtaattagtaggtgcctttttttttttaatctttgatcgttccatcatgttctatccctttcctattgccaggagatgtacaacttagctgatcgtatcagcttgcaagttgcaaatttagatgctattgtggaaagtttgaacaatgctggctatatcactaaaaagggatcatcaatgtatcaggtatcgtcttgttttcaataagctctagcattactcttgctgtcagaacaatactagctggcctcctggcatcatgctgattatcgttttgacttgtagaatccgtggtaaccctcacggaaaacgtgacatatgctctttcctctttttttttttttttctgttaacaggtagtgacttcgtcataccaggggagccaagctacatggtcaagacgatgagttttgttgcatcctagatgatcagtaagtttgttggcgaggactgtgctggttctgttattagtcgatattatactacgggtgcaatcctatgcctccttgttaacgctgggattattcccagttactctgaatcaacatgattgactgatagcttccctttgcttgctgaaccagctgatccaggaggttagtgtctgattctattccgagagccatagaacggggtgatgctgcttcttaaggctgcaaggtgattaaagatgtctggctgcccactcactgtaatgtgcaaaacagcaattttgtatagaacttcatatttgctaatcatccatattgttataacctgtcgcccagatttgtcagttttaggtgatgctaatattttcgttctgatagtatatggtagtataattgggtaagcaatgtttgagctgcggtggcttacccgtcgcggcggaccggtctatgcctcgatcgccggtggcgggggattgggctgcgcgtggagggagcggtacgtggtaatggcccatatgtaagtggcacaactgtaaactgcacaaactcaggggatcaatttccgtaggtgggtggagcacccgcgcggcgcggcgatatgggcggcgcggtgcccgcaacggcggctgcgtgtgacctgtcgtagctgtgcgccgcagcaaaagccgatggcgatgatctctagcagccgcggcgacgacggctcggctcggatgacaccggcccacgggctgcgcttgaggggggaagagagaaaaaggtccattatccatcgcagcaggccataatatgaggcctcatctagttgggccgacgacggcaaggggatgcaaggcctacgacgcgcgcggcgccggcggtcagcacagccatgggccgccgtccaatcaagccctaaacctggaaattctgagagatatttaactatttaccactcttatgataattaagagtttatgactggatttacatgtcatacacgtgactcagtgagtggcaaataattaaacttgacatcttaaaagtggcaaatagttaaatgtcccaaattctaaagctcacaggtaggcaccagaaaggaaaaagaacggttggaaaaatagagtttcataaataaattgccaaccacaaagacaagtatattacggtcatgtttacgttataaactaatataatttgtaattattaatataaattaaaagtagtaagtaactaatttaaatatttcataatgatcttatagcatcaatggctgacaacacatataagggtcgttatggttaatttctttttattccaatgggttacgcttatttctttaaaaaatattaatgaaaaaagtactatttccgttccatttctgaaaacatgaaatcaaaacgttaagtacaaaacggaaacgatagccggtacagtcaagaagtcccgtaccgttttaaccctactcatcggacactgactgagattaagtccgacgaccaccacgtgcacagcgcctaataaaaccatttgatcgaggaaagcgtgtgatgacttggaacggactcaacggagagacgatggatgcaagtcaatttggggaaacggagttatataacgaatgccgtgcttaattagttcggcttaatttgcacgagaaagcggctaagctcaagtgtttcggttagctagctgtatcgcatgccctacgagaaatttaattgcttctcggacttttcaaggggagcaacaagacacggtcatttttttttagttcagttggcatatcacgtgcttcattgcccatttttggttgatggtttcccttctcgacgaagcagattataggtgtaatggttcataatctctggctgaaaaccgccaattatcggtcctatcggtccgatattagagagtggtcccaaattattattttttgtaggggatatcccaaattatttttgatcaaatttgatatagtgtgcgttcttttctacattttcatttatgaaccttgtagcattttcaacaaaattttgacgatttcatttatttgaaacagaaaatatttatgaattttcaactttcaaccgagattcaagtttgaaattctgagcaattcgtctgaattctgggggacgaaaatcaactaaattattggtgacttttggactatcggaagtggtcaaaacttgagccgaaaacgatactgtagtgtttacctgttcaatattttaccataactgagcttgcctagcttgtatggtaaaacctgcaaaggaaagttcatttttttttcagcgcagacaattgacagattaccctggccttgctgtgttgcacttataatgcagctacaggtaaggttcagaaaatccatgaaataaaacttgaccagaaatttcaattccacaacatcaaaaagcagagttctaacacagtttacacacaaatgcttaactgaattgacaagtagaaaaccaaacatagtacatgggaggtagtacacaaggaaggaatgaccaggcctaatacttgctgatccatccaacaacttatacaatccattatctaagaaaacaacttatacaatcaaacataaacaccaaaagacaccaagccaagaactagaagacaacattaacaaccttaacaagcaagtaagctacaggaggttcttacttaaaaaccttaacaacctcctgaacctgaaaggctaagacgacttaaccacacgaaatcaacgagaagtatggatggattagtgcttactctaatatggcagctaatccaaccaagacaggggcgagaggaagagatcaacaagagattttaactgattataagagctcttcgtaattattttaactttgctcctgaaaaattctgctgcgagcataaaaggagcccatagtagcagcagaaattggaggagcggatggcttcagcttctagttcagttgtcggtgtcgtcggagacaggaacgccgccgccgccgttcctgtcgttgcggccgcggccggcgatgacgccggagaacgcggcgacgatgtccttgatgatctgctccttgatctgccccctgcgcggaggcgggagcagcgccgcccgcgccgccctgccgccgccgccgccgccggcgcggtctcccgccgcgggaggcatggccggagccggagcctgagccgggtagctctcggtggccatcgtcgccggcgatctggtcggtggtcggagatcgggaggggggggggagg

SEQ ID NO: 51373 - DNA, 1848 bp, Oryza sativa
gtggggcccaaaagtgcccagtgggccccacttctgggccgatcgcgggctgcgactttagggagaacagccacgtgtggatgacaagtggggaggtttggatcgtccgggcccactgtcagtgacacagatgttcaaacttggtcggttcgtgggtcccacctcgccgcaatttttccacgtagtagtctgttccacgcaatcacggggctttggctttggcttgctctgccttggattgcagctagtggtttgtgatgggaacctctccatttagccgcgctaatcatgaccaaaaacgcaattagaaaagagagaagacagtgcacgcctagaagcattatagtgcctactccttctatcttaaaaaatactactaacaattactaatatattgttataaatctaaatagattttctattacttaaaactaatactagtactaagtcatacttcctcctccgtttcatattataagtctttctagtattgtctacattcatatatataataatctagacatatatgtttagatttattaacatctatataaatatggacaatgttagaaagttctttaacctgaaatggaggaagtatgttgatgtattttggaacgatgaaaatagtttattcggtcagtgagccggtggtggttcagtgatcagtatcaacaaggttgctgcgctttcgcttgctttatactaccacaaaatcaccaatgcttaggcgccgcgatgtggataagcataataagccataaggacacgccaggtcaacagcaagtggtgcactgggagagaagatgctttcacattagaaggtactactacttgtgcataatccgatttgtctgaactttcatgcagcttgttctgcttgtgtgtgtttccttgttagcgaagaaacttgagaagtttcaaaagaaaaagagaagaaacttgtgagaggtaatcctggccgttggagcatcatcatcatgcatgtttgcgatggaatgttcgcgttacctcatcaggagcacgtcagcgcgagcgttcgcaatcgcggtttttttatttttatttttttggtgcgaactcgcaatcacaggtgtgcgttggcagctcgggttaagtggggtttgttcgaacggagggaaggcgtgaaaattgcggtttgggctcggcttcccgaaatcagattcttgcagtctttgaaataagttcaccggaggtccctcaacttaacagcgagaattcttgagatcccttaaccacataaccagaaatgtgtacccctaaactcacacaaaccgttcaaaggaggtcccatgacagtatatgtgggtggttttgctgacgtggcatcctagtcagcattttttttaaaaaagtatgtgggcccacatgtcagttacacatattttcttttcttttcttttcttctcctcctcttctcttttctcccttctctttctcttcttcttcttcttcttcttcttcttcttcttcttcttcttcttcttcttcttcttcttcagtaagtgaggctggtgggcgacgggtggagcggcgatgggcgggcggagcggcgacgacaggtccgtgcggcagccgagtagcggcaggcgagcgcggcctgcaggcgagcggacgagcatggcggcaggcagagcggatggcgtcccatgccccatggcgtggcggcggagatatcggccgatccggagtccaggagcacggagagtgtgtaggactcgtcgacggcggggccgagcgagacgttgggaccgtcggagacggagagcgcgaggatgcagacgtggatgcggacggggatgcgggagagggtgcagttggtggggg

SEQ ID NO: 51374 - DNA, 18248 bp, Oryza sativa
  unsure (1)..(18248): unsure at all n locations
ctctgcccgcatcccgggttcggttcggccggcggcggccattggcaattccgccggcttccgtcttgccaacaggccgcgctggcttgctgccgccctcgcctgccacccgcccatcgcggctctgcccgccgcctgcgctcgcctgccgccgcccgccgccgctcgcctgccgcgcggacccaccgccgcgctcgcctgccgcccgtccatcgccgcttcgcccaccggccgccagcctcacccactgaagaagagaaagagaagagataaaatagaagaggaggagaagaaacgaaaagaaaaaaaagatgtgcaactgatatgtgggcctcacgtactttttttaatttttcttgctgactaggatgccacgttagcgaaaccaccctcatatactgccatggaaccttctttgaacggtttatgtaagtttaggggtacacatttctggttttgtggttaagtgaccttaaaaaatctcgctgttaagttgagggacctccggtgaacttattccacagtctttctcttgtttttgccggctgtttttccgaatattcagttcctcctttaaataagaccaaagtaccctatctcacccactcaagcatcattttttttaagcaccattctactttccatacttctaaaaataaaattacatagaactgtctcccatttgaaacgggataccttaataaccatatatatgaacatcttgtccacaccattacatcacctatttgatgttattcttatccttcctctccccccctctctctctcttgtcctcatggctcaacagccgagagcgccatgcaaccatcggttcgtgtgatcaatgatgattagctccgtgttgccatggaaggccgactccactcaaggtggagggattgcggggctgatttttgaggcttctctagttcgcagtagttttggttgccaactgtgattcacggcaagcttcttctattgagcatctttcccatccttgagaaggtaccatgaggtacaaggtaccaatctaatttaaccgttgatttaacaggggtatgattgggggctaaaaaaaattaggtctctcttccacgtcgtcgtcgcccatcgagggtcgtcgggcatcgaggccggcgccgtcgtcgtcgcccattgagcccgccgccgccgtcgggcatcgaccgccgccgtcgtcgcccatcgaggctgctgccgccgtcggccatcgacccccgccgccatcgcgcatccagccgccaccgtctcgcatcgagccctccgtcgtcgtcgcccatcgaggttgccgttgccgtcacgcgtcacgcatccagccgctgtcatcgcccatcgaggttgccgccaccgtcacgcgtcacgcatccaaccgccaccgtcatgcatctagccctccgcggccgccactgctgtcgccgtcgcgcatcgtggccgccgccgccgccgcgcatcgaggctgccaccaccgccgctgccgctgccgccgccgtcgcgcatcgaggccgccgccgtcggccatcgagcccgccgcgcatcgagcccaccgagccgccatcacgcctttcgccggtctcgccgcaaatctggccgccgctgccgctgccaccgccgtcggccatcgagcccaccgagccgccgtcacgcctttcgccggtctcgccgcaaatccacaatcttcccgatttttcccctcgtgaaacagtaaaggacagaaatacccttccaccaatggtactgcttgaaagagaaggtgcagtaccatgaggtacggatgatttctgactgttggataatgctagatcaacggtcaggatttggtactgcacaacctcaaggacagtaaaaaaactcctaatagtatcatgatgctcaagtgcatcatattggtgataccatgatacttaggtattaggcctaacgtctagcgatatcacactaatacctacttagtaccatggcctggtctggtaccccaaatactcggtacttggaccctgataccaaggcttggtaccttggtacgagacactcggtaggtactggatctggtatctctatgtatcaagttcgataccctaggtacttggtaccaaatcgtggagagggggcatgtgccgttgcttctcccttcctctcctcgatgcctccctctttctttgctattgctatggctgagtgagggagctaagagggagcgcctctacttcattgtgttttgtacgtgggagctcgagtcggagaggaaaggaaacagttcatcacttctttctatatagttggtacccactacaagtattaacactataaagaagcatccaggttaagccacatcatcgataaccaatagccatccgatcgaatacatctttgtttgtttagctggcatgcacagccatgcaggccttaagtaagcaaactgccatgggtaattaagcacatcaatagatgacacacttaagtgctcctggtcatgcatatgtcccttgatcatattaagccattactatgtcccttgactatctactactcaaatgccaactttacactttattattttagaatgtttacttttgatatttcaattatgtttgtaagcacatatttacaaagttgtttatcatcattataaaatctcgtagcaacgcgcggggtataaaactagttaaatatattcggacggtatcccgtgttgtaggttgtagctgtactctgttataaaaatcaaactgagattagaaaaaaatcataatgatttgtgttaacagtatccttgctgctcccttgacctcgaaaaaaaaaattctcacagtggaaaaatcgatcatcgtgaacccaccatctaataatcgttgcagcaaagaataacctaattaaaattccaataggacaacgctttatatcaatgtctagacaaactatctaggtctcactactagttctccctccattccaaattccaaattgatctatatatatttcataggtacactaagataaaaaaaagctaataactattttatactatatttactctagcaacaaactcaatacatgcgccatccccactatttcctagccaataacaaatcaagatattgcatgtgggttataaatacttgtgatgcatgcatcaatgtccatttacttcaacgcacaaataacgaatagacctaatgaataaacacaaatatatagatcatttaaaaataacatatatatatatatatatatatatatatatatatatatatatatatataaatttggaatgaagggagtatttattatcggtaattttctatccaattcatctcaaaataaataaatctaaataaatgtagtaatgctcacactgtattcacgtgcactgatgcacagtgcggttccacgtaatggacacgcactcgctgatcatgcgccaaaaaaaagcaaaggtggcttatacacgatgactcgctgtcgaatatatgtttccgcctttgcactgtacgttcaatcgatatagatgcttctgtggcacacaagtttcatataaccaaggttgcgcagttgcgctagcttttctctccgctggaaattaagacgcatttgcagaattgaatactgggaatttctttctttctttctttttttttaaagaaaatctcttttcacaaatcacaagatgagcagagaaaggttgaaaggagagtagctctcattgagcacaataatacagaccatgcagcatggaagtttatattgcatatacacagcttctcttcttagggtcattttagttcacgaaaagaaaatttttagatgtcacatcagatgtttggccggatggcggaaggagttttcggacacgaatgaaaaaaaacactaattttataactcgtctggaaaccatgagacgaatattttgagcttaattaatccatcatagcacatgtgtgggttactgtagcacttatggctaattatagactaattaggctcaaaagattcgtctcacgatttcctccctaattgtgcaattagtttttttaaatctatatttaatgctctgtacatgtgtccaaagattcgatgtgatgattttgggaaaaaaatttagagaactaaaccaggccttacttgtatttatacatctctaatacatttatatacacatatcgaacttggcagacggatccatttcccttgtcttcattcaagccaagaaatgaacagctgctctgtatagtagcagagagtagagacagacatgatggagaatcaaaatagcatatgcatctatttgcacagtaccagagcattagagaagaacacaaactaaggaagtatatgtagtgcaactgcaagaacacacatctagttattattgtagcttgcttctctcctgatgaagctgttgcgatgatctgcagcctgggccgagttggagtcgtcatcagcagcagcgttgttggccatgaggttgctgatgctcctcacgatcctgcgcttgacctgccccctcttcagcggtggcctcttctccttcgccatgttggcgccgccgccgctcaagtagttgccgtagtagctgtactccatcaccctgcaaggctgcgacttaacacacactgatctctctctagcttcttcttcttgcctctgtcactgtgtgtgagtgatttgttctgttggggatggggagatgtgaggtatttataggcaaatgaatagcagcctcatctctgcctgcagggtctcgtgccacctcgtgtgaacgcacgcgaacgtaagtgacaaattaaagggaacttatgcggttaacctcatgttaagggcgatgtggacgtcagacgtgagaatcagtgactggtatcgttgaagcagggcatggtttagacgcacgagggtcagaatgccagattaattggctagtcagcacaaggaacccatgaaagccactcttaccaattttaaggcagtttctaaaacaaaaattttcacactttcacattgaatatttaaatacatgtatgaagtattaaatgtgaataaaaaaaaccaattacacagattgtgtgtaaattgcgagatgaatcttttaagcctaattgcgccatgatttgacaatgtggtgttacagtaaacatctgctaatgacggattaattaggcttaataaattcatatcgcattttcctggcggaatctgtaatttattttgttattagactacgtttaatacttcaaatgtgtgttcgtatatccggtgtgacaatcaaacccaaaaattttcccaactaaacaaggcctaagtggaagagtctcacttcgctaactaaacaaggcctaagtggaagagtctcacttcgctgttctctactgatagtagaaaacaatgtcaaccattaatcttatttgatcgaagggtcatattcatttctattaccaccacacttaatagtagtagaaacgtcatgggctattattgtccaagaaaaaatattaacggtctgatgaatggatacaaaactttttttttcacgatggatagataaaatctgaaataccagcattacttctaatcactaagttagtaaagcactgatatgaccttataaattatagcaattttaggtccttaaggaagaaggtaccatgaggtaccactttttccactgtaaatttggtacctcttgttacttaggtactatgaggtaccagattttacactatttttttaattacctcatggtacctcctcaagaaccgtagaattgctctataaattaacaactcagatcaattctgctaatagtatgatattactagtagagagtgtcgtagcgttgctcttagtggaaggtttcgttcatgagcttaactacggtgctctctactaatagtaaaaagtgatatgaacggttgatctcatttgatcgaaaagtttagatctgtatgtactaccacccccagttaacgatagtagaaatgtggaggaacattattgtaaaaattttgtgtgaagggatataatcgtcatttagcagagactaaacctttttttctcttactcttttttggctttttcaatgaaatatgagtgatgccagtggaatggatgacaactataggattaaattactattttacccttaataatgaacggttcatattattatatattaccagtagagagcatcggagcatcgcacttcattttatgttttcaagagtgttacataaggcaacaagaaatttaattgtttgttaaaatagcccacacgatgtattgtttcattttttttgttgttgtttcagagacaacacatgcagagacagatcacattagaaatagtatatacaaaatgaaactcatttcatctccttctttattaattacttgtcacatcaccaaaaatattggcatgcaaccccatttaatgagaatggaacttctattgagagtggcccctatcgtttatcgactataagtcaaaatttagtttgaaagttgattttagggattttaatcttaatctattatttaacacctacttttaaactacataaatggaagtgtttttccataaattattatttcaaggacctataaatcttttattggtatggcttatcagctcagctatatagctcaactaatcagagatgctaactagtgttccaaaggaaacctaaattttgcccttgatggtttgtcattttcgttctgattatgatctatgggcatcatgcacctttcaaagtttcacgcaaatcaatggactttccagcttgagtagattttcagtttgggtcttgctcgattaatccttaaaaaaaattagatggaactaagaaggattaattttacctcttaatttcttttatttttttcttcaattctcttataaaatggattaacctaacaagaaaaaggagaactagttaccctcgttttcttactgaactgtcagatgaatgtgcagttgtgcttgtgcacagtcacctgatcagctatggctgtagataacttcaagcatttcgtgtagctttgcactggacctcagagaaaaagaagacgtgctagctatctttgcactcctatcacaactttacactaccactccatgttttttttttacactttaaatttgtatcaactcgatgcattgacaaaaaagaaaccttaccgctcaagttgtacactgtgtacacataagccgaatatttacgatatccaaatggatcaggatctgatgccaaagtggcgaaaaagggtaagatatatatacctgcgctttcacatttttctgacgcatctgaaagatatttaaaaagatctgtacacagtacgcggagaaagtgcaggtatatatctgacactttcgcattttcggcacagcacagcatgatgctataatcacgtatccgaggtagtatgtttacatagatatttccaattcgacagaaatttggatgcaaattaatcaagactctgcaaattagttgagcggagaaaatatagaaaaataaatgaaacaaccaaaatgatcattttagtgtataacttttatattgctactcttaattagctgctaaaaagccaaggttaaaaaataaaaacaatgaaaagaactagattaatttaaaattaattttaaaattcaaatattgaatgtacgtagctgattaacgaaaactgaagaagacgagatttttttgtaactaatttatttcaagagttcgtaactacctacaaactttgtcaagtagggtaaaaccattttagtcagttagctagaccttattggaaaaagtacacctaaggtccctcaacttgtcggcgagttacaaaatcgtccctaaaccgatatataacatatctcaacttacaaaaccgtttgctttaggtccttcggtgattttgatcccggttttgtctgatatggcggctgagtcagagtgggcctcacatgtcagtatgccacgtcatcacctcctctctctctctctctcacttttctcctctgttggctggccgacgtgtcggaggaggtcgttgggcgaagacgggcgacggctggggaagaccggaggcgcacggccggccgacggacgctcgtcgccgtcatcgccgtggccgctggacgccggcgccgacgtggaagcggtccccgagctcactggcttggaccccagcggtggtgaggtgagcgaggatgcgcggggtggtgggggcggcctcggatgcagaggcgacggaggcggcgggcggcggtcgacgtcgaccatctggaggcggaggcgcgccggtgcctctcttggatctcggccaccacgctggagcagatgaggctgggagcggaggaggcccgcgggcaccgggcggtgtgtcgtcggcgcgtcgccgccctcaccaacgacgtggagagcgcgattccagagagagagagagagagagatgtgggcggtggccaacgacgcggcgctccaagtagatcgtgaggtcgaagcagccggggctgccctggatcgaggcgctacagatccatcgtcggcggaacgaacgagcaacagtagagggagcagtcaatcagtcatcacttccctcccttgagtattaggagtggttctcagtttctcgctcgattcacttgcacactctttcactccactgctccagtccagtgtgttcacatgctctgccccaacgcaattcaagcaagcagatgagatcgatgatgcgtctcatgatttgctgcctcctggtctctgcgggggtcgggggaatcacaggcgagggcaactcggaagtggtgctcctcctgcagcgcgtgaagccggtgctgcggagggaaggcgggaacgcgcagctggccacctggaccgcctccaccccgctctgcctgtggcgtggcctccgccaaatcccaggaggccgttgtacatcccctatcgtcgtccctgctgctgcatcccagtcgcctcggcttgaggatgtccttccccttcatcatgttacagagccggtggccggcagagtagaagagcggcggtggcgaagacgggctgaggccgggggagaccggaggccggcgccgccgccctccccttctcccacgtcgccggtgacctcctccggaccctgcgagaacagaaaagtgagtgagagagagagagagggaggggaggaagggaaaggaggggaggggaaagagatgattatgtggcaccctgatatgtggggcccacgtgggtcctatgttgactcaactgccacgttggataaagcggggtcaaaaaccattgaaggacctaaaacgaacggttttataagttgagggacgttgtatatctgattttgtggttgggggatattttggtaacccgatgataagttgagggaccttgggtgtacttttttcgaccttatttagatatatggtccacattggcatggagtggtagactagtgttttggtctatctgaataaggtatatgctggtgcaaattattgttattctttgatgtagtattgggagaatactggtacacgggcgtctgattagacaagaaagaatcaggacactgctactcctatatctgcgaataaaatttaaaaatatatctttttttcgtattttccgtttatatatacaggcgaaaaagaattgtatgaatatacctcttccgcggaacgggccgcgggaccgccactcgccgcgcgctcccgtggcttggccgcgcgggaccgccgcttgccgtgcgctcccgcgttgccgttgcgcgcgaccgtttcggtcggcagcggcatgcatgcatcattgcgtcattgctcatgcatgcatcattgcgtcattggtcagctcggctggatgcatgcacggctccgcagggcaggtacgcgggaccgctcggtcccgcagtgcagccgcgcgggaccggcgctcccggagcgtccgcggacaacttttttcacggtcgcgcgtccccgccgtgcgggaccgtgacgtcgcgcgcgggagcgacggttccgcacggccgttccgcgggagcgagtggctccgcctcggtcccgcaccttcatagaggtatattttcgcaattctttcccatacatatatataaacgcaaaacgttgaaaaaaaggtatatattcaatttttattcctacatctgcatatatggtaggctatactacttagctttttctccctccctcctcctcaccttaaatattttttttctaactacttatccgatctacgattcgatcacaccattgtatttgacgtaattaaatctttgtaacaagatatcacatggttatattctaatgaaaaatgtatattttaaaccgttagaactcaataatttatctgcgatagcgacatgtttcaacgtgcgttccattgtgtttcataaatttcacataactacctccctctattctctctcctgcttctctctccattttatccatccatgcatgcatttaacgagctttaaaatgattttttttctaaactacttatccaacttataatttgagcgtatcattgtatttgttgtaattaaaatgaagatttgcatgattatattttgatgaaagaaaaacacatgtttcagaacattaaaactcattgttcgtttcatatgtgatagcaacatgtttcaatacatgttatcaccgtgtttcacaaaatttttaagtgtttcaattgctgatttgtctgtttcaccatatacaattttaatgttttactcgttggtcaattaaaatatttgaccctgatttttttttagaaatcggatgccaaattgtagattcttccgtagtattgcattgtgctttgtgtgttggaattttagttatagagatcattctattcaccgaagactctactcttatttaggtttagagattctagatttatagaaatagggtcagaatctaaaaaagcaggatatcgggctccgagcttgattagcttcatgatctagagaaaagaaaaatctaaattatttaagaaagttcactacgccagaaccctacatctgtgacggcataccagtgacgggcctatgaattggtaacagatgaccgtcacctttgacgggtcgctaggtttgctgtcatcgatggggcatccggccgtggcccgtcacaggtatcccctcacctgtgacgggccagaaggaaaagccgtcacaggtgaggaagtgacgggttttcctcccaactcgtcactggtatcccctcacctgtgacgggccgtggcattatgagccgtcacaggtggtggtccgccacctgtgacggatttgttttacggcccgtcacaggtaggtcaatacctttgacgggcaactggtcatacctttgacgggtttttttaatctaacctgtttgaggtgtgttgggtctataaatactccccaaaccgccaactactttctatcccgaccagttcactgttcacaaatcggttgggagggcaaggggggcgattttttgctaaaattcaaggtaaaaaacacattattctccattccttctcaatatatcgatcatcatatatttttcttcgtatgttgttgatttctgatggatcgtagatggatgtactatgcgcatcgttcgtctaccgagtatagagagggggtcactgaatttgtcacatttgcggataatgacagaaaaagtaggatgagcatgcacatgttgtgtccatgtagggactataagaatgaacagatgatcgaagatagcgatgaagtgcatgcttatttaataatgaatggattcatgaagaaatatacctactggaccaagcatggagagcaagaggcgcctgatgtcgcagctgatgaagtgttggatcaggatgtagagaacaccgccgcagctcgagaaggcatgttcgtaccttctcctttaggtggagagaccatagatttggacactcaatgtctatctacaatgttgcatgacattaaagacgcagaggacaacgacagagattttgagaagattgtcagatgcccttgtatgatggatgtttagtaagttggtggaagattgtcagatgcccttgtatgatggatgcaagtcgaagcacagcaagttgtcatgcgtgttggaactcatgaagcttaaggctagtaatggctggtcgggcaagagttttacagaacttcttaagctgttaaaggacctgttgccagaggggaacaatttaccggatacgacatatgaagcaaagcaagtattatgtccgttgggtctggaggtcagaagaattcatgcatgtccgaacaactgcattttgtattacaaggaatacgctgacttggatatctgccctgtctgtggggcatcaagatacaaacgagcaaagagtgaaggtgaagaaagtaagtcaaagaggggaggcccagcaaaggtggtgtggtatctcccaattgcggagcgcatgaagagaatgtttgcgaataaggaacaagctaagctagtgcgctggcatgccgaagaatggaaagtcgatggtatgctgaggcacccagcagattcagtacagtggaggacaatcgataggatttaccagaaattctcaaatgacccaagaaacatgcgtttcgcaatgtgtaaggacgtcattaatccatttggtgatttgagcagtcgtcatagtacatggccagttctgcttgttaactataaccttcctccctggttgtgcttcaaaagaaagtatattatgcttgccatgctcattcaaggattgagacaacctggcaaggatatcgatgtgttccttgaaccgataatcgatgacttcgaaaggctatggaatgagggcacacggnnacatgggacgcataagcacaagagtatttcaacctccatgcgatgctgttttgtaccatcaacgattatccggcccttggcaacttttctggccaaactgtgaaagggaaatggacgtgttcggagtgtatggaggaaacaagaagcaaatggttgaagcatacacacaagacggtctagatgggtcacaggagatttctcccaaggtatcacccgtataggaatatgaaaaagaatttcaatggacacagatacagccggacccccggcagagctaacagggacagaggtgcacaacttagtgatgggaataaccaacgagtttggaaaaaagaggaaagttggaaagacaaaagagaagagcacgtcgaaggaaaaaacaaaagacaaaagagatgagcatgtggaaaaacaaaagacaaaagagatgagcatgtggaaaaagaagtcaatattttggagactaccatactggaaggatcttaaagttcgccactgcatagatttgatgcatgtcgagtagaatgtatgcgagagtttaatgggattactgcttaacccaggtactacaaaggatggtctcaacacctgacgagatcttgaagaaatgggtgttcgctcggaactacatcccataaccacaaaatccggcagggtttatcttcctccagcctgctacactctcttgaaagaagagaagattgatttgctaacatgtttgagtggtataaaggttccatctggttacttatcaagaatcagtaggctcgtttcactgcaagatcttaagttggtaggaatgaagtcgcatgattgccacgttcttataacacaactgttgcccgttgcactaaggaatattttgcctcctaaggtgcgacacacgatccagcggttgtgttccttcttccatgcaattggccagaagatcattgatcccgagggactagatgaactacaggcagaacttgtgagaaccctatgtcatcttgagatgtactttcctccaactttctttgacataatggagcatcttcccgtgcaccttgtgaggcaaacaaagtgctgtggtccagcattcatgacgcagatgtatccttgcgaaaggtacctagggatccttaagggttatgtatggaaccgttcacaccctgaggggagtatcatcgagagttacaccaccgaagaggtcatcgatttttgtgtggactacatgtcagaaacatcttcaattggattaccacgatctcatcacgaagggaggcttgatagtgttggtactattggaaaaaagactgttaggttggatcggaaggtgtacgataaagctcatttcacggtactgtagcatatgactgaggtggtgccgtacgttgacgaacaccttgcagttctccgacaggagaacccaggccgataagagagttgggtcagaaataagcacatgtcttctttcaacgagtggctgaaaaaccgaattgccaggttgcagaacttgtctagtgaaacacttcagtggttgtcacagggtcctgaatggagtgccaccacctggcaaggatatgacataaatggatacacctttcacacggtaaagcaagacagcaaatgcacagtgcagaacagtgggttacgcatcaaggctgctagtgacggtggtcatcgtgatcaatactatggtagagttgagcaaatattggagctagattacttgaagttcaaagtcccattgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccatgtaacaagaaactacatgttgttcgtgaagggaaaaggagaattgttggattggacaatattgcagacgaggatgattacaaccagcacatccatggcataggtcaagaaatacctctagaagaggaggaagaagaagatgacgttcaatatgcacgcgtcgaccatgaggaaggattatttttgtaatttatgtatgtagtttatgtctacatgtctgttatctgtatgactctatatgttcgcaatgatcaatagtatattgctgatgaaacagtcaaataaaataattaattgaagcacccactagaagtgaaataaaataattaaattagtataaccattggaaataaaataataaaattagtaaaataatgaagtgcaattactactgttagtgaaataaaataattaagtataaaaaaaatatagtgtatgtggaaatatgttaaggaaaataaaaaaactaagtgaaataaaataaaataaaattgctgtaggcaaactcacctatgacaggtggcccagagtgttgggcctatcacaagtggcctcacctgtgacggctcaacagttggcgcccgtcacaggtgaggccacctgtgacggccccatagttggcgcccgtcacaggtgagtttgactagggttgtcctagagttggacatcttctagatcgatccagatccagcacccactctcactcactcactctctcaaccgccgcctcgcctctctcgacctctccgccaccctctatgccctcctctccaccgccgcctcgacctctccaccgccgccctcgccgccgtcaaatccgccgccctctccaccctctccgtcgccctctacgccctcctctccaccgccgccctcgccgccgccctctccgctgccctctacgccctcttctccaccgccgcctcgacctctccacctccgccctctacgccctcgtgtgtacgccgctcgccctctccaccgaccgcgaccccgaccttcccgacgccggcctgcaccgccgaccatcaaggccgtcatcctcgccgcgtccccgacctcccaagacgacgtcgggatccacgacgccgacaactgcaccgtcgaccaccgcctccccgacctccccgacaccgggatccacgacaccggcctgcaccgccgaccatcaaggctgtcgtcctcgccgtgtccccgacctcccaagacgacgtcgggagccacgacgccagcaactgcactgccgaccaccgcctccccgacctccccgacgccgggatccatgacccggacgtcggccgccaagacaccgcctccccgacctcttctcctcgaccgccgaccaggtgcgttgcccccctcctcctgatgagatgatgaattgatgaattgctgtttggatggatgacttgcttgaattgaatggatgaattgctgtttagatgaagttagtagtactgtctcctttttttttgatgaaatatatgcatatttgagatgtgaaatatatgaggtgatgaatttggactgtttgtggatgaaatatatgcagtattagaggaattagtctttttgtattagatgatttcaggattaattttgctgcattggttgaattttgcatgattttaactagataaatggccagtgatgttttatgttaatacacccctgctactgttgttattgtgggctacttgttcatttttttaatctacaattgctactgttgctgctgtgttccttgttaaatggccagtgatgaattgctcaacaagaacagattatctacacttgttcattttttttatctatacttgttcttttttctggattgatatgaggagactatctagacatgttgttttagttaatttgcccctgttgttgttgcccctgtggactatctttgcccctgctgctgctgcccaatgtgttccttgttaaatggccagtgatgaattgctcaataagaatagattaactacacttgtttattttttttatctatacttcttttttctagattgataagaggagactatctagacatgttgttttagttaatttgcccctgttgttgctgcccctgtggactatctttgccctgctactggtcttactgtggctacttgttcaccctgctgttttatgtgaatttccccctgctgttgctgcccctgtggcatatatactcctgctgctgctgttttatgtcaataacattctatctgtacccttgctgctgctgttttttaaatttgcatgattgattcagtggttatatacctctacacttgttttttatggataagaacagagtatctacacttgttctttttttatgcataagaacagattttctgcacttgttcttttttctggattgataagaggagactatatacacttgttcttttttatgcataataatagatattgatgttatgatttcctctttttttcccttcatgcaaatgatggtaattgatgcataatttctaagcaaaactgaggccatatctttcatagtataccccgtattacattggatctaatgctatttagtataatggtaggaaatttataagctttttcacgaaaattagaccatgacaacgcccggcgcaaacccgccctccccaacacctgcgaggatccaggaagaagcaaacccagccacggagacagttgctgaaggtcatccctcgacaacagcggtcgaacaacccgaaattcatggtaatttataggataatttttcaccacatgaccacataaattttagctagcactccttagcatatgttgccttctgtttgtactaaagaattgccgcatgaacaacatacatcgatgtcgggtgggacaagtgcaagtaggtcgggtagaaatcctcggtcacaaaatatatggccgaccacaatgcaagttataagagaggttgacgctagtggtaggcccacggcgcccaggactgtcattggaagatggtctaactgctacgggctggcggcacgtgagaactttgggatcctccataaagatatcggcaaggtcacagaagccaagaaagagcgagcttggacggcattggagaaatggttcacatttccggctgaagcaaaggataggctcaagtggaaggcattctagaagatgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51375 - DNA, 8330 bp, Oryza sativa
ttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtattaccaaccgggactaaagttacgactttagtcccggttggtcccgggggggcctgacatgacctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgatatcacttcgtccacacccaacattgctctgtcaccggtgaagaccatcgttctctgtcaccgagaagtctatgacaccttccagattggaagaaacatgcgaagttaacttggtacgcaaaattgtcactcggccagtcagcaacttgttacaaacgctactgtggggtcacctagttcggagtcatcatcaagcgctactgtggggtatatggttcccggttacctcatgttttgcctttgtgccgaatagcatgggatgggccaagtgccctaggcccacgcagcttacttgtaattaaagaaaaagattaaggattaggcaattattcctatcccatgtaaatagatggtaggtattcggattatacgggataccgtaccatatccacccggctgccctagcttctatataaacaggttagacacagccattctccacatatgtgctcacgtgctattccaacgccgtactacgcatacctacacagattcaatatacatacaactggactagggtattacctcacatcgagagcctaaaccagtataaacatatgtgccaccatctctccttgatctagtgcaccctataaattatattgcagatcataagaatcgacagtcaatggggacgaacaacctcggttggcccgagaagcagagcaacacacagtagaagaacgcaaaagaaggccgaagatgaacaagcaaggatcaaggaaggacgcaaacgcaaggaagtggaagaccacaggaaacacaatctgtccatcacagcgtatgctgcccacaaagcgaacctccagactccattgcagaggtcaacaccaatgtcttcatcacgccaaaacagaatgctattgcagcggctacagagctatttcacaagagggtatccaggagcttaccatcatggcttaccgtctacaccctgaccatccacgcagcaggaggagattcaaaagaaatggcaaactagttgcccgttacactcaccgattccgctaggagttagctcgccggcttaccaaggggcgcaatcgactcttggaggattgccagtaggatcgtagaaggagggaaggtgggtcaatgtcgcgaccgggaaaattgccttttcccgaacgctagtgtattgatccccgtcccaggaaaagccggggtacaccacacaaacatgatataaaagacacatctttattatatcgacaatacttacattattacaaaggcgcttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacggtactcagcaagccacaccggcagatgcatgattaatgcaagggaagtacaagggaataataatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttacgccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggctttaggggttttgaaagaggaagagaggtgtatgtccaattccaccataatccaacaattccaaagtgtccaaatgacatgagaattcccaaagtctaaagttataaaaccacctaatgttgcctaattaatcagcgaagcatctacctaaattcatactagtggaaccatgaatataatgtccactagttggggttttgtttattctagggtgaacaaggtaataataacaatagcaataataatgtcataacaaaggtaaataggcatggctaaaaaaaacagtgataacgcgggaatttaaacaaagcgataatgcaataatttaaatcaaaataattttataaactgggattcaatatgctcaagggtgatgtgacttgccttgctcactttcccaaacgccggcttcaacttccacgaagagcggatcttccgaagctgcagcgtctacacgaccgacggaaaagaaaaggcttacacactaataaactccacataacagcaggaacaaagcacaaaaatgggttctttacttcttaaggaaaaattagagacttgaacggtccaattccgagttcaaatggccaagttatggccatttgaagtttatatgctctttaaatggatatttacgaatttcttcatttaaattttaattaaaaatcccatttattgcgtcagccgagggagagggcgcgcggaccgggtccacgggagtggggcccacgcgtcagcctctcggtccacggtggaccgggcgcacgcggctggcggcggtcggcgccgtgggtcccacgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgacgagaacggcggccggagaggaggaaagcggcggcgcggttcgggatgacgatgacgacggtgctccggcggtcggcgggcgaagcggagcggcggacggggtcggcaaccactcggcgaagccgatggaggtggcgccgagtcgggaggacgtccggagcggcggcggcggcgaaccggaggtcggcggcgacggcggagagagaggtggacgtcgcgagcacgaatccgacggcgagagcaagcggcgaacggcggaaacggaggagggaggcacggggagcaaatatatagcgccgagagggggagagcgcggccggagagagaggaaaccgcgcgcggagatctcgggcgccattgaagacgccggcgaacttcgcgggatgaatccggacgaatccgagggagagagaaagggaaaagagggggaatcgggagagggaaacgcggggagtaattcccctctctttaaggcgcgcggggaaggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcacgcggggagccgatgggccgcgggggaagagagagagggagggactgggccgagccggcccaagaggggaagggggggggaaacagacttcttttagggtttttctttttataaaaccttttcactttgtttatttcttctcaattattatttgtgctctgaaaattccactaaaatttgagggctccttttagaccaaggagaatttaacaaaaattctccgggccacatttgaatttttcttgtacgtattttagggtttgccaatttcttttcgcattttaattaattctattattccttttagagaatgatttttattttgggatgaatttatcaggacgtgacagtcaatcctgaatcgttggatcttagagagaccatcctgaccgatcaatgaggaatgaggaatgtaacattgtgttggtgaatgaattatagggtagataagggaggaaggaaagaagcaggagagaagaagaaagaatagaaaaggaagtgggacccatgggacccacattccccttctcctttgacctctttcacctgacaaccggacatcacttgggatattcactggaatattcctctctgttatatttagctggacaccaacgggttatatgaaaggtgccgcttttgagtaagaaccggcatctatttcttttgtccacaaaggtgccgggcgggtcccacgctaactaaaagatgtcggttttaatttaaaaccagcatctatctctgacagaggtaaaaggtgccgatttttttaaaaaaatcggcacctattaggatataaggatgccggttcttggtattttgacgggctcacgggcgcgtaggttcgaaaggcactatagacgccggttttatcacttccggcacctatagtgctggcatctatttgatgttttgtagtagtgtacgtaattaaattttaatattcatcacgctgacctaccatgcaatttcatctgttagttacgttacaacttcagctaagattttgtaacaaaaaatcatctcgcgtataaaataggtccagcgatataacgtccattgcctacatattttcactcacttcccgttctaatatcatagaattgtatgccatgatatcttgcaacgtcgaatgcaatcatgattgaaaataaaacatgaaaaagtctcaaagagagagagcatgttcaacaaaaggttaagtaggacggtggtgcgaaggaagagggactgggcggttgttcaataatagagggagacgatgacatgctaaaaccatagctaattatggtaagagaggaggagagaatgggagaaacaaaatcagaatcgaaccctaacacatgcatactttgaattggaccttctcacttcggcatggcaaacaccccatgcatatatatatatatatatatatatatatatatatatatatagtattataaaaattgaagatatttttgccggtattttgatacaagaagcaattcaagaacatgaagatgaagaagttctatcagaaggcgcttgatgaggcatttgtagctgtccaagaatcaagcgatattgagtttgaaagtgatgaggatgatggcaaggggaacaaaggcaagaatgatgtttgtctcatggctagaagcgtggatgaagattctaattgtgataatgaggtaactcatattcctagtgttgaatatcttcaagaagttattgctagacttggttataagatttctagatttgagaaaaagattaaccaatatgaagctactattgaatctcttaatgcttaaaattctagaataaaatctcttgtttctgataatgatgagtgtaaatcttgtgaggttttatttgaggaaattgaagctgttagatatgttaataggtctcatgttaaaaagattaagaaatctgaatcttgtcttgctatgagttttgtcatgaacactagattggttgatgaattgtttttgactaagagagctttgaataaatgtcaatttgctttgtttgctagttcgatgtttaatgtgattagctctaaaaggattaaacaatctagtgaaaaaccttgtttgacatgtgttgctaatgagatgaaactaaaagatgcactaggtcgtgttaagcacatggaagaaattgtcaaacaagatgaggtgttttcttgctcaaattgtagaaaacaaaaaggtcttttggatgcttgcaaaaattgtgctaatcttactcaagaggtttcttacttgaaaagttctttgcaaagattttctgatggtaaaaagaaactcaacatgattcttgatcaatctagggttagcacacacaatcgtgctttaggttttaatccttatgcttatcatactagacatcctcctgttgttttaggtgctggtgctagaggtggtgaaattttgcttaaacctgagcctaagaacactgtgtttaaatctgctggcatcatgactagtttaagtgcattatcttcaaaaaccaatgttatgcatgcaaaaccttctattagtgcttgtgttgctaagccatatgtttctataattgcttctaatcatcatgataaatatacttgttcgttttgtggaaaagatggtcatcttgttggattctgttttagacttgctagaaaacagaaaaaggaacgggaaattgcttttgcgaaaaagagatggcaaaaactgcgttttgtcccgagacaggcagtcagaccggtgctttacccccagtcagaccggcggtaagccttcggtcagaccacaggtacctcagcggtcagaccggcctcgggtagatttttctaacgggaaatgggttgaattttctactggttatgctcctgttggttctggtcatgtgtctcagtatttttattatctaaccccagtactgaggcttcaacttctgcttgtgtgtaggcacttttggcgaggaaggagaacgtgtggattgtggattcctgttgttcgcgacacatgaccggtgataaaaattggttctcctccctcaagaaggcatcaaggaaggattcaatcatctttggcgatgcttctactagtatgatcactactactggatctgtcaaagtaagtgacaagtttacattgaatgatgtcgctttggttgagaatttgaagtacaatttgct

SEQ ID NO: 51376 - DNA, 9779 bp, Oryza sativa
aagcatgccctgtttgcaaagcactacgatacaagattagacgggacgatccaggagaagttgacgggcagctaacaaagaagagaattcctgctaaggtgatgtggtatttccctataataccacggctaaggcgtttttcaggaacaaggggaatgctagaatgttgcgatggcacgctgaagagcgtcaacaggacgggatgctgagacaccccgacgatggttcgcagtggcgaaacatcgacagagaatttaaagaatctggaaaggacgcacgaaacataccgtttggtttgagtacacatggcatgaatccttttggagagatgatcagcggccatagcacttggcccgttacgatgtgtatctacaacctccccccctggctatgcatgaagaggaagtacataatgatgccgattattattcaaggccccaagcaacctggtaatgacatcgacgtgtacctaagaccactggtcgaagatcttaaacagttgtggaagaagaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggaagtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagctagctacactcttagcaaggcagagaaggaaaatatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaggtcatcgatccggatagattagatgcccttcagaatgaagtggtgcaatgtctcgtcagttttgagttgatatttccaccttcatttttcaatataatgacacatctgctttgtcaccttgtgaaagagatccgtattctcaggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattgtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgggagcccaagacatgaagagcacgaaccaaaacagcgctgttcgtgtcgatgccatgggacacgatggaataactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcatgcagcgatcacaagaagggaacaatagtgaggagaaagtacgtgcagtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatctatgctaagtatatatatatatatatatatatatatatatatatatatatattggaatttttattaattataagtcatatatttgcttattacgatttatccacttaatttattacagacaaaaataatttttcgaagtaattgtcattaatctttgtactttaaataatgttaatgcaataacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtaaagatccgggggtatatatattcccggtgcgccctcgtcttcttcaccaacacttagacgttttcggccgatcgatctctctcagcctctctccttcgccgccactgcctagggcaaatccccgcgccgacgccgccgtatctcgccgtcgtctcgagctcgtcgtcctcgccgccgcctccgcctcctccgcttccgccgcatctctggggtgagagccgccgccgccagatctcccttcatctcgatctctccgatctcgatctctctccgtcgcgccgcccgccacgagacgccgcgccacgacgacgacgcgccacgccgacgccgcgccgagccgccgccggcacgcgacgccgccgtcttcgccggcgcgcgcgcaatgccgccgccggcacgccacgccgccgccttcgccaccgcgcaacgccgccgtcgcatgccaacgccacgccgccgccgccgtcaccacgccgccgccgccttcgccgccgcgcgtgcaatgccaccgccgccacgccacgccgccgccgccacggccccgcaacgccacgccgccgccgccgtcgccacgccgccgccgccgccgccacgcgccgcgccaaccgccgccccgatgccgccacaccgccgttaacgaacgagaacgagaacgatcgaacgaacgagagcgagaacgaacacgtcaacgtacgttgccgcgagaacgtgaacgagaacgagaacgatcgaacgaacgagagcgagaacgaacacgtcaacgtacgttgccgcgagaacgtgaacgagaacgagaacgatcgaacgaacgagagcgagaacgagaacgatcgaacgaagacaagcgagaacgagggaacgaacgtgaatgagaacaagcgaacgaacgtgaacgagaacgagcgaacgaacgtgaacgagctagggaacgtgaacgagcgaacgaacgaggacgaacgttaacgtgaaatgcaatatatatatatatatatatatatatatatatatatatatatatatatatatatatatatatatatatatatgttacttcgcatttatcctaatacatctttttgtatcttgcagaaaagacgtgttgtcggagtcgtccgtcaagcctgagtgtaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgtgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttaaaatatacatgactattttagtcttagcatgtaatattatttgagttttaatataagattattttatttgtaattagacttagtatataattatttactagctagggttgtataatatacgtcacctagacttaggttatatcacgatttgtaattagacttagcacgtaaggttgtgtagggttctaatgtatgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaacaagcttgagggtcggcacatcataacggaagtggaagaagatggacgtcctagtgccccagccgaagccgccaagaactatgtacgtcacagcggttgggttgtgcgggataacgtgcctgtcagtagggtgtactggcgaagaacaagggcacgcggagatcatgagagctttgtcccagattcggagaaagagatgctgtggaccacaatgctcgagacattcacccttcctacgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcttataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggtgtcgggcatggccatcccaatggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcctccgcaagctcctcttccggcaccttcaaagtcaagggcccccccagctccaccgtctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtatcatgaacttcttcaggggtatgtctgcacctgtcaaggaggccatcaagctatcggactatgagcgaacgctgaagaaagcatcttctggaaagtccaaaccagtccctcagcttggagagcaaccaaaccaggagatcgagccgttggtgaccgggaaagacatgacgatagaagaatttattattgacaccgatctaactacggatcaattgctaggagttgaaccaatagaaaaggctgaattgaaatacatgtacgaactcgataaaccgcttgtcaagcccgagctggtgcagtccctacccacacaaatgtacaagttccatcagctgtacgtggagatgagcgccaccggtagagagatgatcggagcgaggatcagggacctcgacttcttgcaaggagatgatattctctggatcaatttcaagggaatctacgaagtataccagctggacgccctcgacgtctctattatgagtttctggactttgtaagtatatcgttcaattataattcttaattactacgtctcctttaattaattaggtccttgtatataagtagactatataaaataaaatactcccttttatcgttgtagaatggagattcaaagggcccgacggcggagggttttcgatactggattcatcgaccctcggagagtaaacgttgcaatgctcgaccaatatccgcaggaaatagaggacaatctcgtccatctcctgaaggcgcagcattacaagacgtttatactgttaccgtacaacacagagttagtttaattttactgtcttcctacataccaaattttattcccgtacgaacttgctaagtgtttcatatgtaatgcatcccacgcacattgcagattccactgggtgcttttactcttcgacctgtcggcctgcaccgtcaatgtatatgactcaatggataaaaaagagtctacgtttgacaaggttttcgaacttatagacaggtactggcataagtttctctgttaattaagaaattcttgttatgttaattatttctactacgaatcatatctttaaactccatgtagggcttggtatcggttccgtcatttggtccgcggcaactagagagaaagacttaggcggaggttcaaatttcctgtgagtacacatgctctacatttatatttctccgattcaaattaatacatacaactgtatattaattagatctcacgccgttaatttgtcatttatttgtagtgcgcaaagcaaaagcagggaactaacttgtgcggctactacgtgtgtgagtattgccactgccttgcagaccaaatcatcaccacaagagagctcgatgtacgtacaaataaattcaaaatttcattacgtaacgatttcttgtttaattactaatcaatttcatacattcatataatttattcgcatgagggataacctgaccacacacaagaaatttatcgcagcggttcaagaacaactcatgggattcatcaacgaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatatatgtatgcatatatatgtattcaaacatatatatgcatggtttatatatatatatatatatatatatatatatatatatatataaaccatgcagcaacagggccatgcaaaaaaaaaaaaaaaggtcagctcgatctttagtcccggatgggtactcccggactaaaaacagcgactattagggggggactgactctccctgctaggggaccgtgactaagggggggaacgaacagatactaccactggtggaggaaccaatgaatggtttaaacctgtggagactcttgtggacgaactatggggagatcagaaccggggatacgcatgggtgacgaggaatggggattacttttacccagtggcgcaggggcgtcgacgatagacttggagccatagccactgccgcggcggcgtaacgggaagacaacga

SEQ ID NO: 51377 - DNA, 3418 bp, Oryza sativa
ccgggactaaagatcgatctttactcccggttatttcacccgggactaaagatagcgatctttagtcccggattggtactcccggtttggaaaccgggactaaaggggggttacgaactgggactacgaagggtttctccaccagtgtatcatatgatcatatcattgctctaatggaggaactaattaacggatgagaacgggggagaagcatgtgttcccggcgatggggattccgtttccggagttgcgcaaggcggaggaggattgagtttgagtttgagccagtgtggcggtggcatcaccgcgatccgaggagccatggcgacttccacggcaagggaaggggaggagaacgaagaaagatgatggactgccacaaatggtccagagaaaggggattatttgggaccaaacggcttggaatttgaggaatgtttttatttttaagtttagaatttgaggggaactttggaatttttacgtactatctaaaaataatctttaagcattgttcctttaatcctctttaattcccttaaattcctttctgatgtggattaagatcaatgtcaacgatctgaaaggctgaaagggttccatctcgacagaacacaatcaacggcgactaaaaagctattcgtacaaaaaaaatttccatgaaaaatccagtacgaacatagtcttaattttcttttatttcttcttagttggtagtgatcaaacgttctcatcttttcggttatgtttatcagccaaaatttaaattttcaaccttagagttgattttggggttttttcatccaaatttattttttaacatttgctttttttcgctaagaatatgaatataaaagttttatccaattattttcgtttgtaaatatgccgtttttattccgtctctttgtatcggtttgacttccggcaccagtagttacgaatcggtaccaatgcctgtttatatagtagtaattggatctatttcttatacgcaagttcatttcgacgcgacattcttagcaaaagacatctaatgatgatggacttgttaaaacaacctattattacaacaatcagatgattgatctggctttataacaataatgctgggacgccaacatataggtgaaaaaaactgtgtaatataattgtttgagaggatatattatgtagttttttataatgttgaaaaaaagaataataatacataatgtgggatagtaaggtgatggcggcgccaacaaagccatgggaccagcaacaggcggtgggctagtgttgatgggccgggggctaggatcttgaccatttaaaaggtgggtggggccaccgcgttgtcacttgacttggagaggaggagaggcgggcagggtgaaggactaggcaagtccgcgccgatgccatttgtgctttctgttgccaatgtggctaaggggtgacgtactgcatgggttagattttggtgaagaaaatgagtgtcgtgtacgggggtagaagatataaaaaggccattgtgcttgcatgaatcatagcgtgatctaagccatccaaaattgacggaaataaattagggtttttttatttatttttccaaacaacgagcacggacataataggagtgggtgttcggttttccggtttttttttgctcggtttattcagttttggagaagatcggttttgaagatatggcaaccgagtttgtctaaaataaggtaaaaccaagccgactaaaccgaacaaattcggctcgttttttcggttctcggtgaacccgaacagactgtgacccttgtttgaaatgtacgctagcaagtagcgcatgctgaagcaaaagctaagaattaaactgaacagccaagagcataaaaaggtcatatataattggataatagatgccacgattccaccagatatttggagtactagataatactatattgaagtaatgatgtttctaaaaccacacaataatcatctgtctgacaagcaacaacaaacgtccaacatgaatatcaatagttcatactgcaatacatgtgcagcagaccagcaacgttacagcaaaacttttttttttgaacgccgaagttacagcaaaactgggttacaagaaaccccagcttaagtattggccaaaagtagacttgattagttgactgcgcaatcagctgcccaccaaattcagcataccacagctcacatccaaagctgaaaaccaaagaaattaatcaagattagaaaaactatgttccacctcctattgctagtaaaatgatatctcctgaatcctgatacgtacaagatttttagggattaggagaactaggcttggacgcaggagccatgggggggcttggaagtacaacaatctttttttgcaaccagttctgaaacatgatccaaacaaaagcatgtaatctttattttgttaccttgttcaattagggccaacttttcggggtcctcttctatgctagtaggcggggtgcttcgcaaccaatcttatgtactcactccatactcataaaggaagtcgtttaggacaatgtttaagtcaaaccttaggaatataaatcatgaataactcccaaattattgagtttgaaaatataaaaattatatgtatagatttgtcttgaaaaatactttcataacagtatacatatatcacttttcaataaatatttttatagaaacaagaagtcaaagttgtgttttggagatcgtgtcgctgtcctaaacgactttctttacgagtatgaaaggagtacaaattaggcgttcagccatagatggtgtgatagtatagttggccaaaaggccagcagctcgacagctcagtacacggcacaaagatttggcccagcccaggtatggtattttttgacagttgtcggccccgtgccagtctgacccgactattgggctacgcataagcctcttccttggcacgacaacgtcgtgccgtccccggcacaacacggctcaacggtacctcgctcccgcaggccggcacggctcaatggtagcttgcgccatagcccattggcgcctggcccaaagagatgagggatacaagatagacttattccagccatataatgcatgatataaagatgtgagggggtaaaatatacttattctagccatataaggcacggccttaaaaaaatgagggaggcaaaataaacttattccaaggatcaatacggtatgctagtcgtgccttcgagccagcatggcatgatccgagtcttattgggccatgcctgggatataggtgtaggcgcccgccgtggatgggcacggcgcgacatggttaatctcaggccgagccggtccgactgatcttggaccgtgccttagtcgtgtcccggccagccgtgtcgggcgactcattttggccatctat

SEQ ID NO: 51378 - DNA, 34795 bp, Oryza sativa
ctgctgtaccgccgctccatcttctcccacgtcggctgcaggtagttctggcgcgcgtcgtcgacgctgagcgccacgcccctgcacaggccggcgaatcccttagcgacgtcctcgtcgcaccccatgaagtgcacgacgacgcctttgctcgccaggagcgcgacgtcgttcgccgtgccggcgagatgcgacatgaagaggcagtaggccgtgacgtggctgcccaggtttgggttgttctgctccagcgccatcaggttgcgcaggacccgccacgtgttgttgtccaccgtcagcgtcgggacgtgcagcgtcagccgccggagctccacgtcgaggacgcaccgtgcgtcgccgaggccgagggcccgtctcttgaacctcacgccggcggcgtggtactgcgtcgccccgcgccagcggtacacggtggcgcgcgcgcgcctggtggggatggggacagcggcagcgtcgtcggcggccggcgccatcgccatgggtgtgaagtgcatgtggagtaagtggacgaggtgacaggggcgtgtgctggtgatgtccacctccagattcgagtagccctggtctcggaggagtgaccggagatggcgcacgaacccatcgacaaccacgacggaggaagacgacgacccgccgccggcgatggctgtagctcccggagaaggagggggagagtggatcagctcgtagaccttctcgaggatgaagaagggtatctggttctcgagcaggtagaacacgtcgcgcacggcgaagatgtccaccgctctcccgccgccgccgacgccgacgccgaagtagtggagtatgtaccacccgtcgagcagcagcatcaacgcaaactcctccgcgcccatgtcatccgtgtcatcgcggtagtagctccgcgcctcgctttcgaggccggcgatggccgccaggtagcgcctcagcgtggacgcccgctcgtcgtcgccgtcggggagggcacgccggagcgccgccagcttgtccagctcacaccggtccagcgacctgtggtggtaggcgccgacgagcagcacctgcggagcgtactgcgatacgtcgacgaggcggacttgcggcttcacgatggaaatgtggcactccggcgagccgtgtcgccggccgccgtcgtccaaaggaacgtcgcatagttttgcctctagttggtcggcgagaagattgatgtcaatttgggtttggtaatcccctgaaaattcttctggttaagcatgccaagtgtcatatatataatatatggtgatctgaagcacatgatatgcttaattgcgaaatctttataatttatatggtgatctgaaattctgaagcacatataataatacataatctgttgactatggaccagtttatgaattattgaaatataaatatgcaacgaaagaatgaatctgaggaaagaaataatcaggtcaaattgcaaatcacaaatatagcatataaatttttaggccatttggcatagactacactcgacagaggcacctcaaaagcgattgaaaatgaagagagctagcactgtatatatgtggcaatggaagggaatatttccttaatttacttcatgaacattacttacctgtgactccatcgatgctcatttccttgtaacgtttctgtcttgtttcattctgctaaaggtggcatgttcattgtacaaaataaaacgaagttaacacacacatatatattgtgtgttccattcctccgatcccatctttgtccttttcacttcgactcttccatcgaataatattaggtgcaatttccgacggatgtgcatatccactatctaaagtgtgtttctttaaaaagatgaaaggctccgccaataaaaaaaaagaagagtactaaaggaaaagtaattaaagtaatatcttagtgcagctttctgtatatacatcctcaataggatcatgagaattccttcacaccgtacaagtagctttaattgccttttaaaatatcttccatgcatgtcacttgaacaaaacaagaagagtaaatgtcacaaaaacctgggtatatattgatgcatccgtaacacatgttgagagtgaatagaatcgacagattaagcgagagagaattgagcgacataatagagcgaattgatagtttctcattgatcaagagtacatataaatgtgaagcggtggcaaccgcagggacacgatggttgggaaccatcacatcggttatcgagaggggcgctgaggggagagagaggagcagtaacgccctgacattcgttagccatagacacagctaactcacaccggagtgttatgcattacctgtgatatagtaccagtcccaggatacattagctggtatacacagaataaatgtggaatcaaagtaaactgctttattacatcactggatagtagtacttacataagttgccatcatggacaggcccatagataaacaacacaacattacataaaaccataaaagcgacggcgcagaagtgaatagcgcggagaactaagcgactaagcaactatgcactaggcaaagaacctaggcaactaacttattccacaagcgaggcttggggctaggcacgaaacatctagaagtcttcatactcggcttgctcctggagatactcctcggcggtcgggtcgacatcttcgtcttcacactctataggttattataaggggcaagggtgagtacttaacgtactcagcaagccagggggaagaatgacatgtttagtttacacaacgaggctaaggttttatttgcgaaagctgcctttttggcaaagtgatttatttcacaaaactcctagtgagtgagtcaagttttagttgtcgggaggaggctcacgcctcaacccattccacaagttgctttgcaacaacttgtcaagattaacgaacaacaattaatttgttccctcattaactcgttttcactatcacaacaacacatagttcacccaattaccttagcacatcaacgccatcatggccctaacaacacgtcggtgtcggacgacaccccaggtcacacagacccgttcctaaccacaaaggttagccgtctgctacacaggcggactctggtaacgttcccttttcagtaaccacttttttcacaaacctttgtcaaacaaatctacactatgagaaacaccttacactcgcccttgaccgtgggcacgactgttcgaacagttcattaatctctacagaggttgcacgctttacccacacgacacgaaacttacactggtactggccagtaccggaagttcgtgataaggcctttccaaagctaacacatgaaaatcgcatgccacctagttgggctaagatccatagccgagtattaggcaatgacagccgtcatccactcaggaaataccgaggatgcctcctactcttactggtatcacgccacaatagaggcaaaaagacacccatgatgggcaataaatgtgtaatacttcgtctcctcatcctcggcattccacaaccattggcacaccaactcccatgtgataacaatttacttaaccagaggcatcccataaatatctgtgtggtcgcactgtaacgtgttcggatggatttcccaaagaaatcggtccttaacaataatacgtagccaaaccacaaaggcgtgactccgcatcatcaccactttcacaacacattttatttcacaactccccggtacactgtaccagatttttaagcatgtatttggaataacccaagtttcccacacggcaataacgtaagcatggctaagcgaaactacctcggtaatcgtataacgataccggcgcaaatatttgtggagctatcaaaggtatggaaacatcaacctatgaaatataagtgcaactactaggttggtccgtcggttgtataaacaatccgaggcctaaacatgttaatcgtgtgaactaaacaatgcatctttgcaaacaacatatcattaaaaatataggggcaatgtgatcaaaggggtttgccttgcacagggttggagtcttctctttcgaaagcggcgtccggggcttcttcgaactcaggctctaaacgcgaaaacaaagctaaataagaaaaggcaataaaacaagcttaaatcagataaacaacagtgccactgtgtagatctcaattttagaaaaatttaagaacttaaacggggtcaatcggagttactgttgattttctaggagttttcaaaggttaaaaggattttctgagatttttatttattggacgggaagggaatattccgctagcgttgacggcaaggaggtccacctgtcagtgaaggatgggaagaaggaggcgcgggcccggcttgtcagtggctgaggaggaaaagggtcgtggagccggcttgtcagcgactggagggggtcttcttcctcgtcctcgcgttctgctcggctcggcccgaggcgtgtcgcggcggcgaggcgcggctccgcggccaggggccggggaaggcggccgcgaaatccggcgaggttctgccggcgtcggtggcgccgagaggaggagcgcggcggcccgagtgacgacacggagagaagaacgagagaaagagagagatgagagagagagatggcaatggtgtggggtgaaaggggctcggccctccttttatagccggcgcggcttggcgggacgcggcggcgagctggcagctagggcgcgggagaaccgggggtatggggctagctgcttcggccggattcgcggagaggaagggacggcgacgcgacggcttggcgtcaggcaccggtggcgacgcgatgtgaagcgacggacgcgcggagagcgggaacggcggcgagacgtgggtgacgcacggccgacgacggctatggccgggatttggggcggtagggctataggggggtgacgcatgcggcggtggcgacgcgacgcgagagagagagggagagacgcggctcagcggcttcccgggaggagacggagacaagacgacgaggcgacggcgaggggacgcgcgtccgcggaggttctgggacgggacggcgacaggacgacgatgatgcaaggtgacgccgtgccgtgtctcccggcgggattcgcggcttgtcgtggcgcggccttggcgcgatgcgcggtgcacgggtaggcggctcggtgcagcacacggctcggccgattcggcgcccgggtcggcatttcgtcgagcggctcgtgtgcatgcactggctggctcagggaggaagacaaacagtggcggttgggctgggctgctgcgggagagaggccgtgggccggcctgcttaggtgggaaggagaggagagaaaaggggaataagtgtactttgactccctcaaaagtgacccaaatctaatccatgaccataaaccgcaaaaccggatatctcgacccccgaactattgaaaccggtgcaatttgactccttttgcggttttggagggcgatttcgttgacgtggcgctgacgtggcggtgttgacctagtctatgggttgatgtggcgcttaggtggcatttaaattaaaaacctacatgtgggacccatttgtcattcgcactgaagaatttgtggggcccacatgtcagtctatccctctccctcccttgtctcttatctctctctccctccccattcggcaagtagggaccgccggcggcagcggcaacgacggcgagcgggggctagagtgacggcagcggcgggagagcggtcgtcgctcgagaaggaggtgctgctgccgagctccgcatctgggcaacgccgagcttagctctcgaggttcggtcagatctggcggtagcggaggagctccggcgccgtgagttggccacgcggtccgccggcacgcaccggccgtcgttcgccagcgaggaaggagacagcggtgcacaacagccagcgaaagagcaagcggcgcatggcggccggcgggagaggaggcggagcgcgccaatcgccaggagagaaggcgaggcagcggtgcgcatcggccggcgggtgaggagagagcggcgcgtgacagctggtgggagaggaggtgaggcaacggcacgcgcctgctggcgggagaagagcggctcgccggcctctccgcctccccgtctcctccttttcttcttcacaggagacagtgagggagtgcgggacggcgaccggtggtggacggcgatagcaacgggatagagctcggcgagggagcttcaatggatgccaccgcatgggccgccgccttagacctccacctccgtcgtcggccaccgacgacgccaacgacaacccccaccggtcgacttcctccacaacgtcaaacccatctcgccgagcgctgcctcaccatcgtcgactcctccactccggggatcgccactcccacgtcagctcccggcgccgctgccacatcaggtcccgccggccgaaggggagaaaaagagagaaagagagaatggaggaagaggggaggaagaagaaagagagaggatgacatatggggcccatatgccaatggcccccacaaatttttatatgtgtgaatgacaaacgggtcccacctatatgtttttaatttagatgccacctaagcgccacgttaacccatagactaggtcaacacagccacgtcagcgccacgtcagcgaaaccatcctccaaaaccaccaaaggagtcaaattacaccggttttaatagttcgggggtcgagatatccggttttgcggtttagggtcatgaattagattcaggtcacttttgagggagtcaaagtgcagttattccgagaaaaggaggaggagagttgggcctgggagagaaaggaagagaggcccaaaatgaacagtgaactttcttattttctcaaggtttgtagaattgaattttgaggatatttgagaggaatttgaatttgaattttgtctatggtttcacaggaatttgaagtgaattctaggccgtgccacgtggctcaatgccagctcaacaaaaatctcggcgccaacattatcggcgctgagacgttatacctcagcgccaaccttgatggcgttgagccgacggcttagttttggttgaagtttttggcaggggctattttcaaaataagtttttataaaggatcaatttgtcaaaaaacggcacggtgccggttctaatatagaatcgacacttgtaagggtgtacctgttttttatttttgttggtgcaaaaaacccgaaaaatatttggtcttattattaggcacatatacggtcacacttcagttcctataagtcacatgattttttcaacacatattcatagatatttgtttaagaaagaaaaaatgcttatcaatgggtgcccgatgcatgaaggaaattgtcagagtcacggataaggtataccctctattcttggatgtacgttgtatactgatacggtatacccgcgtgtatatggatagttactgtatacgttaaggaaatctatcacgtgataggaacagaatccacagatgggaggagtcctactcgtacaagacttggtctttaccatatcgtaagggtccgatatctccgagtcctacttggagatcaactgacccgcggtataaaagggaccccctaggcaggacctaaggcatcgaatctcactgccaacatatccaccacagcctacgaagccggagcctacgggagccaagtcgccgggtgatctagtcaaaccaactcgactacagtatcgtcggtatcatcgagttccgctattccctttgtaatctgtggtttccatcatataatcccataccaactggattagggctattacctatcaaggggctcaaaccagtataatccttgccttctgtttgcttgatgtcgtattacgtagatcctcgtaccaatgtaccccaataccctctatatccggtctacggttatcccccatcgacagaaatatcgggcacccgcacccctacctcattttccactgacacaaccgcatccttatctcatttccgccaacacaaccgcatccttatatttttattcttctctctctaccctttcatcaactcctttagattcagtccagacgcaggcagcgacggggttacggaggtgacggagaagacggaggcggccacacggacgtagctgagttccgcgtggcatcaactacggtggccacgagctccgtgcgtcatcaatgatagcggacacgcggacgcggctgagctgcacgacgtcaacaatggcggtcgagctccgtgcggcaccgacgacggcggccgagctctgcatggcgagctccgtgcagcgtcgacgacggcggccacgcggttgtagcggactcgtccgagcttggcacggcatcgacgacgatggccacgtggttttagcggactcgggcgagctcgcagtagatctaggcttttctctctaattttttaatgtatcggcccatgtaccatgatgtttcattagttggattgaaatgttgcagtgaggttttctatagtgtttcattctttttttcgtcgtactcggatgtgtttcatgttccaatatgtttaaaacaattgtttcatacattgtatcaaaagtgttttattacgtgttttgactgtgtttcagattttttcagtactgaaaccttttctttacaaggggtgaaataacgcccgatttttactccgatgtgttttatgttccaatatattcaaaactattgtttcatacagtgtattaaaatgtttcaatacatgttttgattgtgcttcagaattttcagtaccgaaacgttttttacaagggggtggaaacgagctgagccggctcggcttgcagtggctcacaacaaactaggcttggcttggctcggctcagttacggaaacaagctaaaacttgggctcggctcggcttgtttcctggctcgagccagctcaagctggcttgcaagccttcctgttgaaacatctcttcatatatattttataattattaaaaaagcaagaacaaatcatcaacatgtaaaatttaaataagtttatatattcaattcttcaaaatcttaataataaatttcaagtttacaaataataacttcataaaaaataaaatactcgatataaacacatgatgggctaggctcgcgagccaaaacaagcggctcgtgagccagctcgggctcggctcatttcagcaatgagctgaaaaggaggcttgggcttggctcgtttggcctacgagccaaggcaagccaaccaagctcgagccaagcccgagctgagctcacgagcccgagctttttttccaccctacccgatttgtaagtgcttcattaagaaagatttgaatataagaactttctctccatctaaagcttccttaccatctaacgtacaaacagttcatgtattggaaataaatgctattcttttgagactactgtcatgaggtcaaatgaaaagtttatcaactacaaaattgtagatctcatctagagctacaactttgatatagtttttgtctttacccgatatcgtttagaaatttgaaaaaatcacttatgcaaatagatccgagaccttttaacacatttttggacatccaaacgatcttaaataaaaaagtcatcaactacacaattgtagatatcattgagctctacaattgttatagcgttgttcttcattcgactttatatgaaaaagttagataaaaaacacacatatatgaattacgtcatcagtttcaatagtaagcatgcacctttgggcttataagtgttggtttttattaagaaacgactcatatgtgatacccatatgtaatggttcatgataaagaccggtacctatgacatcgcacttgtatgtgccagtttattataagaaccagcacctgtgtgatgtctacaggtaccggtttataaaaagaatcaacacctatgatttgggggattaattatgtcagttttgttataaaccagtgccaatgagtgattatatgtaccagttcttacttttatattgtaaaaaggtgaaaaaagcttcatagatgtcggttttaagcaaaccagcacctataagaccggtcactatgtggtgttttgtaatagtaaatacaattcatctgagggtactgtatacattggctttgagctgggttgcccgtgggccctagtctctaggcccgatgctattattagagtcaattcttaaacatgatcttaggctatgcatgatcacctcttatgtggaattttatagtttactgaccggatcttgctaaaaccataagttgggtcggtctagtggtagtaggccgccggtgatgggatcaccgtgcggcagtggtgacgggaaccccacggtgcgatagtgatgatgggaatttgcccttcggtcccctttaacgcaccttaggatcggtagtctgatggttttgggaatggcttagcgtacgtgagtcgtcactcgtgcataagatcaaggttcctttttacgtgtgttgaggggatctggaataattccttctcaagaaaaaaacgacgcatctggttatagcgctaaggagagaaatgtgtatgactcgctcctcaacgctagggagcacgcgtatgcattgctggaccaaaccgtttgcttcactttctggcttggtggccagatatcaaccaacacccataacattgcatcattcctttcaagcagcacatcctcaagctacaaaagggtttaactgactcaaacaactccctagatcaaactgactcaagctttctacatcttgatcgaccatttttattatttagtatcatacatgtgtttagtatcatgcctttattatcattagactcgtatttagaaatatcttcatactattttgcagttgttgataatttattttgaaataaattaatggtcaaatgttggacgctgtcaaaatctaatatgctttatatcttttaaacggggactatccatttaacattcatccaatgcatttcggttagcaaaagaaattctaaatatgtacaattatgcataagattgatatataggggcatcatataaatccaaaaactgatatttcacgcggactggtctaacgttactagtgaacaaactgataatcctatctttttttttttgcggggttgataatcctatcttgatttggacatatatagctaggcatcaattaatcggcgaccaagcaaatatttatgtacagtacataagttttggatttaagctatgtatatactaaaattgaatcgcagcagtcaccgttggtgtgacgtccagtatatgaaaaaattcagtcaaactcccgtgggatcggacgtataatgccacgcacgcgatgatatcatgcatggttattattagccgtatatatagggcttatttagaccctccaaaatggtaaaatttttactgttttgaactactttttggtaaaatagatctaaacactattatcaaaagtgggcaactttgcatttgtcatttggaaggcatgcgggacgctcactgcatgccccggtcgctctctcaccctcacttgctcgctctctctcatcttgcacccaaaatttccccatctcgcccgcctcctcctccccagctctgcctcctcctccgccgatctcccccgccaccgccgctcacacccgcctccatctccgccaatcacgcctgcctctgcccctgccgatctcgcccgccgcagctgctcacggcagcctctacctcggccgatcttgcccgccgcaacagtccgaggcggagatggacggcgacggatatgatgacggctccggcacgagggacttcatgtcacagtccgattcacacgcctccgccgatgggctcgacccctacaccgactccctgcactagttcactggatttggcagcggcggtgcttctaggataggcatggccgcccttgacctcaactccagtggggatgggtggccggatctagaaagctacgagggtctccttcgctccggttcgcgaggacgcgacatcggcggatctgggagccacctttaatttgggccgatgcacaaggaggtgacgtcggcggatctgggagccaccttcgctccgcctcaaaaggaggcggctccgctgacctccctctcgtgcgtggctgcggcgtcagtcagacccttggcttacgcgcagcctgccctcccggtggtcgaggtgccattgccgcttgcggcaattcctcaccatatggaggtggccgtagagcgcctgcgaccggacggctgatgcaagggcgtggtcgaggcgcgcccgcgaccggacccaggagccatggtggtggccgtcgatccgcagcctccaccgtatctgaagacaacttcgacatggactccaacaacgtcgatgattaatttgcatcagatcatgataccataatgcgtagtagtaattagcagtactccctccattctgaaatataaggcgcaaccactctcaacctaaagttcaagaaataattattataagttatcacctcatagtttaaattaccctaataaatataatgcgtgtacccaatagaattaaacatatatattgaggatgggggacataaaaaaataataatttagtgggaaagaagtgctagttaatggtatatattcatgcatgtcttatactccctctattttaatgtatgacgccgttgactttataacaaatatttgactactcgtcttattcaaaatttttatgcaaatataaaaatacttatttcatgcttaaagaacatttgatgataaatcaagtcacaataaaataaattataattacataaattttttgaataagacgaaaggtcaaacgtttgttaaaaagtcaacggcatcatatattaaaatatggagggagtattatgaaacatcttaaaaaagttgtggtttatattatggaatggtgggagtataatttttgcaaaaattatagctacttaattattgaacagagataatttgaatgcgtacgtgcaacctgaatcgtataagttacattatagcggctttcataagtacataagaaattaatttttactaaacaatcttatagtaaaaaaaatataaaactctatgtaaaatactccctcggttcgtctaatacgataaatctgtacagctaggaggagtagctggtggtaaattaacttcgaattactacactagtcttctctcgaccggtcagcgcatagtgcagccattatctgattacgacggagcatttgccgttttctgggcttgtgtccagcaacaagaaacgtgtaagaaccacagttgattgtaataatctgaagtctttaacatttgatggcgttttgcgctggcattgatagagaagcattagccgataccaggttcgccctggttgctaggcagctgatcattaatttctacgaggctctacctagtcagtctacgcgattataattaattcgagggcgtaaaacgcgttacggactattcaaaaacaatgctatcgcgaggatatatctatatgtctactattataaaaattaaaaaaattaaagatgttttgtctattattataaaaattaaagaaaattaaagatgctttggctgatacttttatacttcgttagtatttgagtcgatttttaagttcgtttacttttcaaaatatataaggagtcgtataagaaattattttaaaaacatcctatgtaaaggatttatccataatgactatgaacggttgctcctgtagtggctgcaaataaggtttagctgctcttatataataaagaaatctatatttacaatgaaaatttgacctgatttttttatgtgcgatttaaatagacatacattttttgcaaataaattgtccaaggtgattttttgctgattctcttcccaagaatcatgcatattaactgggacgagagttggactcctaattgcttcagaattcttacaagaccataagaaaacaacttataggatatggctatcatcccgatagaagttccaacttagatatcaatactatcaaaataaaattcccataaactttttttagataaaaaaatctaacaataatatgattaaaatagcatatgtagtgatttatagattgatttataattaaggagccaatatttaacattgagcaaggataatgtgaactatatatatatataaatcactacaaacttgtagctcatctacaaactaataactggccctgctgcatatagcaaggtatgctactacctccgttttagcttataagatattttgacattgatcaaagttaaactactctaactttgactaattttataaaaaaaatagtaatatttttaaccaagacaaatatattatgaaaacttattcaattatagatttaatgaaattatgctgactagttttttctacagaattagtcaaacttttttctacagaattagtcaaacttaaattagtttaactttgaacaaagtcaaaacgtcttataaccggagggtgtattaatcttgctctaatgctgaatgccacaataagatatgtcatgaccaaagccttaattaattaccaaatggtttggcatatagatgagtaaataacctacgcatactgatccatcgatttctgaaattatgatatgtagggtgtccttcgtataattatgcgcactgtaatgaatttttataaaaaaatatcctctataggattcatttattgttcccattaataataaatttgattatgtatctggatgagtcataagttttttttttaacggaaggagtagctatatctgttgaccctgccggtccatcccctatattcgtccatccgttgtcgtcggccccctcttcgttgtcatcatgtacttattaccatcggggttccttttgttttaaggtctcgttggctgccgctcctccattcatctcgctcttatcccggtctgttcgttaccgcagagacatttaaaaatcatcaagtcaataccgctagtttcctttttcttttattgtttttagatgttatctgcatcacagcatgtctgattgtctggccgcatatttgtgtatactgtacatacacactacacacggcaaactaagccaaccagaagatgaatatggttatagtacccaaacaccaaaacttttaatggagttaaaagttatcctcgaatcgatgtagatcagtctgaccgtagatactaattaggaaactaggtctaaatctttcgataggtattgacaacactcgatttggcaaaaacttgacatatatgttctggcttctgataaagacgatccaatccctacaaacgcagcaccacgtctcctctgtttatcaaccgtgcactgcccgattgatcttgccgagaaggctaatccctacatgcgaatcgaagaacacaaagcaagagcaagatagattgcaacacaattgcatatcaatgattaagcacttgactttggggttccacaaaccgatctagcggcgaaattacaatgacagaaataatttaagcaaatcccaattccaaactatgatgactactgaataaatatgatttaggatgtcctatggtttccctagggcgtagaacccattgggtttagcccacgacataattataatacctaagactcaaatcagattcggactggatgtatgtggcttgttttgtatattcccgacagctcgatgggaattttgacgtgggacaaaaaccatctcaaagtagacactataagctttccagcaagaactcatgggccctgagattccttctagatcagcggctaggtccgtttgaaattgatcctgtcctgaggtccaaatccgaatccaaaacgtattgaactttatctattgtcttgtatggaccaaaagtgacgtggtgaggtacaagtggacttggagaaggtcttggtttggtccttaatcaacttttttgatcatccatgcattccttacgctcgatctcttttccttcacccaagcaagtacctttggaaatgaaaacacacgaaactcattgtgtaacaacgattgttcaaatatataacaagtaaatataatatatatgttatcgaatgacaactgcgtacatcgaaagacgtggttcacacagttcacacactagaaagtaaagcaatatgtattaattaaaggaatttttttgagaaccccccataacatgcccctagggggctatttatagccttagtacaagctcatgcaccgtagagttaatgtgtactggggaatttacatgggtacccttatgatggtgacatttatgagggtaactaaagcttattttgccttgggccccttaatgggggttaactatggtccctcaagtgacgaatgacccatttaggccttacagcttctttggctgtggcgaagacatcaaggctcctagcgaatccttcttgcttcgcccaaggcaaaagccttggccttcggctggtgtttcgccccaacgcatctggtttaggcatccttggtcgaaggtcctcgtgtcatgcctccaacaagcccctcacgcgcaagtataagttgggagcttcggccgagaccgtgtgaaatacaaggtatggcatgaggcacccctttcggccgatgttcttgccaaaaccataatttcattcctgcaaaagaagcaacacttgacttgtttggaatagagtttaattttggtttgatttgaagttttttctgaattttgaatttctccaaaaaatgaatgttatgggctgcatctttcagaaattgctatttttccgttcaatgtggccttttactgtttggcccgttggcccgaatcgagagttaccattgcctcgctatttggatgccatgtggcttgccgtcattggctggaagttgaagcatcgcgggggtgaagttatataatccccctcccccgaggtcattctcactttcgctgcggtcaattgttccgagtcttgcagatctctcaacgctctcgctctccgtcttttctgagcctcttcgctacttgaactttcaccacttcgcgtctttttatcctcgagactgtggcccctcgcaaaccagctttggctgtcgtgactagccccgaccccgggcgattgggcgaggatgtctcatgctttctgggcaagtcgctggtcatggagggtgatcttgccacgctagtggcgtctagggcgatcgtcgaaggccaagcttttgtgtctggtgatgctctcgttccgcatccaggtgaagggcggaagctggttttctctgcgttcttcgacgcatgactttgctttccttgcgaggttcttctgctagacgtccttcgcatgtatgagatcgagcttccccagttgagcccttctgcccttgtacagattgcagtgttcgaccggatgtgccgaacgtcaggattcgccccttacgccgaactcttcaacgccatcttcaccgccacgatcctacgatgaagacaccagctgggccgaagaaaacggtcttcggcagcattaacttcatccttcgtctggaaatatctgacttgtggctggtccatgcttccgccactggatggagaagtggttttaccacaacgtcccctatgaagcaggctccaactgggcgaaggtgtggcgcatccgctgccgggccatatcgatcgagtataagctggacgtggaggtggacgagacaatggaatcacgtttcagcctccttcgcaagatcgccttttggctcagctgccgagaccttgttgtggagtactgcatgcttcggatttacctcttgttatgagactcgggtgttacgcttatttcggacgaggaggtcctcggccttctgcgcttcacccttcccgcgagcgttaatcgtaagtcactcttcgccttattttgtcttctgaaaagccgaagtaaagcatacttctattttttgtgtatgtttgatttatcagttcgctcgctgcgggaggcggagaccgaggcaaaaaagatgaacatggacttgaccactcgcgaatatgacttgctgctttcatggcagattgaggggcgggcgaaccgggtgcatgacggcgaactgcctccctgggcaaaccccaccaaagtggtcatcatggacgatggcgttgggccgtcgaaaaaatggaagagagctacccaaaaaggcacttcgtgcaggtgggccaagtcttaagctctttattaaacctaacaagcagtattatagccgatgaggcatgtttagggtcttttattccttgatctacccagtccatagccgatttggtctaactacatcgtatgagaccgccaacgatatgctatcctatcggcctgttgtctttcttgctgattacaggataaaatcagctagtacgcccttgacatactcgaggctagccttggaactgcactggagttaagcagatctcccaggccaccgtgttttccgtcatcactaccatacgtcatcacagataacattatcttttacaagtgatagttatgaactatcaatgatgggttagaatttaatttttttaattttttgaataatctcagatggaggcatgccatataaaggttgttgatcttgacgatatctacaacttcataactgacaacattttcattagagatcttctacatcccctaatatgaatacaagtgctgagatctatttttaacaacaaaattttgaattttcaaatgacctcgaatggaaacatgccctatatcgaagtcgttggtctcaaccatatctacaacattataattgacaatatttttatttgagattgtttgcataactgaatatccattataaggtgagatctattttgaaagacgaaattttgaattcttcaaactaccttggatggagatattcattatataaaaattatagaacacactaagatgtaaaacattttagttgattgcattttgatttgaaatcattgaaagtgttaagtatatgcaacatgctttggaaaggaatagttacaagaaggaataagttcaccgaaggtccctcaacttaacagcgagattttttttggcgtcccttaatcgcaaaaccagaaatcttcacccctaaactatacaaaaccgtccaatttaggtcccatggcagtatagatgcctggtttcactgacatggcattcgagtcagcaaaataaaaataaaaaaatatgtgggtccacatgtaagtgaaatgagatagaaaatgtggggaccacttctcttcttctctcttctctctttttttcttctcttcagctcctctccccaggaggctgccgccgacggcaaatggggcgaggcaagccggtgagcctggccgagctccgccgccaccaccgcactggtgcacacgcgctcgcccgttgttgcttcctttgccccttgtgccgtcgcttcccctgccccctgcgtctccgctcctgacggctaagaggcagtcccgaggacgttgcttgatgatcagcagcgtcgccgtctcgaccggaactagatgcgccccgatgccacgacagcggaggtggctagaggaggagcggagcgcatcgggcggagtatgccggcagtgggggcaacggcggcggctggtgaggtcgaggcggggcaaggggaggaggaagtgaagagggggttggaggagagaaggggaggcgctcgccctcaatctcgacggtgccgtcggtggtgagcacggagtccacgcaggcagtgtagctcacctcggccccgatgaaccacaccccttcgccggtactgtcgatctcaggctccccgacgactggcttcgtgattcggccggcgacagggttgtagtggacgaccgatgcggcctggtcctcgacggcttcagcggagacagaggggaatacttggatgaagttgatggagacgcgaacggcagtggtcttgtcgtcgttgtcgatggaggatagcgggagggagccgctcggggtggggctccaccggggcaccagcaccgcgtccccccgacagccggtgccaagtcgccgcctcctcctcgccgtccctagtcggcgtcttgtcatcgtcgccccaagcttgtcattgcagcgggtcatgcccccacgctacctcctcgccgccatggctacagtggccgctgccaccaccacatagccggtgccacctcctctcccacctctctcgccggtgtggccagctgcctctctcgccaatcctcctctcccacaggtgcgctaccaacccccctcccgccagctgcctgggaagaagagagagatgttgatggggctgatatgtgggccccacatttttttatttttattttgctaactaggatgccacgtcagcgaaaccaggtatctatactgccataggacctaaattggacggttttgttaagtttaggggtgaagatttctggttttgcggttaagggatgtcaaaatatctcgctgttaagttgagggacctgtggtgaacttattccttacaagaacagtattcaaaaagtaatcaacaagtgctctataggtgagttggtaagggtagtcttcgtagatagggaagtctttgtgttcaatactcaacaaatgtgtgaatatctatatagctcataaaatcatgggttggtgggtagtgatgtatcaccgtgtatagtatggttggtaaaattaaaaataatattttttagtttttttgtgcatttaaaattcaaaatcatgattattaatttgtcttcaataacagttcgtgagttacaacttgtcagagatgagtcatcggtgatggatggaagctactacatgtcacataacttacacacccatcatagatgactcatctatgacgattgttcacctatcataaatgatattttgtcattatgaaccacatacttatatgtgacgagggccgaagctgtcagagaagacggtttgtatctgtcagtgatgaccttgtcctggatagtgttatctaatgacactgatttttctctttttctatgactaatatgagaatttctagacaatagaaataacacgacgtctcttttcaactatatctttaataatgtaatagatagaaagattgatcataatgtggaaaacaaaaaacaaaaacacgctattgttcgtcagcatgcaataggatttgcgtggaagtttaagtttgccaaatagatttaattcattcttcgtgatggagttgatcggaactgtcgttttttccaggatgtagctaggtgttcatttgtttttatctgtccgccaatgggaattactaacattgtttgcataggaagattaattaatttcccagtcgaagctcgtacagcaccgggcccggggaaccgtgtttgccaacaaacacgtggcgtccttcggcgaaagttcaatttatgcagagtctattaaagagagtgtgtgtttgtgtgttattgtatgtaaaaataaaatgttacatctgttttctttttccttaacattgtaaacacattaagatgatatatatgtccaaattaatgcacatatttcgtggttattatttcaattatacaacgcttaattacaagacatctaaaatacattttattgaagggtttgagacaacatgtattctaggagatcatctattttggaacgggtgtagcatgaattgtagcaagtaatatatcatcacacattactagtatatatatttttatatgctactctcactgtacacaagtaattatagtaagtaaagtaaactacatgtagccagccaattgtggtagtaagagtttttttaagaacaaataattaacagacctacatatacggattattacagtgggccatggtttttatggacctatcactactctatatgtgatcagccatctaaatgtctatctcttgaaaagtagacaaccggaaaattagtttttgttcgtttgcgatgactgacctgccatacagtacacggcaggaaaatttacaattagtgagcaagctatagctagtttattgccaatttttttagataatagattttcattaatctggcctctatatccacaagggtagtttattgccaatatattactacctgtcttcctctgatttaaatatgtatatgatgtcatttacaggattatatatcatgtttatctattcgtcttactaaaatgttttaaataaatatatttttcacatgttgtggtttgatttatcactaaagaactttaagcaatacttacttttaaaaatttgtacaaaaatttttaataagacaaaatgttctaacgaaatttaatggcgccatatattaaaacacggagggagtactataccgagaagtactctctcgcgatctctagataaacattcagattggctggtatttgcgcgtacaatatattataaataatacattctgtattcagctaacacatccatccgtattccataatatctcctgttcgcctgttcgtcctcctctcttcctccacttcatctcggtggaccttttttttttgctgcgagaaacgtagatccagcttgtttcgatgtcgaaatgcacagcaaatattgggcatgaaacctacaggatcttcatcgtcgataacggaggcaagaactacctcgccgtggacacgtccggcaacgtcgtccttgtggaagatccggagagaacgcaaccctccagcaactcctatggccgacaggcatgcatatatgttcttctctggatcttgttaattaattaatgaatgaattccggtataattggctttctctgcatgcagctgatatggtacaaggtcgtcgacgaggccaccggcggcggcggcagcacaactaaccagaacttcgtcctgaaaaacaacagcaagcccctcgtcgtcaagagtagtcgtggcgacgggcggcagcggctggatgttgttcttggccagggaagagatgttggagaacgctggacgttggaggagatacacaagggcgtatgctacatcaagagtgggagctactccaaccacatcttcactggcgtctcgaccaagaggaccgtccacctgcaggagaagcgcttggccaatgccctctccctctggacgttcgtcccggccgaggacgccgatccaagtgggtacttcgtgccaaggttttaaatttcgaaattgctatttctgccccccccccgggggggggcgaaattttggaaatttcaaaaaaaatttggccgaaattatttgaaattttaactgatttcgaatgaatttgaataaaatttgacaaaaatcacaaaaaattgcataaaatggaaaattttgggtgagatatgatcttaccggttggggggggggggtttggaaatttcaaaacctgcttcgtgcttgaaattgaatactcccttcatcccaaaatataagcatttttagcatagtgacaagtcaaacattttcaactttgactattaatagtaaaaaaataaaaaaagatcaatcatataaaattgatgttactagatttatcattatccaaactatcctaatatatgttactcctttatttaagacatcttacttttacagatattgttggtcaaagtagcatctcggaggccgtgtcagaatcaaaaaatgattatattttgggacggagggagtatataatttcttcattttaaataaaattaaatactacctccgttttaggttataagacattttgactttggtcaaagtcaaactgttttaagtttgactaagtttatacaaaacaacattttcaaaccatgacaaatttattatgaaaatattcaattatttatttgatgaaactaatttagtattataaatattactatatttgtttataaacttagtaaaacttgaaacagtttaactttgataaaagttaaacgtcttataacctgaaacggagggagggagtacctaacaagttacaacgactgaaacggagggagtacctaataagttacaacgactgatggaacatgaactaactaatttcatcataaaatatataactattccctctgtttcatattataacacgtcttgacttttgttttaattaaactttaaaaatatacgatgaagtttatagaaaaatatagcgatatcaacgacaccaaattagttttattatgaactgattgaacaaacaaaaagatatttgacaaaaaaaaacgtcttatataatactccctccgtttcaggttataagatgttttgactttggttaaagtcaaacttctttaagtttaactaaatttataaaaaaatatagtaatatttacattaccaaattagttttattaaattaataattaaatatatttttataacaactttatcttagatcgaatatatttctattttttttcaataaacttggttaaacttaaaacagtttgactttgtccaaagtcaaaaatattttataatctgaaacagaggaagtataaaacagataaagtaccacttattattaacaagttgacatcgacctcatgcaggcacatgcatgcatacctacggccagttggttaatttcttccattgtactgtatatatgaaaaatccgagcatcgtcatttgctgttattatattctttttcttcatgtcgatcagggcatacccccgatgggggtgcatcgctaactctatcaagaacagctccccacggtgttccacaagtattagagccgtctggcaagatgcatacttttacaggaggtaagaaattaattattagacgatgcaagcattcagagactagcgagctgagtgagtacgttctagctcgttggtacgcctgttatttcttcgtgttcacgtcgatcgatcacacatgcatgcatgtatatatatatgcagtgacacgcgtcacgatattgtacatttttcagaaacgcatgtacatttatgcagatggaaagagtggcagtttttctctacaaacacagcacgtacatatatatatatagagagagagactcctccgaaaagattgtttttcaatcgtgtaaacacaaagcaagggtatacatatatgcctgactaatttctctcttatttttccttgttgcagatgctggcacatcattaggtagtgcacaatctaatcagagaaagcctgttaaaggtaacatccccatcagaaacacttcgaaacagagcacgtatacccctcttgcagatcaaagaaggcctttcgatgttaaaaaaaagagtaaatttcacaaaactacagatatatttaccaattatcacaaaactacagattttaagatgatatatcacaaaactacagatttaaggtggaatatcacaaaactacagatttaataacaaagttatcactggtttagcatcaatttaattataaaacttggatggttataaatcaatcataacattagtgctaagaatttaaaccccaaaacatgtagctttgtgataattttattattaaatccatagttttgtgatacttagtcttaaaccggtagttttgtgataattttattgttaaatctgtagtttagtgatatatcacctcaaattacttgtagttttgtgaaattttctctaaaaaaggaaaacctttctcggtgcgaaataatttataatagtataccttctataattattatggtggacaacgtatcatatgcatataagcttccggtgcacaatcaatatccatacataaactaacaaatgtcatcagaaattttttaaaaaaatggacatgtaatatcgatagtattagacctagcttcgaagtaccatatctaaattcaatatatttcagccagaaaaaaaaagacaaaatcttggcagttttaagaatataaaactgtcaaaattataacacagaacaaaataaatcgcatgtacttgatgtatatacaaaacaattcactgaagtatatataactatcagttatactgatacattatttgaaatcttttgtttgaacaatgccaggtggtcgtgacggcgggcgcagaagaaacccataagtaaccatgaatggacggcttctctgtgttgcgtacaagcattgtgggctccagtcaaagtacaagacatatatacggtggatatatatatatactcctactcctactcctacataggagtccttctgaatctatttgtgatggattgtgtgactgtaatcatattgtaaacggtttgtcgcgcaacttcttatatgtgtatgctatatatatgaggtgtgtaagacgattattattattattattgttgttgttgttgttgttgttgttgttgttgttgttgttgttgttgttgttgttgttgttgttgttgttgttgttgttgtgctttcattatgtaatataataagagttggtttggtttgatattatcctttataaacaaatatatgttaaccatttgctttgattctatgcatatacatacacactgcaccaagcccagatggtttcaatgtgcacttctgtagagccctttgagatgtttgatagtgttttttaatggtacccttgagctgaaaagactgaatgatggggtgatcttcctgattcctaagagtactgatcacattaaaagaaaagaattctgacccctatttgtatgttgatagcaaagttgactaacaagattcagaggtggctcgccgttgtgctgcctgagcccaatcgatcacgcggaagagctgttccccatcctcactttgtcctccctacgtgctgccgttcttcacagtagacgatgcctagatcccctctacagaatcgggcgcaagctgtgcatcaccactactggagaactgatttttcattgtgttaccaaaacctcaaatttctctgatctaatactaaccggtagtaaagataatctttagtaccggtaaaccaacgatactgtacaatctttagtcccgattcaatattatcagaccatgttaggcccctagtactaaagatcatttcctatatatgttcctcgtctagccattgctgccaagaagaggaggaagagatgtcatggcaaacttcttgctacagtattttggtgatattagacaaattgaaaagatccaaaaggttagtaactttatcctctatttttttttaaaaggggaaactaccccacatttgcccaacagtatatatttcaggaatttatgtagagtataagttacaagttgaaaacaaagagattacaaaagttgtagccaatcaaaaacaatttgtttaaggggaaactacatcctctattgatgtatggttaacatattacatttctagctatgtttctatacgccattctcttacaaataggttatggaaaaagggtacagagaataaatttgtagataaaactagaaaaaaatgcccgtgcgttgcaacaggtgtaggctattttaatattattatgagtaaattttagaaaactacaacttaaattgatcaaactattagtttgctataacattagcgacatgtttcagcttgctacaacgatagcatgggaaattatcacaaaactgcaacttttacgttgctgctacagttgtggtatgggtgaaactgacagcatgcatttgaaacattgtaggagagttgtgtacatgggccatcatcgatttcttgttgtaagctatcctgtacgaaagaaaggcaaacattttaaacagaaggcagaccacagaccaccgtactaggcctaaacatcgtaatggaaaaattgtgattgctacagtgaaagatctaaaaatagtatttggaaagggacctggtagccactccatagcaagtgaagatgatcttgcgatgatgtggaagaaagagtctcattttgggagttaccatgatggaaagttttagaggtacaccacgcaatcgacgtgatgaacctcactaagaaccttcatgtcaacctgctggggttcctaggtgtatatggtaagtcgaaagatagacttgaagcatgccatgatctgaaacatatgaaacaacatgacgaccttcatccaaaaaaaaaagaaatgaagccattacttaaatctaaccagccacactctgagcaaggcagagaaggaaactatatctgaatgcttggattgcatcagggtaccgtctggatactcatcgaatataaagggaataacaagggtgaatgagaagacgttcacaaacctaaagtctcacaagagactgccatgtgttgctgacataattgcttcctgataatgtacatacaacaataacaaagttgtctgctttcctgaatgcaatttcgcagaagttcatcaatttagacatattaacaaccctaccaaatgacgtggtgcaatgtcttatcagctttgagatgatcttttcaccatccttcttcaatataatgacgcatcttctatgtcaccttgttgaagaaatcggtattctcggccctgtgtatctacgcattgccagggtgtcatgccccgaactagccccgaacggaactagcccgtgacgctccaaattaacctgtttatcgatattagtcccaggaaacagtgctggtatcacaggaagacagaatatcacagcaacagaggtctctttattacagagtaggagtacagtcatgttgggctgcggacagatcccgagctcacaactgcattacaaaaggggaaagcggaagccaagacttggaccaatcatcacaggcgcgacttgggaactaggccgaaaccctaaaactcatcgtagccgacttgctcctggaagaactcctcttcttcagcaactggggggagattatttatatagagcaagggtgagtacaggagtactcagcaagccatgggaattaagtgtttaatgcaggcttcaagggaaaggctgttgtttttttacaattgattttatttaaactcctttttgaaacaactaagtgagtgcttctcaaacgacacggatgagacagtgtgtctcgcccggtcggagtatgtgcaatgtatcagccttttgaattgatcaaggttggcacccgggcaacagctttcaaacagccacccgggcctggctgatcccatcagccgcaaattttccaaacatcgaacccattccacaacagcaatttcacaaaagcagtagtcaaacaaaactacgctagtaatcacctcacatccgcctatgaccgtgggcacggctgtttgaacagtttaataacctctgcagagggggtatactttacccacacgacattactaacccggatcatccagcccgtgcagaacggccacgtctggagaccttgaggctttcataacaaggcatttcgaaagccgacacaggttcaccatatgccaacgagaggggtcccaaaccaacaccaggttaggtcccggaccatactatgccaggaaacccgggggttctccccggcaccaccccgttgaatccacatgtctcttggcatcatggctcccttgattagctaattactcagccaggggcgtcccattccacccatgtggtcgcacttgccttatgttcggatgaaattccaaggaaacggtccttaagtgcaagagcgggaaaccgtactcccggtacgttcaccggtctgcgattttggaaattcatttagttcgcaagcgccgacctaggtgtcgagtttttccaagtcttttgtaaaaccccaagttttacccatcattggatattttaaatttgaggagaggtgttccgatgcgcgtgcccgaaggcccgtgcatcgaagcacaacagttgacaaaggaggtttaagtgttcaataattcacggagggtatttgcagcaatttaggattgggggccggcaggctatctcgcaagccgcggccgaattactcgtgataatcctatttatgcaatatttgcgaaaaagaaatacttagatttaaattataggtgcaagatgatcaaaggtgacttgccttgctcgagatcttgagcttgatcctcgaaatcctcgcactgcgggtcttcgggctccgaaactacacgcgaaacgggacaactcaacaaacggcgaaaataaagccctattattgacctctaagcgtgccattagatagatctcgagatctgaggaattttggaagttgaacggagtcaaacggacatacggttgaggagatattgaatttctaagattattggatttttgatctagaggaaaaggatttaattaaacccttttgaaaaaggaaaagataaagggaggagaaatagacttccctcgggcggctagggcgcggcccgagagaaaagggcgcggcttggctgagcttaatgggccggccggcccgagaaggcagcccaaggcacgcgcgagaggggaggagagagggagccggtaggccggatccttctcgcgtggtcccgagtgggacccgcttgtcggtggctcggctcaccgtgcggagggagcacgcggcgcgcgctagggttcggggagagagacgcggtgcacgcgcgcggttcgcggaggacgcggatgcggcgggcccacgcgcagcctcacggctcgcggtggaccgcgcgcgtgagcggggccagagggagcagctgactggggtcggctcgacccggtcttggccgagctagtgccgacgtggcgcctacgtggctgccacgcggtccagcgggaggtaaacgacgatgtcggctgcgaacggcggggcgaaccacggcgatacaggcgaaagcgagcacaccgggtggttgcacgagacgaggggagacgagccaacggcttggattcgccggagggagttcgacggcggcggattgcggcggcggcatccggcggtgagagaagagggaaacggcgacagcgtgacgggagatcaattcgggcgagctagagcatctacgcgactccgggaatccattccttgcgccggattaggagggaaacgcaccgagggaggccggcgacgagaggcgctaccgagctcgggcggcgacggcggcgagcacacagtgggcggcggcaaggcttggggcggcgccagctagctatggggaggctacacaagcttctaccgaaagctaaggggaggagggggaacgaggaggaagaacggggagatgcactaccgtgcgggacggggcgcagtgacgatgggccgacggcacgggagtgatctctccggcctcgggccagggaagcggaggaagacgatgcgcccgaagtccccttcacgcgtccttcgcacgctccggctctcccggtgcttggcgatgaacggcggaggcgagacagaggggcggcaatggcgcggtggtggcgagcgaaacgggaggaggaatcgatgggagggcgccttggttaaataggaggcgatgtcggtcgcggccaaaacggcgacggggcgggggggtgtgacgccggcgggagagaaaagggaaaaaggaggagagaaaggggggctttcctcttgcctctttaggaaaaggaggagggagagagggctacgcggcagagggaggaggagctctgcctccatcccttggaagctagcgcgcggagtggcggggccgactcgtgacgacggcgatgacggcgggggcggtttggaacggagcggcgacacgggcggcaggcgcgggctcaggcgcggtagagggctgacggtggtggcgactggccgatcggccaccacagtgcgcgcgcgcgggaagcaatgggcagcgcggctatttgggcggcgtcggcgggaacggcagcgagagcggagagggagggagaggcgctcggcgcggctcacgcgcacacgcgtgcggcgcacgggcagagcgagggaggggagagagagagacagagagagagatgggccgagagggaatcggcccaccgaacctgagggaggcaaaatagacttttcgagaaggattgagattagggatttgaatttgacgatggattggggatttgagatttggaattggcacggagactgacaacaagcaaagaaacaattttcgcaattagagtttttagaatttaaattttcccgctaggcgccacgacggaacgggcgctacacagggttatggatacaacatacctaatagtagttgactaagctcggcagggtccaccatgtaccaaatcttatacggaatcatacctcgtatatagaaggagttccggataaggaaggacggatagagttatatatgaaaacgacaaggactactcggatcgtatccatattggtctccctagttctacttggacaaggaggcatctatgggtgtaaatataacatacacaacatacacacaagccaacacacgccgccatataacgatgacaaaggtaagcctagacataccccatccggtgcctacggaggccgacaacagggatctagcgccatctctgatctcgatgagttcggactcgaggaggaagactaacctgtcgtcgactacgagttagttatccatgccgccaagtcgacgacagctagataggctatcccaattattgtattggagtgattgtgatgaataagagtgacaccggctttgaccaacaggagtagggctattacctatcagataaggggcccgaacctgtataaaaatcattgtctctatctcttttacctcaatctcacatataccctggtaccaatgatccccatacaatccaaataccctagttgtgatctcaaacaccgacagtggtgcacccggtagggggattttggtgcttcaaggtttcgacgagatgggtttaagagatggattctccaacaacaaactactcgacaacttcaactgtagggatatctgacccaaccgaagtgtcccccccccccgacgagatcggaaccatcatcgtcaacaaattcgatctatcgagatcgcttaagcttcaagacgtcatcgcggggaataatgactcagcaatgtcggttttgagagacttcggtttcctgcatcttgatgacggatccgaacggtgcagggcatcggctggttaagtccaagccaagcacatcaccaatcaaatcgagcaagctagcgtgtccccacggtattctgcatagtcacaacaaacaacattcgagatgaaatgtgcactgatcaagacatgttggctacatctacacaaggtgattagcacggctaatcgaggtaaatagtggattgattttttaaattaatttactgatttcgtagatacatccggcatgtatctataaaggtacgtaatattttatatgcaatttatcgtacctattttccagatctatacaacattgtcggatccaaaatttattatgtttacctagagcatgttttctatacaatatctattgtgcgaatgtttctggtgttaggccgactacggtctaatactgggagctcgctctattttcttatatataaatcatgcttgtttacggtttacataatacctgatatttaatctgatcgttatatcctaataatattagaagattcatgcagttttttttagtacatactcgatattctctactatatatcttgccttctagacaatatttttcaggaacaattgagcacacgagtaggtgtggtcgagtacaccccattatcgagaacgttctcgaaaaaatgtgagttgtcacacccaacatacctatgaagaacaaaaacttatctcatgtatagcaccggttacggctgggctatttgagaaaaggttgttaacagataattcctcgcgaacattgtcggtttgatcacctgacatgattatgaacagacatccggatatgctatgtagacccccaattttggaaatcggaaatcatctatgtttatccgtaccaatccctggatcattagttggtacacacatacatagttgaatcacaacatatcacgaatgaattcaggctaaaatagttaaatacttacattagggccaggtaggccaacaactatcagagaatagcaccggaagacaaaataatataagggcccggttgacatgctacaggtagccgactggggaacgagacctagaacaagaccgcactccgatcatcttcttggatacgcaagcgtaccgacaagggcttctcttcatcactctcctaaaagatatttaaatagaaagggtgagtaccaaccttactcagcaagccaccacagcaacgatgcatatgatagagggtatttcaaggaatggctccaggttcttttgcgcaaagcaagttttgcaaatcttttcacaagcctaaaacctagcatagactgatcaaattttaataccagtgttcacattaaacaacgacggttctgtccaccatccattgtgatcccaaggatagcttcccgccattgagtcgtcatggttttctgaggacgtccaccttccctcctcttaggaagtggctccaacagcataaaaatcatcatgcaatatcccatcccacacaagttaagaatttagagtctagccaagtgtaacacacgtcccggtgctcaataactgcgagcaaggctattcgaatagatttggtttactcacactgcagtggatgtacactttacccgcactccgcgactgcccaacacatgagcctcgtcccaacacatgagacatgtcacggcaaagct

SEQ ID NO: 51379 - DNA, 23578 bp, Oryza sativa
  unsure (1)..(23578): unsure at all n locations
atgcagggatactgcctccgctcagctatctattccgctaggtctatacccatacgagaagtgcggttgtacgggggtcgtttcatgcttaacttcatggctcggtccttaattgaccggggacggtactagccttttccagataccttccaaatcctccgtccgccccaatcgaaaacagttgtttagttttatttctcctttcacaaatcatgtcatcaatatcatggcaatgtggcgctcatgtctccatatgccgcatctcaattaccttcccaaacgtaattgcccaagcataaagcatttgataaatatgagtatgcatgattctataacaacatttctaagcatttgtcataattgactagggacttcatacgtaaacatggttatgaaggaataaggggtaaacaataatcaaggcatggcataatcacaagtaggatgttcatcattgcatgcaattttatttgtaaacaaaataatttcgtaattgggatcaacatgttcaaggaatagtgatgacttgcctgctcagaatagtccttactattgatataattttgatcaaccttcacctcctggaagctgcatacgttgccttacgactaaccgatacacaaattctataatacgcgagaaaaaccaatattcagacaacaaccaaatatgcacaaacagaatgtaattgttgggggtcgaacctagggttgctcatattactcgcacttgctaatggattccaatcatgctaggggctaaagcttcttaatctttctattgtcatcgtggtctatttaggagttaaccaacatagcatttatgggatacatatatatttggctaatcagtggtttagtctatcaaatggctatggaaggattatggctatatatgcatctatctaaataggacggttatatactagaggttctgttgttagatggatttaggatcaatcaaataatgaatcatttgtattattatttaattgatggaggctttactttgattatgaacatattttacttgtcacaataaattataaaaggttaataattatccatgctttgtatgtgagatttgtttaggttaatcatattatggttacggattatctcttaatgaacaatcctaatttacagttgaactataattataattatatgaggtcaagatttataattagtatttatctaacatacatgtttgtcatatactccctctaatttaatatatgcaacatgcaaattaatactataccgtacactataatgggatgtatagtatatgtgtaagcaacaatatcttattattggatcatatatttgagtagttgctttttactgaaagctatgcaatacatgttgattttaagatggctctgtttggttaactaatggatgtcaaccgactatatatatatattctacttcacatgacattgtatcgactaacttttaagtggtccaaatacaactagctctgtgattattctcctaaaaaagttaaagattcatctatgtgcgtttatattttagttacaaaatatgaggctaaactttatgtaaataatttataagtcatggatttagttatatttggacatagactagtaaatggcactaatattttcctatatacccattaatttgaaggattgattataactaatttatgtggttgctacagtgacaaaacatattaaagataattatgccactgtacaatatccatttttatttattggcacactatttaggttaactattatctaatcatttgatattaattaattaataattataaatatattttattaaatagtgaattatataccattggaaagcttatgaatttagatgaatttaggatcaagtttcattcaaatcggagttaaaatgaataagttatgctagtgtaaagattcaaatttgaataattgtgaaacagtactgttcctatttcatttatttttattccataatttacattgactgacccgtgggaccggcctgccatggacacaacatatataagtgaattttcatagattttaatcatagggaccgcacatgtaagggacttaactaataaagatcaaggggaggattactatttactaatcacgtggggcccactctaacctctctcctccattctcttttctctctctcttgtctgttttctcctctctctctcatggctcggctagaaccggcgggtggcgcggcgcgacgacaagcggtggggaagggggaggctcacctgaccggcggcggggtcgatggagacgccgcggcggggtcgacggtggagcacggcgcgacgacgaggcgcagcgcggcggcggggcgcgtcggctcagcggcggcggcggcggcttccaaagaggcagcgacgccggggatggaaaggagaggggaaagggaggggaggtggtgagggtagtgtgggaagcaatgggcagccggggaggggttaatataggcgcggggaggggtggtcggcctgatggcgatgggacggcgtggcgcgcggagagcgaggcgacggtgacgcgcggcgacgcgacaacgcggggcttggagcggcgacgcgacgggcgggaaggtgataggcgagcggcggcagcgacgggcgcgcggcggctcggggcgtgaggccgacgggacaggtgtgctacgacgggacgtcggcggctatggatggcaacagcgcgtggcgcgggagcggcgatggaacgcggcggcgacggcggcacagcggcagcggcagagcgaggcgatggcgacggtgacggcccgcggcggcgcggggcgcgaggacggctaggcgcggtgtggcagaggaggggaaagggctaggagaccacatcgaatacctaggccataatgaacattgactttttcctatttattcacttttggggcctttttcctattaaaacttgtcccataaattctagatttcacacaaatggagtttacccaatatatgttttaatttagatgaaagtttaccaaattttaatattacccatattttattcttatatatatatttctattgcattatttaaataaggtctaattctaaaattaacctagataattttggaggctttgagggttcccaaattaattaaaatatcctaatgtggccattattattacaatagcacattgaatgaacttatttgtataacaatgcattttacgtgtgtctatttattctataaatataaattgagactcagaacaacattaatctaattgtttaattaaacactcacatattcttatttatatataaagcttaatttatttatatgactattattttatatgagtgattttcatgtcatgaggaactcggcgaaatgttctaagtataaatctatatatcctcgtgaattacttatttataaacacgatcattatagtggtaatcatcatttcatgtgttcttatatttcatgtgagattggattcaaatgaattagatttgattttactatttcttttagctaatcatggcatcaagccatcagcatggttcgaatatttaatatttgatctgtgatttataatagaaattaatatttgacttatactttatttggcttgctttcttgtacactaatatttgtagggttaataataaataacatattctcgtaaattatatctattgcttaaatttagatttttctttactttctttgtgatcatttatggtttggcaagcaatagcaatcataacaaccagcatgatgtaaaagttttaaaaagttcgaaattttagtgatttttattgttgggaattttcaggatgttacatgctataagttgggtatgtgagtcatgctggccacatgagatgcacatgtaataactactagcgcccctataggtgattaagagatgcctactcctggttatcgaccagacagttgtagcgacatctcatcgcctatcaatttaaattcacttgtggaccattaaactgcatatatcattgttgaagacttcatgtctatttggtcttacaccgggatcgaccaagtgagtatggcaaatattgataaggggagtcgcgcataacaagagatgcttttacgaatacggtttgtttatgtatgcctatcagttgcctataggtgatcgagatatgcctacacctggtcctcgaccagtagatcgtagcgatctctcaccacctaaaattcatcttcaggtgatcgagaaacgcctacacttggtcctcgaccagtagatcgtagcgatctctcaccacctaaaaattcgtctttaggtgatcgagatacacctacacctggtcctcgaccagtagatcgtagagatcttttactatctaaaaattcatcttcaggtgatcgagatacgtctacacctgatcctcgaccagtagatcgtagcgatctctcaccacctaaattttcatcttcaagtgatcgagatatgcctacacctggtcctcaaccagtcggttacaacaatctctcgacatctaacgtgacaatcaacattgtcgtgatagcaacaatcaagaccgactagatcggcgttgtcaccaggacgacaacgtccaggactaacgacatcaggacgacaacggacaaggttaacaacatcacgacatcacacgatgatgacgaaactcgaggtccccagagttctagagggcccgaggatgaggtagtaggtccaagagccaaaactccgactacgataattcctcattgtcttcgtcgtcatcaggaggcagttctcgcaggtcacgagaatgtcgtccatctattactatggattcccttcaaatggtcgaggtacgactacggcatgtcttctaccagcaacataacgatccttgcaccacgacttttaatggtcgaggtacgactacgattggtcttctaccagcaacgtagcgatcctcgcaccacgacttctaatggtcaaggtatgactacgactgggtagcgatcctcacaccacgacttctaatggtcaaggtatgactacgactggtcttccaccagcaacgtagcggtcctcgtaccacaactcccaatggtcgagatatgactacgactggtcttcgaccagcaacgtagtgatcctcgcaccacgacttctaatggttggagtacaactacgactagtcttccaccaagcaatatagtgatcctcgtaccacgacttccaatggtcgagttacgactacgactggtccttgaccagcaacgtagcggttctcgcacctcaatttctagtggccgagttatgactacaactggtcttcaatcagcgatatagcgattctcccactacctctgtgatttgttgagtacaactgtacacctggtctttgcccagtgtggtggttgtctcatcatcaacgtcaattctgtaagtatttatgtgtgcaatatttatctgttgatctccttttcttatatcgccttgtcttgaaggcgttcctatcgtttctttacgctattctgataagcttctgagaaacctaaaggaatttcggcctggggacacccagagcagataaggctttgtgaaatgctgagagccaaatgaccatgtcaaacctggtcatgtaagagtgctcaatggatgcgtattaaccaagccgtgtaatcggaaattaactttttcaacttcacagctagggactaggatttgtcaacttcagcatggtttgttataagatttaagctacctttgtggaaaatagtttttccataaaaacagttgggggctaggaagagtaccaaactccattcgctgagggcaaccctagcgagcatactcttttattgtcacacgcagatgcaatttatttttaattttccatacatattataacatgttaccctttgagggttcgctcgggggctatttctatttaatattctattctgagtattgatttcagaaaagttccattcaacgttgtcgaggactccatgtctatacggtcttagaccgggatcgactaagcaagtacaacaaatgttgacaagagaagtcgcggatgacaacatgagttcatttaagttgatggctttgtcacaaactctacaccctctcaattacccgagaacggttgttggatttcgacaaggaatatggaatgaagcgatggtatacccaccgagatggaatttcttgacttccatccaaattcccgattacagcaagacgggagacttagtcgcatgctccgtaccttctcggtcgatattgggacctagacaaacccaatatagtgcctgtggaggctgataaggggaatctagcgctatctctgatctcaccaagaacggtcaagtgagcacgacaaccgctattccaaagtcttcggtcgagaacataaactcgttcatttgcattgaagtcgggggcaactgttagggttttggataccacatacctagggagaggaggaggctgggaatggagttgtgtaacatccggcctctcctaggcaaccgagaagaatttcctggtcggtcacctatcccaaattgctccaggacaaacacgcttaaccctggagttctttggagattggcttccggaaaagaagttgcaacttgtagatatgagtattctattaatcctattaagccctaggtcaggatgtcacaatcctcacctcttaagacaccgatgtcctcattggtcaaccccaggccaggaacatcccctcatagccacatccgtgcatccatgtgtgaccactctgggtcccctcatagccctaggccgggatgtcacaagttggccgggagaggagaggagtgggggagatgagtgggagtgagagagagaggagcggagaattaataaaaaatgttgaaagagtgagaacaggaggatttttgtacgttgggcacttacacccgcacgcaaaaatatgcttattaccgcatgcagatctgttccgggggtcgcctgcaaaaatataaatttgtaggcggtcctctgaaggatcatgttaacggaaaattttggtaagtttattaatagatttagtcaaggaaagagatcaatccaccgaaggtagtttatctagaaaatatcaagttcaataaggaatcatgaagaccacgacttgttagtttaattctatctattaattaggcaggatttactaattttccttttacctttagcaagtatctgtctactgtccgatcaagacctgaatcttccttttttatctttaggaaacatgtaccatgttcgataaggacaagtaacatcccaagggtataaatatatacactcggggtgtttgtaatctatctctcgattaatacaactactctcggcgcatcgccaccttgttttttgagaattttatgaccggcggaacttggcactttgacgcggggctacatcggcttcgatctctggcgaatgggtaaaccataagttctgacggccctggcaatttaacagctacattgatgttgttcaaggctgctttgctttgatctcttgtatattgctatagttcgattggtatattttgcctacctgatcaattctctctttaatttcattgtgtttagagacgcaacggtttagttgggactgcctcggttaggtctgatcttctgtcttagccgatatatctctacaatcacaatgttgttttaaatatatttattgtatccatcacattagacagaattatcggatcattgagtattagattattttatacaatctcgtgctgcatcggttagattcgacctactatattattattattgataaatcaagtcttgttaagtcgatatataggttcatgctaatgtttcatcggagggttatacgaggtgctaaattcctctttgatggttttactgttttgttaaatttaatgcttgaccactctgaacggtgtcatatcagcttgcttaaatccattaggtaattatcaaccttatgctgcatcgattgagttcgacctatagggttgtggttgtaaattagatttattcaagtcagtaggcatcaatcattgtttcatgcatcgaggttttagccgatgatttatcttaatgttgcatcgacttataaggattatatacaagttggttttagttgattacaacaaaggtttcatttattacttgataatttggatttaatgacattggattcccagacgatatatactttaaccatcagatcaacatttattttatcataccgctattggatgattggtttctattagattatattgttgtattattacaagttctcactgcttgtccgattgcctttatatcattatttatccaagtgtcaaaatctatatcggacatttaaaaccctatcgacatcagttaatatccctaaatcggcttgttggctgattgactctatcatcgtcaatttatctatcttatcagttgcaggatcaaactagctagctaggacaccaacatctcatcaaaatttaggaattgcactggaactaagcagatctcctaggccattgtgtttgccgacatatttcgcgtcaacaaagatttagcaccataagccgcacatggatttttcgtcaacataaccgtatgcgaaaataggaatcgattttagcaaatgcagacacttattttccgttagcaacctactgtggtgctcgttcaggaaaatcatttttcactagtgtacaagactttttgactttttttttctagtctatttcttaagtgcggttaaatttataaaaattatgacagtgaaaataattaggtgttataagagtttcttcatttatgtataaacttagttaaattttgaaaagtttgagaaagaaaaaatcaaatggtcttatttttaatatgagacggagagaatagttaataatatactactatcttcatattttaatgtatgacgccgttgacttttttccaacgtttgaccattagtcttatttaaaaaatttaagcaattatcatttattttattgtgacttgattcgtcatcaaatgttctttaagcatgacataaatatttttatatttgcacaaaaattttgaataaaacgtcgaaaaatcaacagagtcatacttgttacttgataggctacgcaaagttggtaggcatatggcacagtggcctagctagattgtaggcctgtaggtcttgaccgcatatacggcctgcacaacttcacagactaggccagtaatggcggcgagcagcgcgatcgccaccagcgggttgctcaaatgccgccgccgcagcagcgccatccagttgaccggccggctgctgtaccaccgctccatcctctcccacgtcggctgcaggtagttccggcgcgcgtcgtcgacgtcgagcgccacgcccctgcacaggccggcgaacccgtcggcgacgtcctcgtcggtggccatgaagtgcacgaccacgcctttcctcgccaggagcgcgacgtcgctcgccgtgccggctagctgcgacacgaagaggcagtaggccgtgacgtggctgcccaggtgtgggttgttctgctccagcgccatcaggttgcgcaggacccgccacgtgttgttgtccaccgtcagcgtcgggacgtgcagcgtcgtcagccgccggagctccacgtcgaggacgcaccgcgcgtcgccggcggcggcgccgagggcccgtttcttgaacctcacgccggcggcgtggtactgcgtcgccccgcgccaccggtaaacggtggcgcgcgcgcgcctgttggggacagcggcagcgtcgtcggtgtcgtcggccggcgacatcgccatgggtgtgaagtgcatgtggagtaagtggacgaggtgacaggggcgtgtgctggtgatgtccacctccacattcgagtagccctggtcctggagcagcgaccggagatggcgcaagaatccatccacaacaacggtggaggaggacgacgggccgccgccggcgatggctgtagctcccggaggctgaggaggcggaggagaagtacacgtttgcgtgcgttgatcttgatcctggccggaatttccgacacgcaccagctcgtagaccttctcgaggatgaagaagggtatctggttctcgagcaggtagaacacgtcgcgcacggcgaagatgtagtccaccgcgctcccgccgcggctacccaccgccgcagccgcctcgccgccgacgttgaagatgtcgaggacgaaccacgcgtcgagcaacagcatctgcacgaacatctgattctccctccatgtcttggcgccgtcttcgtagtagctcctcgcttcgtcctcaacgccggcgattgcctccaggcaccgcctcagcgtggacgcccgctgctcgccgtcgtcggggaggacacggcggagtgccgtccacttcgccagctggtccgtgctgtccagcggtttgtggtggtaggcgccgacgagcaccacctgcggggtgtactgcgagtcgtcgacgcggcggacctgcggcttcaccttggaaatgaggcactccggcgagcggcgccatcgccggccgccgtccaaatccacattgcatagctttgtctcgagatcggcggcgagacgttggatgtctatactgcagctccctgaaaattttcttggttaattaattgcatgtatcatgcatagggtgaaacattcagaatttgttattcaaatgacaactgatatattagtgtggcagcacatgaaatcattcggccgtttcaccaattcaagattgttattttttttatgaaagtaagttaaatacgaagaaaaacctgcatatatagatgcagtaagtaaaactcataaaattgcataccacatgtacgcagaatttgttttggccatctagcacagaaattcattaatttgaatgtgatggaggtgagaaaatttaaggtaatccataaataaacgagtgctagagacagtaatatatatgtgccaaactaaacgaaaaaggacaaatcaatatagaatatttgtgcatacctgttggctcccccatacgtaccgttaatcagtcatgtttccttcgagtagcatatgtgtttcattgtctggaattaatgcagcaaacttaacacattacacgtatatttatatctatggtttcagaaccgtgcattgcatatctccagaccctttctcggcaacagtttgtttccactagatgagcacccatctgcagtgtgcacctttcaaaacatggaagcaaaggtaaagtgcaagcagataactttaaagcgaaatatataattggagagctttatatggctttgagtaggggtcgtacgtactgccttatatatcttttgcaagaaaatcctttagtttgtaccttggctgaatttttcgtccaacagatctacagcggtatagattgactaacacaccaaaatatatggagctaaccctaattgtgcttacctccaagcatggatttcaatttcgatttcgacgaaaatttcagccatttcggcaaaaccgaaatttccaaaatactcagcaagatatatacaaccatggttaaattataagatagtaagatacagtatgcattttttgacaaatcttaagcatatataaaatatatacttcataatgcaaacaaacaaccgattcaactcttagtataacatattaagtataagcaaataaaaaaaataatttggacgtttatcttcggcatgatgttctttttatagactttgcgtgatattatgttctgtcatgcaccatgggccggaatggcactatactatatatttactttgtttaaatcttgtcttagtagtgcatatcctttaggcttctctttttagcatagaacctttatgtccacttctatctaaccgatttcagaaaagaaaaggaagcacgtcgatccttgttgtaagaaaattaagttgtacgatgaaccaggaatagaggctggaaaaaggaacaatatataccaagtaggtagctggttaatttatacttcctccttttagggtctggttggatcaggtacaaaattttagtccctgtcacgtcgaatgtttgacactaattagaagtatcaaacgtagactaatgtgataaaacccattctaaagccctgaactaattcgcaagacaaatctattaattctaattaatccataattagattatatgatgttacaataaacatgtgctaattatgtattaattaggcttaaaaaatttgtctcgcaaattaactctcatttatgtaattagttttattattagtctacgtttaatacttatagttagtgtccaaacatccgatgtgacagtaactaaaatttagtcccgagatccaaacaccaccttattcatatatgacgcttcatataagtagaaagatgcaccatataattaagtagaaagatagactattatacaccattattaaaaatatgagaacgtgtaataatttggttatcacttactacggaactttttttttttgcaggcagggtgccctgcttacaactataaagacgcatttccacaggctccgacctaatacaacaaaataaatctaaattcaaaacgttatgtgttggtatatatgaataacatgaagaaataagctagattaaaaaaatggcctaaatctccctcctctctccaaaaatatatgtagaaattgacctacatgttaaactacccctatataggagtaaagacctcaagtcaaggtgaaacaccccccccccaccccgccccgcccctctattttcctttttatctgcgccgaaaggtcggtctgaaatggctagctcgaggaaggatatacagggcatgtacaatgatgtctaataacgggctctgtttgtttcgttgtcatgcaagtaaatttggtgaagtggaagaaagagaatgaaggaaggagaaacatcgttactatgtatgacaacggctcagagtcgactcttagtatttattaacggaaagtttgttgtacgagggtggagaaaaaaggaaagaagtataataaaaaatatttatgcattaatggtttagaaattttattgtctctactattttaggaggatagtttccagtaacattaattaatatagagagtttatattagactctatctttgtacatgctcttatatataggtggagatttctatagataaaaagctgcctttgagaatatttttctaggtggttgacttaaagctccaactataaaaatatatacataatttccacatacggctggtattactgttccccaggaaaaatgtgtgcatttccgcagatgcacatgagtaagtccaggtgcttgcggaaatgggcctacacagcggcccttggtggccaacgacaaagtctttgttagagtttgtcagatttgatttccacttaacgattcataaacttttttagaaacataatataatcatatagacgctcacaacacgtgcacactgaactctcaaaacacacacgtaaacccaacctctatgattacctccaaaaaactggaccggtatatattgagatgacgaagtcaccactgataccatgctattgacggatacattgcttagcactaaaggaataactagctataaataggagcacacgacttgaatccatgtgggttgctggtttcaccacaaaaaatcctaccagttgagttatgtttactttgccaacgattcccaaatttgttaatcagattgtgataaaatatccaaattcgacttcagatatcgttgaatgagtattcaaatgtcaaatcagatgttcgaagttcccctcaaaccttatcccagaatgctgtgaaaacatgcatgcatatacgtacacttctgttctttctgtgtctcactctcacgttttgggccagcccgcaccaaccctgcaagagccacaggccactgcctgctcgattctcccctcattttcctgggccggcctgggtgctgcctccgctcgaagtaggcctctcgggctggccaccctcaaccatgccgtgcgcgtacggttacaagaaaagagaagagtctccatgtggactccatcaaatatgattcgaatctaagggccagtttggggagcttcagctgctgcagcttctctcaaaaccagaagctctcacaaacagtatagcttttaatccagattctcagaagctatagttctagaatccagaaaaagaactagaagccagaagctggaaaacctagcttttctagattctcataagctggctacaaccagctgcctctcagaatcttaagttcccccaaacaggccctaatataattttcatctctcaaaaccggctcattttatctctctaagtggtttggatggtgatacttgtcgttctacgtgatgcctatttgctacgttgactttattttcatcttacattgggagcacgtggcatctacgtagtattacagtcgatagaaaggtaagagaaattgaaaataagtgagccccacatgcaaatctctcggcggaaaaaataaggtacgacacatgtgtcatgtcctttctctcatcccctcttaactccctctctccccttcttcaggcgataggctgacagccacatggagtccgagctttctaaggtttaggcccatgtggagtcaatgtcggtgctctagcaacctggttgtatgtagccacatggacgggctgcatagatggggcaattgcaagcccacacacagatgagcttgcacgtttgcggcaactaactaagatattgaacaacttcagaaaacatttgggtttttgtaccattcgcatagtataataggtttagttatttgttttgatcatagatctaactactttttcagaattgctaaaaaacttccgtaagttttttttccctaaaacatttagatttgtagtcattagattgcctcaagatctgtgcatgaagggaaaaattgttacaaagaaaatttcacacatatcacgtgtaagatcccgatgctaaccaaccaaaccatagttaaatataagttttatataagttatatcatagttacagtgtagttatattgtagttacagtatagtaacattgtagttacaatgtaattatatttcaattatagtatacttatatatgaaagtttttcactcaaaaattgcggcagttttttagatactatcatatttgtatgcaatatgaagattacacgagtgatcaaaacggaacattcaggtacatatatgtccatacatattcatatcatttatttgaaatttattatttctaaatatcacaaatatatgtccacatcatgatcttatattcagtaagaatttatttcttctaaaaaaaatccaacgacatttttttacacaagctttcaccgtatattgatccatttaccccagcaaagtcagcaacaggtaggttaggaaaggaggttgaataagaaatttgaggttggaaccaactgcaattaacaatctaacacatctactactactattaccacaataaaacatgtttcactgtcagttcataggttcactgtgaaccggcagtgttagaacaacactgccggttccgatcggtgagcagtgaatggtcctatcgacttcttgggcagatcacacggcagcctcacaacgtcgccggctcaacaggagcggagaaatttgattgaaattggaagtttgattgaaattgaaatgatgtgttggaaaagttggaagtttgtggataggaaaattttaatatgatagaaaaattgaaagtttgaagaaaaagtttggaagtaaactcggcctaagataatttaggcgtaagaaagatgaagaagaagattgctgtggccaatagcccagctggccaacagacagtagttaattgtagcatgcatggatatatatatatggattgcgactttaccttcggtactactattaaagttagacaatctgtatcaagtcgatcatacatatagatagatatgcatcacgcggactagctaattaatatctacgtcacatcgataataatcatatcgtttcgatttttcctatatctacctgattctggttttggatgcatgtaagcacaggagtcaatgatcgcgagtataacgacgacgtacgacgacgacctgtagtgattttggctctaagcactggactaataagctacaagccgaagacttaacaacggagagatactcacaaaatgacgcaccttgctatcgacgggtatgtcgtctaccactaaaagcacaacgccgttaaatcttagaaaattcgctcccacggggagtcgaacccaggacctcaggtgctactgagactcttgtaattactaggctacaggccctttcgcaacaacggagtgacttatgacgtacttcctcaggtcgttgcaatattcaggatgttttaataacttttggaatatatttaaatagtttgaagacactaaacaacgatgtatatatagagtatgagtgctaaagggtattgttcagtaaacatcattactggtttttgacgtgaaacaacaggagagtcttctactctgctatatatatttaatatataaatgtataactaatgttcagtaaacatcgtaacatcattactgatcgagcatctttatcacaaagaatcatcagtgatcgagcatcttcatcacaaaacaaaacactgaatcaatcacaaatccaacaacaacatctaaaatcttcatcaccaggcaatcacaaattgttcatcaaacaacgcacaaacttaactacaaatcaaaaaaataaaatgaaacacataaccagacccgcctcaccggggaggggatatcgagcggctgtagttgatctcattgtccttgtgtaaccatggtcatagtcagtcatgccatgcctatcaacctgtggccgtagttgatctccctcaagtagcatacagcatcaccatcatcgcagggctccgactcccttcgtttatgttatagatttggcataccctgtatgcccgtattcattatcatcaggagtaccgcatacctattcttagaaaaaagtatctccaaatatggacaaatgatatataggaggtaaatgttatccacgtaagaaaggactttgtagtctgacttatattagttatgataaggctttgtctttctatatcctattgaggatctcaaagttctacttaggtaagggattatatttacaaatatatggtctagtaggagtggagatcattaaatcataagccttacaccaccatcaatttcacaccaggaggaaacccttttgcttgtcaccggctacaacttgccattttgctcttcgagattagtttagttgctatcttgtttgttctccctttgtactagggatgctacacgcacatcggggccctaaacctttataaaaatccttgtccactactcaatttatttcatactcatgtataccttggtatcaatcgtatgctgtatctctaaatatcatggttgggtcatataacccgtcgaattcatccacctaaaagatctagtggtcggatgggggtttgacagtggggtggagaggacaagtaaacagtggcagaggctctcctctcccttcagttctgagcgcgccaaccaccattgccggacggcaaacgaggcatactggcgagtggcgactacagagatggtggcaaggaggagcacgtaggtggtctgggaagagggaggcagcaataaaaatagttaggaagagtgagacgacgaagaggagaagtagcgatactggcggcagtggcagtggagagagaggcagggacaacgatagggatagtggcagggcgtgatgaggagatgcgaggcttaaaaggtattttcctttgttggctggacttgtaatctcagcaattttcttgttggtgccggttcaattaaaaaacatacattgatttcctatacataagtgccatttttttattgaactgacattcattaagaatgcgtgcaatctaagggggtttggaaccactataaatgttagtttttggataaccgatactaatgaggcggtctggatgtggtgttctatggtagtgatcgatttttataatatatccacttaattattgtggtatacttcttccgtctctaaaagacttctttttcatacagaagcatttgtcccacaaaaccttattgttaggcgtgcacgtggttccactaccctctttattatccttgttttctctcccttagttatagatcagtccaccatcgcgcacgttcaaccttcagctgcaaacgccgttaattagagcttgtgtgtgccaaaagtctagcctagcagaatcctgcaatggtaatgaagggtgaatttctttttacacccataatactaatttggtagtttggctaaaaataaggtattttagacatggagcatataagagaattgattagggatcagaatgatacaaatatatatactgcctctatttctaaatataagcatttttagattgttttgcaatatcagtaaattgcacatatctccagaaaaagtgcatcgtgtttcgctttacaccagatttagtatatactttcactttccacaaagtttttcttttgcggggacattttgcacaaagttgtattaaaataagtttcatttaaaatcaggatgaaatctataaaaatatcatgaaatttctttgaatatgaaaaagaaaacgttgtgaatcataatctaaattcaagttgttccataagttttactcatattttacaatattgttatccaattatatgacccaacctagctagtggaaagtgaaacttattttgatttagccaggtgtaaaatgaaactatttgttaaacctggtgcaaagtgaaacaatgtatactctacatagtgtgaagtacaatttactcaaaattaatattatgaagaaaagattccctttcactcatctcattggtcaaattttgaattatttcaatttcccacaaacacctaattgactgaaaatatttagatttccagtgtgtattaatggaaccagggttcgacaaatgcttatatcatgtactgaatcctacagatgcatgtatatatttgaaaacttgtagaattgttaatcgttacttgtgaatatcttggcaagtgtgagaacaaagtacgtacttagcttgattggtcttcttgattgattgatcagttcaacgtggttttgccgatgatttttaaaattatacaaataagatattcttttcattaacatgtgcccagttataaataagagaagtaaaaagtatgtcaattaaaaacatatgattacatgggatgataaaatcatgaagatcaccacttgaaactgggttatatcgttttttagtgtattaaaacggtatttagtttttgagggggggggggggtaaatatttcatttcaaagtttaccactgatatatcttcactcgttcggtgatgaagatatggggcactggactttgcaatatacgcattaaaattagtttatgcaaacgacgaaaatgtgttgcatttgtttaacagtacgctgaggtaattaaacatactaatttgttcatgaatttggaacaatatcaaaaaggacaatggcaaatgtgtgatcaaacccatgctaaacggttggcatatacgaatattaatttagtaacatgtttttttaggaacataattaagctcaattggcattaagatagagtgtaacattagcattttccaggtatttgtagctcatcttttttctgtctgttatgggcatttagcagtatttattatatgatgaaaccatgacttccgagttgaagttcgatcgtacaacacaaggatttgagcaacagtacagagaaaagtagcgaaaaattatgaattctgtatcaagattataattgaagtgaatccctgtattgtcgtctggtgtgtgctgattttggagatgaacactagctagctagcacgtagtttgttgtactacaagggaagaaatattgtaattaaccttaaactgaattttattaacaaatatcatattaatttattggtacctcatcgtgctttcttggaatatttaggtgtagaccattgattgcgtaaaactcagggggattagtcatcattatttccacaaagaggacgaattcatatacaagaaaaaaactaatctttttcgaacagatatatactagtggttgctgcatgacaaattagaacgacttgtttcgaactaggtcagcatctctcaatcaattagactgttcttgtgattttgatcgggcttaatttgttttataaaattgtgaacttcatcacataaagcttaggtagaactggaattgcataatcgatctcgctagataggcttgctaagtgctaactgctcgatcgatcgatctctagctacaaactacaggaagctataggtcaactatggctgaaacccaaaacgaaggcatgggaaatttgccccagcagccggccggtgagatctacacgatcttcacggtcgatcccaatgacaggaaatactacgttgccgccgtcgacagcagcgacgaagtcatcgttaaggagaatacagaaggctcccgcgtcttcgatgatctccaggtaaggttttaaatctctagctatagctaccgctatctcgaggcaatgttttaaattttaggtaagaccgtgtgttaaatgtcttagccgactatttaaattttaaaacactaactccagccatgctcgatatatataattaacacacacgcatcatcatcatatcattcatcagcagcagcagtataaactttttaataacttctagttaattgtaatacatgtttgttacatatatatatatatatatatatatatatatatatatattgccttgtggatgcagctgtggtacatggtgacggccgacgagccgcagcagcaacacaagcagcagacgtccgccgccgccgccaccgccgccaccgcatggtcagcagcagcagcagcagaagccgttcatcctaagaaacaagaaacggaactgcgccctcgtagtcgccagtaaacctgcagcagaagcagcaggaggagacaagcaggggacgactaagcctgagcagatcgtccccggcgccggcagcagcagcagccggacgcatcagccgcagactggagaacggcggcggtcgacgccggagacaggcacagtaaatctgcaggcaagcggccagctcgccgcgaagaagggccactgcaggtagtgctcgggaagcacggtgcagaaggagaacgctggacaacggatgggacgccggccacggccgacgccgacgatgaccggcgactgatcagcaggagatgctacatccagagggcgagcaacgccaatctcgtcttcaaagccgttaacaccggcggcagagacggctccataatcgagctgacagataagcccatggtgatcatggggagtgatcaagatcagttgttctgctgctggacgattgtcccggttgccggggaccacatcatcgcaggtacgagcccctgctgatttcttcactgatccaattaattataagggttatttagatacgtgcaattaaaaggttgcaggttaatttggaaaaatatcattaaaaggaaataattgatgtctatgcaagcccctaaagcagaaatttcatatccccgataagcaatatctcccccaaaatatttggaattttctataaatttggtttaatatattcaaattttagtaaaaaaggttaaaattttaaatatttcgtgcaaaaaggacaaaaaaaattctgaaattcacgaaatttcggtggtttccgaaaatgtgaactctgtcggccctaaagtaaatctcatccattaacatataagaaatcttcctagctagcgctgttaatatgcttcagtatgtgcagatggaggtttgtcgttgagatccttaagaatggatcatccaagacttgtggcacaatcaggcctgctttccaatcaacatgacacaagatgtattacgccaggtaagaaacggtgttgacggcgattaatttcaaactctagctagtaactacctaattcatatactagtttatactatcgtattaattcatgccaattggtgcgaagcattcgtttttatttagttttcaatcaacggtatatatgattgagttctccctccgtccaaaattgaattatgcttctgcttttgtctacaaattaattaacgtacagactttagcgtactactgccccgtccctaaatatttgacaccgttgatttttttaaaacatatttgaccgttcgtcttattcaaaaacttttatgaatattattcaaaaaatcgagtagtggtaatatatttaacaatgaatcaaatgatacgaaaataattaataattacttaaatttttttaataagacaaatgttcaaatatattttaaaaagtaaacggatggagggagtaattcccaaaccgtctatctaaccactacacttacttcgctcagtagtcgtagttacaacgtcagtcctgatatttgcagtcaacagtaactccactcaacatcaaaataatttcacaatagccaagaagcccttataaccatggacggagggagagcacgattaaaagcatatatatatatatatatattctttcaattgaatatgcatgaaatgagtcaatatatcgtatgtcagaaaacaactaattacgtgatgcatgatggcctaggtagcttgcttgacttgctcattttttctttgttgtttttctcctcatgcagacaagagcgcgtcactcagcactcagcctcgcctcgaagctacagggtactacgtacaaatgagtttgcatttgcgatgttttagtacttatatgaacacaattgatcgagtgcatgcataaaattaatttatccttatatagtgtgttgtagccgtcttatatgtcgtgcagtggttaacctctgaatttgtgcttaattggacatatgcagtgaaacactgaaagatggtaataagcaaggtgataataagaaaggaaagaagaagtgagtcgtcgacgacgacctctgcatatatacagacaaactccaatagtggaatggctggcaaacatcggtatctacgcttacgtataatagttgggtcaaggatcaaccgatcgagacctaacaacaaatgaatatgtactgttgcttaattgcagttataattaagtattgtaataatttgtcgtcgagctgtatagtatgtaagaacaaattagataatgtattgaattctccaagagaaatatagggatatatatagggcttcttgccctagttaattaattaataacgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51380 - DNA, 16253 bp, Oryza sativa
  unsure (1)..(16253): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaattgtgatacgtgcaccactggatgaataaggctggaggagggtaacgccaagcgataggccacttcccccacccgctccaaaacctgaaagggaccataaaaacggaaatagagtttgcgatttactcgagttaccactgactgttgttcgaagggctgcagcttcatatacacccaatcgcccacaacaaaaactcgttcggaacgacgattgtcagcctgaaatttcatccgagtctgtgcacgcaggagatgatcccgaatcagagtttgcattttctcccgctcatgaagccaatcagcaagctcagtagactgacaagctgcagtaactgtcaacccaaaatatcaaggtttgtggccatagagaacctcaaaaggagtagtgcccaaagcagagtgaaaggatgtattgtaccagtattctgccaaagcgagccatttactccaatgagaaggacatgtgtgcacaaaacaacgaagaaaagtttccaagcactagttcacacgttcagtttgcccgtcagtttgcggatgataagaggaactcatccttaattgggtgccagccaatttaaagagggaagtccataatgtgctagtaaaaatccgatccctgtctgaaatgagagactgaggaagaccatgtaacttatgaatgtactgcatataagcctctgcaacatcaagggcagtaaaggggtgagccaacggtacaaaatgactatatttggagaatttgtccaccaccactaatatgcagttgaaagaatctgagcgaggtaacccttcaatgaagtcaagagataccatttgccaagcatgttcgggaactggaagtggctgtaacatgccgggatatctgacatgttcagacttagcatgctgacaaatatcacacgagttgacaaattgagttactgtggagcgaagtcgaggccaagcaaacaattgtttaactctttgataagtaacatgaatgcctgaatgcccacccactgcagcagtatgaaggtttgctaaaattttctgttgcacagctgtattggtaccaatccacatacaatccttgaaatataacacaccatttttcagagaaaaattgggtacagcaccaacactgatgcatagggtctgaaccttgctacaagcatcaggatcaagcgagtaaccagacaccacctcctgaatccaatcaggcaaagcaacagacaaggcagacaattctaaagtggcagaagaaggatacctagacagagcatctgctgcaccattatcagtgcccttcttataaatgattttgtactgcaatcccagtagtttagtgagagccttgtgttgccagggagtggtcagacgctgatcatccagaaaagatagacttcgatggttagtccgaatgaaaaattcagcatgttggagataagggcgccaatgttcaacagccagcataatggccaagctctccttttcatatgttgacaagccctgatggcgaggcccaagagacttactgagaaaagcaactggatgcttttgttgcataagaacagcaccaatgcctttatcggaagcatccgtctcgacaataaatggttcagaaaaatttggcatggccaagacgggagcagtaatcaaagcttgttttaatgcttgaaaggctgcctctgtttcagatgtccaaatgcacaactgacccttttgcagcagattagtaagtggtttacttaagatgccatagtgacgaacaaatgtgcaataataccctgttaattccaagaaaagcaacaaatttgccaattctggaccactcaaatcttgtcgtcatcagtcgacacaccattgggagtgatgatatgccccaagtaggaaagccgttgttcagcaaaagaacacttactctgttttaccttgagctgatgcttgaccagaatttggagcacttgtcgcaggtggttcacatgatcttccaaagttgcactgtaaatgagtatgtcatcgacaagtaccagcacacatctgcgaagtaaaggagataagatgctgttcatcacaccctgaaaggtggcaggtgcattggtcaagccgaaaggtatcacacgaaactcatagtggctactatgtgttttgaaggctgttttatgctcatccgacatcttcatacgaatctgatggtagcccgccctgagatcaagtttagtgaaccactgtgcccccgacaactcatccaacagctcatctataattggcaatgggtgcttattcttcgcagtgatatcatttagatggcggtagtccacacaaaaccgccatgtcccatattttttcttaaccaatagcacaggagaagaaaatgggctggaactaggttgaattatacccttgtccaacatttcctgaacttgctgttcaatctcgttcttttgagccggtgtataccgataagggcgcacattaacaggcactgcaccagggacaagagggattgtatgatcaaaagatcgagctggaggtaaacccattggttcatcaaagacagaaacaaattcttgaagaacgtgttgaatcttgacaggaatttgttctgaagatcctctgtcctccaaagaacataactgaacaaaatgagcaactgctctcttgtcactgaactcttttagttgttgagtggatatcatttgacactgttgcaattctggcacaattccttgaagagtgacagattttccctgccagcagataaccaaggacttttgtacccaatccactgacattgggctgcactgcattaaccaatccattccaagaattgcatcataattagttaaggccataatcttaaaggtggtgtaaaacacatgcccttgagtcgtccaaacacaatcaggtaactcagctgtacaagacaaaacagctccattggccacctttacctgtgctatagtaggaattaactgcactcctgacagctgatctgctaccttggaactgagaaaactagctgtgctgcctaaatccaccagtatcagcacctccttaccttggatataacccaaaatcctcattgaacccacatgttctgccccttgtattgcgtgaactggtacaaccattactacttgttcttcagacgtaatcaattcagcagattcagaaaaagaactctctccaattgcatccaaaacagagaataattcctgaactgcgtgtaactggacagagttagcacatctatgagttgtagaccatttttcagcacaaatgtaacataacccctgagctcgcctttgtgcctttagagcaatcatcttgtcagaaccccaaattggttgaccaccatcaattccctttttttgtcatcaacctttccaactgcagatagaactcctttgcctggtggtagaggtagtggcaaagccccttttaatgctgaattagagcgaatgtgcattcctcctttagagtccttcactccagactccggtggagcttccagcacttcctcttgcaaagacgcaatagccagagtagattccaaatcgcggggatgttgtaacaatactgcatttctaatctctcggcgcaatccttcagtaaagcgatgcaccagatactttttgctaatgacaggatcataggccagcaattggttcatcaactcgtcaaatttctcatagtattcccaaactgttcccgactgtcgaattgtatccatttgtataattaacatgtcatgctgatccctatcaaacttagtggaaactgctatgcaaaaatcatcccaaacaggaaaccgcacatgagccctagacgaacgcaaccaggatgctgctctaccatagaaatagatggtggctacatgaacccacaaccctggaaaagtattgttcacatcaaaatagtgctcacacctcatcctccaatcctgggggtccgtgccatagaatttagggaaatctagtttaggaactctatgattatactgtctaccgccttgttcaaaaccaaactccccaacctccgaatcagatttgaaattctccaacgagtgcaaaggaactgaatgagattcaaacgtagccttgtctagagttgggatcagagtggtcaccactccagatgccctcctccggaaattctgttgagcgccgtggccatgggcccaattgcttccgccttccgccgcgacttgatgcgaagatgtcggcggcgtaggcagcaacggcgccttcctttcctcatccgtcaacggaacccgaggggaaagcgtcgtcggcgaagcttgcatcgatttgccaaggaaatccagttgctgacgaagttcgccaacctcgtcgcacaaatcctgaatcgctgactccacttgaggctgccacccaccgactcctgcatccagcttcgcgacgactgcctgagtctccgcttgcttgttgttcaacgacatcagcgaatcctagatgtcgccgagaattttgctgaagtcgaggttctgtttctccatggcctcaacctgcaattgcaaacgagacgtgtaccttggcttctccaggatcgctgctatgataccaaatgtcacgaactcggatttgagtcgcaacgaactctcctatgattcgaaacagaagggaaaagaagctgacttgaggaagaagaagaacagagacaacgagaaccagaggagaaggagggagattggaattgagtttgaggtttcagtttgaatacaatatttcgtatcccgctctttcgcacctgccgactatatagcaatgcgccatctagtctctctcactgacagtggcctagcctttcgctactgggtccactcactcaacggaaagcgtgcgttgggccgcttcatccttttgggtcgatcttgctgctgggccgctgttgacgtcttagtttgaacgccctgctcagatgccgtcgtgacaacttgatgcacgtagccaaatccaaggcacatgataatcaaacacaataatctattcttattatttcttggtttgtgtcaaaaatagtgtttgcccttttcaatgactacaatcaaacaactagaagtattcgatgtcgtgttgagtttagtttccataccaaatattaatgacgataaaaatcacatcatcatccactagcaattattatttagagtagtttacatcacatgcaagtatgtcatgttgggtttagtctcacatcgataattgatgatgagggagcacaacttaaaaggtaggggacggtcctcacctatcagactagtcttttgggttgtgtagacccatgacctaaagttgtggctccgattgggcctgtggtggagcaggcccaatgtgacctgggtggcccacaattggggggccaggctacgcactctaataagtggtatcagagcccaacgtttgaaacccagaacaatttttatgggacacttggtgaggaggccggtaacaagtcttcggggtccacatgtcacatggtggggtcacatgggttgatggggagattgttgggtttagtcccacatcggtaattgatgatgggggagcacgacttaaaagttggtgggcggggctgcgcactctaacatgtcacatcatcacacacaagcaattattgtctaaagtattttaaatatcatgtaaatatgacatatcatttacaattttgttgtatttttagaactcattatgcaagcaatgtttaatcattatctcgacaccattttcacattattcaaacatatacatctatcatttatataataacatttatttaaccacgtatcccgcggtaaagtgcgggtatcaactagttaattataagcaacatgtatgtcttccaataacgaaataatatccggaaataaaagacaaacgaagcataaatttaaaaactatgctctaaaactaaaattataaaatttctctgtatccaaatccaaaatatatatttatacttgcagcctatgtttattgcacggattgatgggatgatgactagtgatatgaaatcaggggcgaagccaggatagatggtcaccgaggtcactattaattaacgatcctaacaattggctatagcttctaataattttaagtctattgttgtagtagtggttaccttttacatatcagagggtgtttagatccagaggtgtaaagttttggcgtgtcacatcggatattatataagatgtcacatggggtgatcaggctctaataaaaaaaactaattacataatctatcagtaaacagcgagatggatttattaagcctaattaatccgtcattagaaaaagtttactgcagcacagcattatcaaatcatggagcaattaggcttaaaagattcgtcttgcaaattagtcgcaatatgtgcaattagttatttttagcctatatttaatacttcatgcatgtgttaaacgtgcgatgtgacatggtgtaaaaattttacgtggaaactaaacaaggcctcaattacaaccatatcattattgtactaggttactatatttgggaaaagaatataacaacctcttatatggtgaaaattacctttgttatatttccccaggctcatgcttcatgatcatgtaattgaacttgaaaaatcaaacgttcatatttcagaactctaatttcgtcaaattcaaacttgagagaccaggttcaaccaaattgtgatgataattaggaaataataataggattagttggttatcctaaataagggccactttatgagcgccagtctaaaacatatatgtatatctatctagactgacgtataatcacaattgctaactaattttctatttgctagttgataatagtatcgttccttgccaccaaatgagctttaacgaaacaatcaccggggtctagtgttttatttgaccggggtcatagctataaaataggaaggagtataaggggactcataagaaatcatcggggtctcctaaccccaataaattgctatagcttcgccctaatgaaatatccatcatccatcgtgcatcgtcgattttaattcctttagtgggcctaatccgacccatccacatggagaggaggttattttagtttggaaaaggtacaccaaaggtccctcaacttgtcatcgagttacgaaatcgtcccccaaccgcaaaaccagataccggacacctttcaactaacaaaaccatgcactttatatcctccagttgttttgaccctggttttgtcctatgtggtggctgagtcagcgtgggacccacgtgggccccacatgtcagtattggcaagtcagcctttctctctcttttcctctcttctctcccatcctcatctctctctctctccattctctgcgactgcgaggccggcaatgcgaggtgggagaggagggcgtcggcggccggcagccagcgatcggcgacgggtggcgcgcgggcggccgggggaggcgcggtgtgcgggcggccgggagaggggcggcgcgcgggctcccccgccggctgccgcccacgaggcccgcgaggcggtggcgggggaatgagttgcgggcgggcggcagagaatgggtggcacccggccgatgggagaggaggaggtcggcgctgtacctgctcatctgggaccaccgcgtggtctctactcggaagcagaacacgcggccgatgtcatagccgccgttaaggatggcggcgtcgcagatgtcacactcctcgtcgctgctgctgacgtcggcgtcttcatgtccgccatcgccgcctccaccacccggggcagctacctcgttgcatccatgtccgccgccgccgccttgtttgggtacgaattagacgccgttgccaacatggagctcgaggacgttggtgattgcttgggcaacgttgccggcggggatcgagggagtggtgaactggcggtcgtggagatacagcggtaggcggtgccagaggtggatccagcgcggggagaagaggtagccgaggcggaagaggtcgaggacgcgggcgacggcggcgtccgggagccgccgccagtcggcgtgccggttggagggaggcgtgagcaagcggcgcggagtggactcggtgacctccgcttgcgaggacttgaagccggacatgatgaaggcagatgcgcggcggcggccggggacctcctcgtgagcggtggccggcggggcagcccgcgcatcgctcctcttcccgctgcccgcgcgctgcccctctcccgccgcccgccacagctcctccccccaccacccgcgcgccgctcctccctgggccgcccgcgcttcggtgtactttttccttttagttttaaattccagcccatgacatggatgtgccggaagtgaggcacatccaatggagacctcattgggccatccattcctcataggttgtcacccacttagcatttaggctcttcatccggtcaaggaataagttcactctgggtccctctatttgtcgtccagtgcagatccccaacttaagaaaccgtttaaataagttccctcgatagtattgtgtctggttttggctgaggtggcacctacatggctcattttggcggagcggcgacagccgcgtccagctcgtcggcatcggtcgtgctgctgctggtggtggtggtgatggcatcgtcgtcgctcgtggcggacggctcggatgtggcggtcatggcgtcctcggcgacaatgtcgatggcgagtggaaacacagacgacgacgactcccgctgctcgaagtcctccagagcccgcgccacggagcgctggacgtcggcggcgctgtggagggtggccgggggcggcacgggcgaggggcgaagcggcgaagttgaggcacgcggcgcggccacggagcgcgagcatggcggcgtcgtgtgcgcgcgcggtggtgtcggcgccgtcgaacgtgccgagccagagcccagagcctgcagccgcggcgcccctcaaaatcaaattcatcagttcttgtaatcttgttctcctagaccctgacaaatgaaaactcgcagtggttcatctgaccaaaaaagaaacaaacagtgtattggtccttggtcgaattcagattcggatggattcacgagtcgaataatcaaatcaaacgcatgactagagtagactcgatctagcaacaaaaacccagtggttcatctgaccacaacagaagcaaaacagctgaccagatgattcggatggattcagtctggctaactctaacctgacgtttcctccgcgagcgtggtaagatgaaggactccccccccctcccatggcgctgctcctcaatcctacacgccgccatggcaatacttgcagttgagcccgaacttgcaccatcccttggtggcgagctccgggcatgcatggacgtccccccgccgccgactctcatctccggcacaattcgttggtcctcctcgccatgagcgtagcgacacgctaccccgttgtggcacctcccctccctccacttcatgcacagcacactcttgtggttggcaacacccatggcgccggcgaccgcgggcgcgggtgcgggcagcagcggtgggaagttgacggcgtaggagctcggcctctctgccgccgccgagtccatcgcgctaggcaagtcccgcgcgtcgttcaacctgaatacatgcgggcggctgccgcggcttccgccgggttatccggaggcggaggcaggcgcagcgggcaacgagaagaggggcggcggccgccatcggtaggcccatgggggtgggaatggaggacgtccttatctccgccggcgagaggagggattagaggggagagatgaagagaggggagatggggagggagagaggaggaagaagaggaggggattgagaatgacaggtgggccccaccattttttgaaattattgtatgtgtgaagctgacatgtgggtcccagaggttttgttatttttcacggtcgaattgccacgtaagcaccacgtcagataaaaacaccgtccaaaccgctatgggacctatgtcactggttttgacagccgagggacctgttgtatctggtttttcagttgaaggacgaaaatcggattcgttgacaagtcaagggacctcagatgaacttatttctccggccaatgagcgaaggctgtgtttcacaccaaaattggaaagtttggttgaaattagaacaatgtgacggaaaagttgaaaatttatgtgtgtaggaaagttttgatgtgatggaaaagttggaagtttgaagaattattttttaactaaacacggccgaaatgtttcggtcgctgtatagttaatttcatgcgggcttttaatctactgggttcatctcatgctgctgctctgttagatgatagggaaaagtacgtacgaggtccttcatcttgtcatcaaactataaaatcgtctctcaaccagaaaatcaatatatgagatccttaacttacaaaaccggtttagtttaggtccttaggtggtacgtaaaatctaaaccaagaggcttctcgctttagtcgtatcacgcgacacgcctcacagctgttcgatcgtgcttgtcgtcctgacgtacatccgcgtggccgcgctctaatggctcaatgagaaggatcaacgtagtgcctgcctgccttttttttaatagatcatgtatgcctttttcctcttcattcaaataaagttttctctcaaattatttatctgatctataatccgattacaattatgtttattacaattaaatctgtcgacgttcgatgtctcgactacggtatttgcatggcatggggatcatcagtgctaggatatacacgagactgaggtaaaagagatggagacaaggacttttatacaggttcaggcccctgaattgtcaggtaataaccctacatcctgttggccaaagccggtattgctcttattcaccataatcacactagtacaatatttggggtagcatatctaactgttgtcgacatggcggtctgaagatctgactcgtagtcgataacatggtagtcttcctcctcgaatccgtgcccggcgagatcagagatagcgctttcgtctctcctgacagtatccggagacaccgtagggtactagccgtgtttatccctgaagtcgatatccggcggcgtgtcttggcgtatgtaggcttctatgttgtggcttctatgtcgattgtgttgggtgttgatcctctgtgtgtgttgatcgtggtggtcgtctttccttattcggaactcctcctatatcctatatccgaaggttgcttccgtataggacatggtatgtagtgggtcctgccgagatttagtcgactactattaggtatatggtatccataaccctgacagtatcccccgacttcaatgcaaataaacgagttcatattctcaaccgcagaccttggaggaactgttatcgagcgcacgtgaccgttctcgataagttcagagataacgttagacttcctttatcagcctcgtgcggacacctaaagggtttgtctgagtcaatctccgacgtcaaacaagaaagtacaaagcatacgactaagtctcccgtcttagtctcccgtcttgctgtaatcgagaatttggattgaagtcaagaaattttatctcggcgggtacaccatttgttcattccgtattccttgtcgagatcgatcaaccgttctcgagtgatcgagaaagtgcataatctgcgacggagccttgtcaatatttgtcgtattcgccttagtcgatcttggtgtagaaccatagagacatgcgatcttcgataatgtcgaatagaattttcctaaaatcaatactcagaaaagaatattagatacaaatagcccctgagcgaatgctcaaagggtgacatgttataatatgtatggaaaactgaaaatgaattaaacttacagaccaatgttttgtatatgagcgtctactcttttaccgactccgatcagtcagtttgttgagttatacactctccctagcccccagccttgtcgtcggagaatcgttctcggaggataagactcttggacctttgacctgcctcggttgaacaagcactgattctagcccccagccgtgaaattggaaaacccaatttccgattacacggcttggttaatacgcacggcgagaactcttacacgaccagatcttacatggtctttcgtctctgaaggatccgacaaggccttatcggctctgggcgtccccagccgaagttcccttaggttcctcagaggccttattaatacggcgtaaagggacattaggataggtttcaacgctaggtgtcttttgtggtaagggatctctgggtaaaacacttggcgattttgtgtatctgatgtcaactttgttggagtagaggtaatggaagaatcgctacacctctggtcgaggactaggtggtagtcgcaagtcgaccactagaagtagaaatagtgggagaatcgctacaccgctggtcgagaaccagatgtagtataaactcgaccactagaggtaaaggtagtgggagaatcgctacaccgcagatcgagaaccaagtgtagtttaaactcgaccactagaagtcagggtagtgggagaatcgctacaccgctagtcgagaaccagatgtagtctaaactcgaccactagaagtaaatgtacgagagatcgctacgattgactggttgagaactagtgagtaggtgtctctcgatcatttggagtcgtggtacgaggaccgctacgctgccggtcgaagactagtcgtaactgttcctcaaccatctgaagtcatggtgcgaggaccgctgcgttattgttgtagtcgtccctcgaccatctgaagttaaggtgtgagagattgctacattttactagttcgagaactagcgagtgagtagaattatctctcgaacaccaatggaagttgcggtgcgagagattgctacgtactggttcgaggaccagcgagcgagtagaattatctctcgaacaccaatggaggttgcggtgcgagagattgctacgcactggttcgaggaccggcgaacgtgtagagttatctctcgaacaccaatggaggttgcggtgcgagagattgctacgcactggttcgaggaccagcgaacgtgtagagttatctctcgaacaccaatggaagttgcggtgtgagagattgctacgtactggttcgaggaccagcgagcgagtagaattatctctcgaacaccaatggaagttgcggtgcgagaaattgctacgtactggttcgaggaccagcgagcgagtagaattatctctcgaacaccaatggaagtttcggtgcgagagattactacgtactggttcgagaaccagcgagtgagtagaattatctctcgaacaccaatggaagttgcggtgcgagagattgctacgtactggttcgagaactagcgaacgtgtagagttatctctcggacaccaatggaggttgcggtgcgagagattgctacgtactggttcgggaaccagcgagcgagtagaattatctctcgacaccaatggaagttgcggtgcgagagattgctacgtactggttcgggaaccagcgagcgagtagaattatctctcgaacaccaatggaggcgctagagttggtttattacatgtgtatctcatgtggccagcatgactcacatacccaacttgtagcatatccggatgtccgttcgcaatcatgtcgggtgatcaagccgacggcattcgcgaggaattatccattaacaaccttttctcgagtagtccagccatggccggtgctatgagataggttgtcggtcttcgttggtaggttgggcgcgacgactctgcatttgtcgagattattctcgataatacagtgtactcgaccacaacctactcgagtgctcaattgttcctgaaaaatattttctagaaggcaaaatatatagcagataatatcgagtatgtactcaaaaaactgcatggatcttctagtattatcaggatataactagcagatgtaaatatcaggtattatgtaaaccgtaaacaagcatgatttatacagaagaaaacagagggagcccctagtgttagactgtagtcggcctaacatcagaaacactcgcgcaatagatgttgtataaaaaacatgctctaggtaaacataataaatcatagatctgacaatgctgtatgatctgaataggtacgataaattgcatatataattattgcgtacctttgtaaatacatgccggatgtatctacgaaattagtagatcaatttaagaaaccaatctaccaattaccttgttgcgtacttgttcgatatcatgcgatctgacatcttttggtatgtcgcggagcttgaggcttggatgatctcgatagaccaagttgtcgatgacgatgatggttccgatctagtcagaagatatacttggataggttggatctccccacagccgaagtcgccgagtagcttgtacttggagagtccatatctcaaacccatctcatcgaaaccttgaagcaccaaaatccccctacctggcgcgccaactgtcgacattcgatatctcgactacggtatttgcatggcatggggatcgtcggtgctaggatatacgcgagactgaggtaaaagagatggagacaaggatttttatacaggttcgggcccctgaattgtcaggtaataaccctacatcctgttggccgaagccagtattgctcttattcaccataatcacaccagtacaatatttggggtagcctatctaactgttgtcgacatggcggtctgaagatctgactcgtagtcaacaacagggtagtcttcctccttgaatccgtgcctagcgagatcaaagatagcgcttccgtctctcctgacagtatccggagacaccgtagggtactagccgtgcttatccctgaagtcgatatccggcggcgtgtcttggcgtatgtaggcttctatgttgtggcttctatgtcgattgtgttgggtgttgatcctttgtgtgtgttgatcgtggtggtcgtctttccttatccggaactcctcctatatccgaaggttgcttccgtataggacatgatatgtagtgggtcctgccgagatttagtcaactactgttaggtatgtggtatccataaccctgacaaaatcttcacaacaagatcttacatattatattacgatgaaaaaatatttatatttgtaaattacttttattatatacgtaagttacttttatcatatatatatataagttacttttagatttgactaaattacttcttagacatataaaaataaattcaataaagtctaaaagtaatttacatatattataaaagtaacttaaaacaacacaaaagtaattttatcacgatattagaagtaaattcattgtagggataaaaatatgattttatctagaaattaaatttaatcagtacatatcaacacaagtaagtttaacattttttaaaagtaacttcaatgttaattggaagtaacttttgcatggttgagaagtaactctctgtaaatccgtttaatcaccgattgtttttttcctttcgttttcgcttttcatatagaatgagaaaagaagataaaacctttcatggattgtaaataacattgatggaataacttttaggtttattgaattacttttttatgtccaagaagtaatttagtgaaatttaaatgtaatttagatatattatccaagtaatttatatttttttcatcaaaatataatcatgtgagattttgttataaagatttaattgttacgaacacaacagtgtaatcggatcatagattggatgagtagtttaagagaaaattttatttgaagtataggtagatactatctttaatagatggagtgg

SEQ ID NO: 51381 - DNA, 10116 bp, Oryza sativa
accactagctgtgtagccacatccttggtggtattgaccccggttttatctgacgtggtggccgagttaacgtgggcccacgtgtgtcccacatatcaggatgaccacgtcatcactctctctctctctctttccctttttctttcctttcttcccctctcccactcttctcgtctggggaagttggccagtgagtggacaggaggctggcggggcgagtgtaacatcccggcctagagcttaataggattaatagaatactcgtaccaacaagttgcaacttcttttccggaagccgatcttgtcacgtcctgataaattcattccaaaataaaattcattttctaaaaggaataatagaattaattaaaattcgaaaaagaaattggcaaacactaaaaatacgtacaagaaaaattcaaatgtggcccggagaatttttgttaaattctccttggtctaaaaggagccctcaaattttacttgaattttcagagcaccggaaataattattaagcaacaaaaacaattatcaaagtttaataaaaagaaaaaacctaaaaataattctcctcttcctcctttgggccaagcccagcccgaagtccttctctcctccctctctttctctccctccccttctctccctctctctctcccgggcctctcttcccctcccgggcagcccactccctcctctcctcctccttctgggccgcccctccctcctctccttcccggcccaccttttctccctcctctcctcctgggccgcctcggcttcgcccggcccaagccgagccgcgctcccacccgtgccgcgcgcgtgcgcgcgctgaccgcgcgccccgcgtggggcccacgcgccaggccgccgtcgccttcctcctccagccgcccggccacctctctctctctcccgtgaaaaccctactcctttcctccctcaaatccgtgtgattcgctcatgggattccaaaattaaataggggaaattaatccccattgaatcctcttcaattgcccccaaattcccccttgattcgtgccttcaatccccgggaacggacgcgccaagtccggccgccttccattgccgccggccgtggttcccgccgccgttcccgctcctcccgtggccggctccctccccgcgcctataaaatgcaaccccctcgctccgttctaccattttagcctcctcccaagcccccccccgtggcctcaccacctctccccgccttctccttctctccctccggcgccggccttcctccagccgcccctgccgccgcgtcaccacgccggccggtcgcgccgtcgcctcctccagcaccgcagccgcctcctcttcgccggcctaccctccgtttcccgcggagacctccggaagtgcctccccgccggcaaccgtggtgttgccgccacgatttcgcctccggccgcctctgccgcgtccccggtgcgccggccgacgtcgccaccacctctcccggcaccggagtgccgtcctctctcccggccaggccacggtgtcgcccgaatttcgccggaacgccgtcatctccgcgccggcctctccttcctcccgtcggctcgtcgccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccgtcggtcgcccggctcgtcgtctcgcggcgccgcctccgtcatcgtcatcgctgcggcgtgttccacgccgtcctcgtccccgtgcagccgctgccggctgtcctcgtcgcctcctcgccggtcccggtcgtcgtcgttgccgtcgtcctctcgtcgttcccggtcgtcgtgacgttcgtccctccgtcgagccgttctcgttcgtcgtccgcgttcgtcaagcgagctgctgcagccctgtcctcttcttcgtcctcgcctccgcgtcgtcaagccccgtgccggccgcgtctcgccttcgttcaaggatcgccgccgaagtcgttccctcgccgtccgtctccgccgcgcccgttcgtcgttgtcgttcccacgcctcgtcgcgtggtggtaaggtttcctcctctcgttgccccgtcctcgtcctttcggtgtcgcccgtgcccgttgtgcggttgtcgaccccggtacccgtgtaccggtgtcggtagtcgttcgcttgtgtgtgtggtgaccctgttagtgtgcccactcggaagccgcgtggtttcacgtgtgcagtccgcgtggtgtctagtggagtccgtttgtcggccactcgcctcggttgacacacggggtccgcttccgtcgacccgtggaccgtctctgtgtactcggtctaccgcggtcctttaggttgacatgtggggtccgcatgtcaacggcgcagccttcctgtcttttccaggctagcgcttccacatgttttataattgcaaagcttaattataataatccgcaaatctccatataacagcattaaacttcggatgatcatatcttggtcatacgaactccgaatcgacccgttcaagtctcctaatgtttgttaaaacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtggttttataactttagactttgggaagtctcatatcatttggacactatggaattgttggattatggtggaattggacatacacctctcttcctctttcaaaacccctaaaacctgttttcgatggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcgtggcagagggttggtgccctgctacttggggctcagtcctgcctgcctgtcccggaggttccggccgtaggcgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttctaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtaccccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactggcgttcgggaaaaggcaattttcccggtcgcgacagatctcgaaagaaatctgaggttaagcatgcttggcctggagcaatttcttcccgagtgcatataagtgaggagaaagtgtgcagaaaagacttgtccagatataagcgggcctgtatatctgattttctggttgagggacgattttataatttgatgacaagttgagggacctcatatgtaccttttcctttgatgatattggccatgtttagattccaccctaaaatttttcaccctgtcacatcaaacgtttgaacacctgcatgaagtattaaatatttgaacacctgcatgaagtattaaatataggctaaaaaatgactaattacacatattgcaactaatttgcgagatgaatcttttaagcctaactagaaaggtagcccgcgcacatgcgcgggcaccttatgcaagtggatttttattaaaatatcctgtattatgtcctaaactaaaattaaacttattttgtgtgatttttattaaaatatcttgtattatgtcctaaactaaaattaaacttattttaaaatgcaatcaaacaaaaaagatattattcgatttcttttggggttataagatatccttctgacgagttaaaataccctaaattaaatttgtgatggaaatattagtgcatataacttggcatggggtaaaggcatacgttctaaattttctcccataaaatattgaagtaatggtcatagtatatttagctaatcatcactaaagtggattgtcttgtaatgaatacatgtttctagattgttctacgtcaaaactttacaatgtactatagcaagtttaacaaaaaaaaaagaaatggacatggtctttaattcctatatggaactgacttgatttattgctaacgccactgcaatgttgttccactgttaaaattcctaggtacaacccaaatgcttatcagtatgatgtttaaccaaccacacttttcaacctgttgtctatattgctagatgaatacctgctatgattagtgacttcatagatcatatgtgtaattcggacactatgattgtctttcttaaaagtatttatttatcgcctacaaagatcattctaaaagtatcaaggtcaatttgtataggtacatagccctcatatgcatgttaagagaaattaattaagttggcataaagtcgttagatgcctaacaggatataagtaatagatggaggtccatttgtgtttttttgcccatatggataattttaattgtcaaggagataaaaacagagagaaaagaatggtgcacgttgtacacaggtaggtagggagggagggagggaggtttgggatgtttttctaaatgactaatctaacaacctaaaataatgtgtcagatgtttatgtcgaaaccgatggttggatgttttgttttcttaagagcatatataaaatgtgtaatgaacttttaacaccgcatgccgcaaagaaggagggagggaaggagatttagggtgttctttttaaaaatatatatctaatgacctaaaataatgtgtcaatccattgaaaataatgtatccatcgatttatgtcaaatacgatggttggatgttttttccccaaaatttctaagatttttctttaatttaagaacgtcatgtagcagcttaccttttattgttctcgcccttgccttgcattctcctcgttttgcatgagatgatagaaataaggaattgcagacaagacatcttgcaagtatttataagatgtttaatggattttaacactacatgaaggtgggagggagggagggaggtttgggttgttttcttattaaaaaaaattaacaaatcgatatcgaatgctttgtttgtttttaagattttcttgtattttctttaatttaatagtaccatttagcagcttagaagcattcgtagtatgtttagagtgacaaagcgagagctactagacctaataggtggaggtctatttgtggttttcttaatgtcaaaataattgtgattttaatttgtcatgaagatagtttgttggtacctacgtgatgtggaggttccggatgtgtgctttttgtttagaataaaagatctaaacttctaaattaaaataatggatcgtcgatctaaataaaaatcgatggtcagattagagtgctacttgacaacctaggagtgcttgtaaggtgccatttggcggcttagtcgtattcgtacgatattcaatgaacttttagtatacaatagtcttttttctgaaattgctaagattttatttaatttaagtatgtcaaatagtagcttaaaggtgtttataaaatgtgtaatggtttttaacactgcatgggggtggggagggagggagggagggagagaggtttgggatttttttattaaaaaaatctaacaacctaaagccatcaatttaagaagaaattgaatgttggctgctttatattttttgaagattttctaagtagaaattgaatgtcggctgctttgtatttattaagattttctattattttctctaatttaatagcaccacgtagcgatttagaagtgttcgtaggatattttaagtgacggagggatagctgctagagctagtagttggtctatttgtaattttttttgcctataagaatagttttgattttagtttctcatgaaatagaaaaataacaaaggaaagacagaagggaagtacgtacagtacatacttacgtttgtacgttagtaccatatatgttggtttcggatgtttttttacaaaatagatcaaaccatccaaaataatgggtctaccaattcaagtaaaaatagatggttggatttctttttatttattagagtgccacttgacaacttgagagcgtttatagggtgccacttggcggtttgagagtgtttataggaagtttaatagacttttagtatataatagatagatagatagattgcttcatgatttgacaatatagtgttacagtaaacatttgctaattacagattaattatacttaataaattcgtctcttggtttaccgacgaattctgtaattagttttttttattattgtccaaacacccaaacacgtcgtaactttacacctctagatctaaatcccatagctatagtaggactagctatacatttatcacaaatttaatccgcccgcgctaactaccgaagaagccactgctgctgtcctagcaaactgccggccggggtttttgggctgctcagctggtgccggcaacccgtgctgacctggaggtgatgcgagtgtgggggaaagcttgtcgtgtcgatggagacccaacacatctatgtgatataactaattactccattcgatccagaatataagaagtattagaatttgacatagttattaaaaaaatagatagaaataagtgatggagggttgtgattaaataggtagtggaggtaggtaggaaaagtgaatggtggagggttgtgattggttaggaagagagttggtggagaagttatattttgggacaaatcctaaaagctaaaaattgttatattttgagacgaatggagtaaatcggaaaggatcaatctcattaacattctcacgttttttcaacaactagttgagtgccttgcgttgctgcaggaaaaaaatagtaaattaaaatcacaatgagaaaaatgatgttaaaaaaatcattgagcgtaaatttgttgcaacaaaaacattaaaataacatgaacaataattacataatatacactaaaaccaagcctacaaaactaatcaaacactggcacatgcatgtatgtatattggatttctgctgacacgtgaatttatcgagcaagtataataattttaaccataaaatcaaccagtttgatctcaatcagcaatctacccgcccacgtacaacttgcttttgttttattacttggacatcctcttaatgctacgacattatttgataattgcaaatatgacatccacattactgaaaaatgccttccatgaaacatgatacacatagacctaacattgcaatcgtgcacatacatcaagcggttttagctatatgcatcatacgatgcagatgatcacgttaaaaattaaaaattttatcggccatgatatatacaaaccaaatttatatcaaattcaaaagttactttaaaactgatgagcatagtagatatctccaggcaacgcaatgtcaatcaatagaacggcgacggtgacgatcagttctcatggtatttgctcaggggaaggacttgattgtcatgattgccgtctttaaagggcacaccctgaaaatggatgacaaacaaagtcgtttggtggtcttgttaggtaaaaaaaaaacacaattctatatatctgccatcagttttaaaggaagaaacaaatgatgcttgtatataggggtagttaggattactgaaccataggttggacacttgaaaatattccagtggagttcagggcgttaatagcaacaccatgaaccttcaaatatggagtataaggtaacaatatataccataccatagcaaggagccaatgtaacaggaaagaccaacattgaagtactgttgaaaaagacactaattccatccaaattccgttttagtacctccacagatacactgtggctgtaataaaataaagcattctcttttgtattgactccgccaatcagaaaatgttaatcagaattgtcaccaggtgataatctcaaaaccaagtagacaaatcgaatcaaacttttgcacatcatcatcgtaaatggggtaaatctttttttagttgaaactggccactcctggagaaatgatctttgttgggccactaaaaaatcacattagtcccggtttgagtaaaaacatatttagtcccgatttgaaaatacagtacttcaaccggaactaaatattattcttactcccgattcaaaaacaggtttgacggagcgtggggctcctcaccgggagaccgcgcaggcccccctttgccgattcggccgggggcgctaagtgaggttcttcgccctcgatctgaggaacgtcagcgagagaggaagtgcacaagacacgggcgacgtagacaggttcgagccgctgagaagcgtaacaccctactcctgtgttctggtggatctgtgcgtgaaggaataccgagagccggagagcgagagagagttcaggctctagaacccctctttctctttttttcccctctttttcccccttctaggcctggtcctcctttttatctggtcaggggtcaccacatgggcctctagctgcctaagaaaggaaacatgctttttacaatgagggctagtctacagccggaagtgacctctgacaagcagagcacacgcctccagccccgctcgccagctttcccggtggacgcccatttcaaccttcattcaatggccagcgacttccttgccatgcttgcgctgaagcctggaatggatctgaccgggactgacataccaactccaggagttagcatgccggctccggctagggacgagagccaggaagctctcatcattccgacgggacggggcgaggcgtgtgacaggccgcctgttgccacctaacccgcgatctgacccgtctgtgaccggtcacacgccgcgaccggtcacggaccggataagcgtgcgctgcgccgcattaaatgcggcgtggcgcgctcgtccaacccgctataaatgcggttaggtgagccccgctgtgctcacctaaccacacacgtggcgccaaaaccacagggggt

SEQ ID NO: 51382 - DNA, 5114 bp, Oryza sativa
acccctcggggagacagaggaggggtggccacgtcaccctcgggcccgaccccccccagggggtcaggccacgtgggtgaccgcggctacccaagcctctagtcacgatacccccgaccccatgtcaccgacaaggttagagccctattatttttagcggttgtttataccaaccagcaccaaacttttaaaaaatcacaaaaatccctttccgagccgtcctcaccgcctcgtcgatccttatcccctcatcatctcctcctctcattttctccacctcctccctctccccatctcctccccctcacccctcccttctctgacaacgagaggcctcaccctctctctctatttatatatgaggtaggctgtgcaaagccaacgaatctaacacaacttagctaggactcctaactatgtaggaaaccctctcttgcaagtaaacaacttatctctttccttatctctatcaaacttcccgaattcggactcccttacaaattcgactcctctttccatacgtacacaattcctcttgtatatcatatggatttcttcatcaccacatgcattgtcctctagccttaagtatcccgcatgatctcttgatccttggacatcaacttctcccaagttgactccgatctttcaccggcaacactctcccgaggcctcaagcaacacctacacatgcaacaaccaagagaccatattccgagcccaagttcgtcccaacttgactcacattagtataacaatagtatccatacgcatagaaaccatctagaagccaaatccaacaaatcaacccgaaaccgacatcgatcaggatcatgccggtcagaccgtcgggccggccggtctgaccgccgcaacacccgcggtctaaccggcgacactcagccggtctgaccgccagggtcaaccaaaacagctcacttcacaaaatcaaccatcttataaaatctctaaattaacattagcaaaccagcaatattttcatcacaaaatctaaatcaactccttgattctacaatctccctcttgatgaaaatcattggcaaacaacaaatggtttgtggtgttttgtgaagcaaatccaaaatgcatcttcaatgccaaaaaaaaattttcaaagaaaaatctctcacttttgaaaagaaagaaattccttctacttatgacaattatgcacaatttgttaccttgttctcccccttttgacaatgagttcatcaacattttttttccggagagctttgctataccaaaagtaattcaagaacatgtgttgcaataacaaggtagatggcatgacaatctagttaacaagcatgcatagaagtgtaaacatgaacctaagatattgtcaaaaagatcaaatcaacactaaagattcatgacttcaaacgatttataataaaatatattaacaagcacatagactgaaaaataaacactatacatatagacctattgcatgtattactctttctcaaattagctttagcacaaaaacaatcaagagaattttttcactttgatttgagcctttttctcttttttttttcaattattccgggcacgtcctcgtcgtcaagactgtttccaaggattcggcacccattacttttgctcacatcgaatacatacttgttgtcaagactgtttgcaaggattcggtattcatttttttcatagatatttttttattatttgtttattctcttgcacaatgagcatttacaaagctatttgaggaataacaattcaataaagcatatatataaagcatttataaattaaaccatatgctagcatcaatattgcatatttgcttaattcaagtcataaattatatgtcatgtatcaaatcacttaaagacaatatcaaaagctcatataaaaactaacatgcactcaagctagtctagtcatcacatcacctaacatgtattgctagcatataccggaatatactaaggcacaaacaaagctcttcttctttttcatttttttatatttttttcaacttctttttcttttttttatcacaccatacatgaataaaacatgtatgcaaaaaggaaaaaaaaataagaaaagaaaacatgaatgcaacaaagagccaaaactcccctcaattgatgccaaaaggatgaacaattcccaactcgcctcgaagaaaagcaaattgaggagaatccaacggttttgtgaaaatacctgccaattgcaattgagtatcaacaaaagccaattcaacatctcccttctcaacatgatccctcaaaaagtgatagcgaataccagtgtgcttcgtgcgtgagtgttgtacaggattcttagcaatattaatagcactagtgttgtcacaaagaagaggaacttcctcaaaagtaagaccataatctctcaaagttgaaataagccaaagaatctgagaacaacaactagcagcagtaacatattcagcctcagcagttgattaagcaacattagactgtttcctagaagaccaagcaatcaaagaaataccaagaaaatgacatgttccactagtacttttcctatcaattctacacccaccaaaatccgcatccgaataaccactcaagcatatagaagacgatgtagaacaccaaattccaaattctagagtatgttgcaaatacctcatgatgcgtttaacatcttgacgatgtgaagcacgtggagaagcttgaaaacgagcatagaaacacacaacaaattgaatgtctagtctcgaagcagtgagatagagtaaagatccaatcatgctcctatactccttttgatccacaacttcaccatcttcatccggatccaacacagcagttgatcccatcggtgtagaaattggcttgcaatccgccatcttgaagcgccttaaaagatccttggtgtacttcgtttgatgcacaaacgtaccttgcttcatttgcttgatttgaagtcccaaaaagtaagtcaactctcccatcatactcatttcgaattccctgcgcatagtctcagcaaactacacaaccaaacggtgagatgaacaaccaaagatgatatcttccacataaatctgaacaaaaagttgatcaccaccatgcttaagaacaaagagagttttatccacttttcccattgtaaaacctttagcaagcaaaaagtttttcaatctatcataccatgccctcggagcttgttttagaccatacaaagcttttgacaaacgaaaaacatggttgggaaaatcaggattttcaaaaccgggtggttgttttatataaacttcctcctttatataaccattataaccattaagaaaagcacttttcacatccatttgaaacaatttaaaaccttttgaagcagcaagagccaacaaaaatttaattgcctcaattctagcaacaggagcaaaagtttcatcataatccaacccctccatttgagtaaaaccctgagcaacaagcctagccttatttctcacaatcaaaccatcctcattttgtttgtttttgaaaacccatttagttccattaatattatgaccaacaagaggttcaactaaaaaccaaactttgtttctttcaaaattctctagttcttcatgcatggcattgatccatgattcatcagttaaggcatgagtaacatctttgggttcaaaagtagcaacaaatgcagaatttacatgagtatcacgagttgttaccttagaccttgtggtccattctctaatgttacctattatgtgttctggaggatgtcgtcgttgaatatgaagtggagcagaaacatctaatgaaatttcgtgttctgcatcatgatttgacgaagtagaaacttctggaggtcctctattattagcacccgacgaacccgaagatgagcccccaggccggtttgactgctcctctgcctgcggtctgatcggcggtgggtcgacggtctgaccggccatgacccgttagtcgtcttcctcatcgtcgctttcctccatgaaaatatcctccccttgaacctgtgataatgtacctgaaatatcgggtcttgtaccttcactagcctcatcaaaagtgacttcgcaagtctcaacaactttgttagtgtctaaaacaagtacacggtaacctcgagaatgtgcagagtaaccaagcataagcccatcagtagaacgtgactcaaattttccaaatttcccgatttcaacacaaagcacttacacccaaaaacacgcaaatgttaaatcttaggtgtatgaccaaatcgaagctcataagatgtttttccaagttttgatctcaagaaaacacgattggaaatataacatgcagtgttaacagcttcagcccaaaatcttctaggtgtatggtactcatcaagcatagtcctagccatttcaaccaaagaacgattctttatttcgacaacaccattttgttgaggaacacgtggagatgaaaattgatgttcaagacctttttctttgcaaaaactttcaaaaaaaagcatttttgaactcactaccattatcacttcgaatagttcttaaagatccagaaaattcaagagccaaacgaagatacaaacttttaaagtgttcaaaagcctcatctttagtagccataaagtaaacccaagaatatagagaaaaatcgtcaacaataaccaacatataccactttcctccgacggattgctctctagctggaccaacagtgtccatatgtagaagctgtcccggtgcatccgtcatcacagaaataataggagtatgtgaagaagcaaccatcttagcatgacgacatggcgaacaaaccagatcacgatctttcttaagtttaggcaaaccacgaacaaaatcagaaccactaagtctagtaagatgatcaaaacctacatgtccaagtctacgatgccaaaacatcacatctttagaaaattttgcaacaagacatgtaatctctgaagaaacacttctttcaaaatcagccttaaaaactcttccatatcgagaaacattaagcacaacatcgccagaagaattaaagacttacttccagttttcttgaacaacacatcaaaatcctcat

SEQ ID NO: 51383 - DNA, 888 bp, Oryza sativa
ccggctaactacggggagtctactcgagctactaccgaaagctagggggaggagatggagcgaggaggaagaacggagggaggcatcaccgagatgaggaggggcgctgtgacgagaggccgacggcgcgggagtaatctctccggcttcgggccggggaagaggaaggagagggtgcggccgaagtccccttccgcgtccttgctcgtgccgactccttcgacacgcgcaacaacgaacggcgacggtgaacagagcacgggggcggcagctatggtgaggaggcgaaaacgagggagattggaggggaaggagctggggtttaaagggggcggcaatgtcggtttgggaaccgacttagggtggtcaaggcgcgagctggcgctcggcggtcgcggccaaagcggcgacagggaggatgacgccggcgggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgacgacggcaatgacggcggggcggtttggagcggcgcgacgacacgagcgacaggcgcggcaggcgctgacgacggcggcgaccaggcggtcggccactcggcacgcacgcgcggctcgcaacgggagggcgcggcggatggagcggcgcggctcggcacacgcgctggctgcggggccgagcggctgcaggcgcggcagggcagcggggccgggcggcgaccacgcggtgcgggcgaggaccacgcgggcgcgcgcgcgaacaacagcgcgcgggggccggctttgcgagcggggagctc

SEQ ID NO: 51384 - DNA, 9683 bp, Oryza sativa
ggtatacctgtttcctgatctttggaaagtttggaaatgttaggttgataacatataatacattgataattaatggttggtgagtggaataaagggaacatacttcctcatctgagacccatctcagtgctgttgatagagttcctgaatcagtgactatccttagacccttttgctttgtagtgtccatttgatttctttgttcctcatcgccccaaggtttaatacggtgaatggatttaaaatggcgttgcatatttcttggaatgcgcgaagctggatatatatccacaaaacctggtttgttcataacattttcactgaacctggcacagaaaaaatgagtaagttcactagcaacaagcaaatttatacattttagaacctcaaatcaacaggcatggcattaattacaattcacagaatcaattcagtgaaaagaaaggggcggtagggaaatgtactggacaggcaaagaaacaggaaagccacaatggaactgtgcagttaaatggaaaaaaaaagtaaaattaatagatatccttatagcgatcagaatgccatttgaatgagagaccatttacgaatacacttataagccacatgcatattgtgtgtgtgcaaggagattcaatatcatttctcgcatttctaatgataatggaaaagagatgggaaataaattgaacaagtgcatcattgaacagatcgatatacaccttagcctcatacttagcactagcagtctgtgcataaactaaaccatttatacattagtaatatgatgatgtgaggactactaagaattatttagtaggtaatatgatcccgctatttttaagcattgtaacagaacagctatacagcaaattagcaggcagtaagacagcttgacacacatccctatagactctatgcagtcaaacaagctaaataatgatatattttcagaacagaagcatctcccaagggttaatatgaactcaacaccatatatgttgaacatatatatcttaccaacaagcaaatgtcaccaaataatgagatcgcttgctgatagtaagttgcagtctggcagacatgcaactggaacaaggaatgcaaagctaatatgaaaagttcaacaaaaaatagtacaatgacagccactgtctattatacaattcatgtacctactttcgacccagctgggcaatctcaaggttcagatgattaacatgttcgagtttatctgccatggaagaaattatacttttagcaacactcaagtggaaaacaagaagcaccagtataactctagtaggccaacctttaggaagatgaattccccctttctcaaagtcaacacgcaaggtggtggctgcccttcgagcttcctctgtgagcatgacaccttcgctctcagctttaagtattgcattgtacaaagtagtattggtattcagatactgcatagaatcacagggaaaaaggaaatttaatggttctgacttggtcatttcactaagttctctccctcattttttcctcaaaccaactatttcggtatgcaacatccatgttatcgagcttacttgaagatgttcataaatcctcattgatgccttatctgcctcatccataaattccctggcacagaatacacatgtaattggccactcaaaactaaaacacattgctccagagtatgattttcataagaagcaaccagtaaccagtgtacactcacttatctgggtgcgtattcctgcacagctctgccgaatcaataactgagcagacctaaccaaatcatcaagtataaaacgcacatcactccctcaataccaactcaagtactaattccgcaaaaaaatcattagcagaagaggaagtaggctacagtgttcgatatctcatccatggcgcggacaatctccgcggacggcggcagctgcccgatgtaggccacgagctcgtccgacctgcgcgtttcagtaaaatctcagcagccaatggatggctccagcttccagatgagtaggttgcggttcagtatctccaccccttacctctcgatggcgtcgtcgacgaagcggcggaagcccttggccgtgcgcagcacatcgaagccgtacagcccggtctccggcctcgccgcggcggtggagaaggccgccgccgcggcgcggcggagagaggctgcgcgggagagcattgcggaggcactcagttgattcatttcgacagccacacgtctccagagtctagacctcgccgtcgccgccgccgctgctcaccggaggagcatgggcgagaggaaggggatggggtttagtgaaagtgaatgtaaaattcaattctgtgagggacctttatgagaaaattcctttcgccattctctcctggatctatcttggccgcctacggttcatcgaacggttaagacaagtccaacgtggatgcgaaaaatattcgcagggtgtaaacggaaatacaatattgtatgagggcttatagggaaaactatccctctgggctttactctcctcggtgtgggccgcgtattcttgatccaacggatcacaacgagcccaactaggatggctagggctctcatcttttggcccaatcagcatatgccaatgccaacatttaaattttttaacttaattttgaagttgtttttgagtttttttcatcatagtttcttttacaagattgtcatttaagtcgctacgaacataactgtaaaagttttaatcacaaattatattttttttactaatacgccaaatggcgtattttccgcacatagccatcggatgaggctgtaggtttcgtcgtcagtgcttggctgaaaattgaaatcctctttttcaaaaaggaaaaaaaacagagaggaagaaatccactcaaaatcgcaaggcaactttttaggaagatcaaatcacaggcaattgaagctagtattggcaaactatttgtgttggacaatcacatcgagaaaatatgttgagcaggagtagaagataaacaattcatccattacgctttgatcagcacaggtctaagtacaacacaatgtaagtcttctgacttgcgacattgatacacagcaaaacgaattctgatccaagtacagaatgatgatacagccaatcaacaaacaccgtcacatgtaaatcctctactgtggcataagcgataacatctctgatatggaaccaaaattcttatgccaatacagaccacaacgctaggaacaagctcatcaatcctggaagaccaactgacatagtgcgatgaccagcgtttttgccacctgatggagaggctgcaaacaatagaattaagaattgaggttaaaaaaaagtactctgtaaagtgttatcgtgatgttacatgcgtaatcaattcgaataaacttttaattttaactattttacatgtgagaaaaagaggcagaatgggatctttgttatcctttactttgctaatgctacatgtattcctaccgaagtaatataatgcattgtattcaaataaaatggctacactacttcttaattgtagacacttagaccccacattagctctataaaaaaaagacccagtgtttgctatccctgaacattgaacgcacgagtatccatagcaagtctggaattttgaagaatttgatacatctacttcatggctagtgtgagcgtaaaatgcaaaaatatcatcgctaaataaactgactaacagcagtaggatgcataaatataactctgtaaggcagtctgatagactgttactaatagcatgccagatgcccaggtcaacacaaactgtccgtgttaaccatttctagcctctttcaatgatgctagttagcctgatcacccatgttatttggttgatttgccgacttaaaatgtaacatctttaaataaatttgttcagaccaaactaactcctactttatgcagcatttattatctgtcttaactgctatggttttagcaccataaacattttctaaacaggtagtatcatacagcagtgatgaaccttcaaatcattgtgcttaacagtagtccacagtaatccttgggaccatgtctaatacatgtctaaccatacatattaattcattcatctatttaattggggtccaagttcacatcaaactcaagttgagggatttcttcctacagatctatctgatatgactttatcaaaatgctgctgcttccagttgaaattcatagcattaaaaattatcggaccagacaaaaagtttcaggtagtgaggtatcgcacatataacaagctaagaaaatcttaagtttaaatagccatgcatactatcttcagaaagtatatattacctggaggagagttcgtaggggaattccctgcaaaatattattgtaggacacttatcagaaaaccatacaaatatatgtattaaaattatctaaggaaaaggacggttgccaaatacaacagatatagtagcgaactggtgtgacttccaaaaaaaaatgaattttgtaatgatgtttggtaaaagttaccagcacaacaaaacagtgctaaacaaatctagattaagtttcatggttccatttcatcaggtcaaagaaattagctattttcctagttgatttataaacatcatcccaaatgtgaaatggctacaatactatatccaacggtaggctgagactaatcattcaactagtattatacccaaggcgaactggtataatctgacatcgttgcgtcttcagattaaactacgattattacaggacaggactggggaagcaaaaaacaggaatctggatgcctacaaacttctggtcgacccaaatcatggagcttggtcttatattcacacctaaatgttttttctttgtttcgttttgccctgatagagacagaaatgcaaagccaacttccctacgccacttattgacttatgcaacaaaaaggcaaaaacattcctttactttcccaaatttgtagtaattacctttttttttcgccggacaaatttgtgttaattacatcgacttgtcactagaaatatgacattatacatggcagtaagaacagtttatgcggccgtttgtttaaaacatcctaaccggatttatttcttcaaccacagtgcagtgacttcgatgtgcaaaccatcattccatcaaccaggcaaacaatgcattagcaagaacaaggcctcatatttattcagtgtaggaacagtcaaatcatgctatttgggtgagtttttggataccaatattacaaaaattaacaactcatgatcgatgccacggtgataatttctatcaaaaacaacatattctctctctctctctctctcttttgctgttaaaagaacaagggatagaaggaggaggaggagggtaaaataagttggttaccggggcacatgctggtggtctggctgatgccgcaccgcgtggagaggcggagggcgtcggagatgttgatgttgaaggccttgaagatctccggcgaggcgtagaggtcgcagaggcacttgagctcgttcttcaccgcctccttgagcgggtcgcagcacgccgccggcggcgtgtccgtcccgttcatgtactgcgcgcacggcaccagcttcgacgcgcagctcggcgtgctcggcgacgactgcgccgccccgcccgccgccagcgagatcgccacagccgccaccatggccgccaccgccgcagccatccgcgtcgccatctgtctctctctctctctctcccccacgagcaccgagcaaaggtggtgccttttttttgtgtaagctctggttacacttggtgctgtaggtgcgcccctggactctgtgaagcttttgctttatagaaaaaggaggaattttttttcttcaggtatttgagaacattcagcaattgtacttttcaggttctgactgtgtttagttttcttcaaacttccgaaaaaatccggcacataaaatgtttgaacacatgcatggaacattaaatgtggacgaaaaaaaattaattgcacagtttacatgtaaattgcgagacgaatcttttgagcctaattacaccatgatttgataatatggtgctacagtaaatatttgctaataacggattaattaggcttaataaattcgtctcgcagtttacaggcggaatctgtaatttgttttgttattagtctacgtttaatacttcaaatgtgtgttcgtatacgtcaaaaaaatttttggaggagaaactaaacacggcctctgtttggtttggggattggcaattggacatccaggaacttttaaatttctactatataaatatgtgaaaattccctccaaatcaaaccaggtttgtcaacattcatcaatttggcaatattaaaaataaaaaaggttcagctatttgaaaaggactttgcaaattgcagaccaatttatggtctccctctttaatgccggcttctgcttctactactctgaataaaggtttgaatgttttttttgtaattaagttgtacttgtacacgcaccctctgatgataaaggtttgaatgttttctgtaacacaaaagatacatgttgatgttttagaaaagtttgtggtcaaactcttagaggacatgcctgaattttcaacaatttgcaccgaagcgtagacctagaatctaataacgaagcaacacaaatccatccgaacacctagcatcggatgattatgtggtaggtaactttaatttaagcttataagcgatgagtccaaagtagttgttgtaaatggtcatttattattattatttgtaaataaaagtgcaaagttgatagaaaaaccctctatttcgcttcaaactttaactatactatcagtctattacccccgtaggcggtaaaaacacttgctagcaactgtatggaaatatagaacacgcatttatcctttccaaatcacatgattaacgatcaataatgtctagaacagttagtaaacactacttctaccaaattctacaacagctaacccaggacgctgctctgaaccttccagtcagttgacttctgaattctgaccaagtctcacctatgcctagaaattactccctccgtccttaaaaaaagacaaaccttggtttccatgtccaactttgactgtccgtcttatatgaagtttttttataattcgtattttcgttgttgttatatgataaagcatgattaatattttatgcgtgacttgtctttttaatttttttcataatttttttaaataagacggactgtcaaacgctggacacggaaatcaggtttgtctttttttttttttgacggacggagtagaatgcgaaacagcatgtcagcatcatgtggcgaagagacttctctgtttttccccatggttggagcactgagacagcatgaactccccgcaacctctcagatagtcagatcttgactagaacagttgaacattttgttcccagacaaagactccaaggcccagttcagttaaagtttttcttcgaacttctaactttttcatcatatatcaaaacttttctacacacagaaacttttaacttttccgtcacatcgtttccaatttcaaccaaacttctaattttggtgtgaactaaacacagcctaaaatgtgaattttgaccaaaaagaaacgtcacattaaatgtttggacacatacatagggcattaaatgtgagaaaaaaaaaccaattgcacagtttacatgtaaattgcgagacgaatcttttgagcctaactataccataatttgatagtgtgatgctacagtaaatatttgcttattacggattaattaggcttgataaattcgtctcgtaatttacagtcggaatctataatttgttttgttattagtctacgtttaatactttaaatgtgtgtccgtatacttaaaaaactttacacccaataaactaaacaaactcttaagttccttgtgaagatttggactgagcatttgatcaatgttgctgaacaaccatgcctgtaaagaaagtgtgaagatgtttactgtactggattcctcttgaaggtttttcatgggattgtgatgataatcatgatgattagctccaagcaatcatcatgattaaaccgagcgtgtccgaaaactttcagccgtggatttcagctactcatgttgtccgaagcttctgtaatgattccttcagcaagggaatctccatcatagtacttgccaaaagaaatgagcaaactccgtcttcaggtcgatcaagtacctgaaggaaggtagataagcatggtcattcttcattgtatgatatgcaaataaacagtgtaaagaaaactgatgtgagtatgaaaccatgaagagaatatttgtaaattgcaactgctaccaacttgctgcattaaagcaaacatagtgcatgttaccatctgtatttcactaagtgaacctagttcacatgtgttttgtgacggataggcctccaatcaccaattcaagagtaaaaacttaatttgtatgcattcactttacatgattattcatctcccaacttgcagcctaaaactgaacaatggtcaagagggtagttcatccagttaaatttaattgtaacatttttttaaaaaaaaaatgccgagcaactcaatagcagggagtggagacagctacaggaaccacatatgtagagacaactcataatcatgataattatcagctcatattagtactcacataagtactgtataccacatgggctgcatccaataaatgttcatgttgcctgcttgatcagtgtggtttggcagtctcattaatagatagctgctataagggataaaaaggatgcggtccaactatccaagtccactatgaacaaggcacagcacaatactggtaggttaggtgttgcagttcaagaaacggcacaagcaaaaacaacctgttgttttgcttctaattaaattaaggcctttcttctttttgacccccatgtgaccatgttaatagaatgaaattatgtttccgtcgattcgtcggtactattgcaaaccgtttacacaatcagtgaatcagaatcaaggaaataagttagatacaaaatttggtaactgaaaaattatatatacggtagttaacctttggattcatgtaataagctcgataaacacatgcagcgttccttatctcatctgtggtaccagttagtcctgttagatcccggaattctgttaatcgggcaaatgagaaaacagtagttagaaaatataactgaacatgataaaatgattagatgccgcaatttcagcatatctctctaagtgaaaatttaatctcaaagtgaaacgggaattagccacgtcatccaaccaactactaatagtgttgtagcagggtgcaaacaccttttcctccaattcggtcaaaacactacgaggttttgcaagacctaagtatccagaggggaaaacactcattctgagtggaaactacctttccaagaggaagaacaccttcccaaaaagaaaataccttcccagaggaagaacacttattcgaatagaaaatacctcttcgggtgaagaacaccttattagggacattacataatcgctaatacaactacacatattttggacaagttacaatttcacaggtgtttt

SEQ ID NO: 51385 - DNA, 1980 bp, Oryza sativa
aaagttgtgtttgctgttagagctcgtttttaaggataggcgggagaacacttctttccggcctatccccgatcttgttcgtacctaaaggtcacaacagtggcaccgtccgtggggacggaaagtctccattgaattgggctcaaacagtaaatgcgacgttctcaacgacagaagactgtgccagtacgctatacaggagcttttgcaagcgcgacagctgcactcgagagagagtgggaaaaggcagtggaagaaagtgacttagcaagagcaacggaaacacttgataagctgtgggcagagatggccaagacatccacagcagcaggaggtaatgaaacaactcaagaagaaagaattgctggtgcggtggtggaagaaacagggaaaacacccatgagtgatgtagagcttgctgaattggtccaagcgcaaggggctgtcatggtgagtaaaggacaatatgaggatcaagtgatcagtgtgcaataccaggggctagggaaaagcaatcagatcaggcaaaaggagatgcccagggggagaacaaagaaggagaaagtatcaaagccacccaagctcaagatctaccacgaacccaagctcccagtcaagtacaaaacccatctcaggctcaaattcccattcttacccagaatacacctcaagctcaaatcaccattcctactcagaacctagctcaaaccttgatccctagccaaaaccaaattcctattcaaacgcacatttctttccagccgcatattccaattcaaactcaaaatcctaaccaagtacaatatcctcaaacacaattacatcaaacccacccagttcttcccaatcaaatccaaatcccccaacctcatatcctacaaagtaatatcccacgaacacaactcccacaaaatgatacaccacaaatacaagttccacaaacccaaataccacagattcaaacatctttgcccaacttcacacatacgcaatcaacaaacactcaagcagctcaaaaccatcaccaagtcccccaaggtttttcccttttccatatgcaacaaccagagatgatgtttgaacaagggtacatcccacaaatggccaaccatatacaatatgcaggtcaaataccgaaccaagcctttcaattccagcccacacaaccctattttcaaccaaccagagcaatagatacaaagaatcccttaagtcaaaacctgcaaatggcaccttggccaataaacttcaagttgtccaacatcacaaagtacaaaggagacacagatcccaatgaatacctcagagtatatgagacagcagttgaagcagcaggtggagatgataccacgaaagctaagatactcccaacaatgctagaaggagtagcattatcatggtacactaccattccaccaatgacaatctattcatgggaacatatgagagacacctttcgagcaggattcattggggcgtatgaagaaccaaaagaggcagatgacttgtatgccatgaagcagcttccaggggaaacattgagaagtttcatcgtgaagttttcaagggtaagatgtcagatcaggcatgtagatgatgaaatgctcatagcggcagcaaaaagggcattgctacccggtcctcttcgttttgatcttgctagaaatagaccaaagacagcaaaagacttgtttgaaagaatggaaagttttgcaagaggagaagaagatgagttgagagtgcaagaggaagaagccgtcttgttgggaaaaaagcagtcaaagaacaagcaaatttcccaaggggaagaacaaaagggagagaataccggaaagccctggaaaaagttcaagtatgactataaataagatcagaaaaaacaggtaaattttatcggagatggatccaacaatgaaagagaaaaaggaaaacatcaatgggacaacactcgcggagggagaaacaattgggggcaatctg

SEQ ID NO: 51386 - DNA, 3942 bp, Oryza sativa
caggtaaatcgtgtcgggacaagctatcagtcgaatccaccagtatactcaaaaacggtaatttcctttgggcctgaagatgcagaaggaatatttttccctcatcaagatcctttagtggtctcagtggaaatagcacaatgcgaagtgcaaagagtgttaatcgatggaggaagttcagcggatgtgctgttttacgatgctttcaagaaaatacaaataccagaagataggttaacaaacgcaggagtacctttacaaggttttggtggacaacaagtacatgcaattggaaaaatatctttacaagtggtctttggaaaaggcactaatgtgagaaaagaagagatagtatttgatgtggtcgatatgccatatcagtacaatgcaattcttggaaggtcaacaatcaatatttttgaggccataatacaccacaactacatatgtatgaagctcccaggaccaaggggagtaataacggtccgaggagaacagcttgcagcaagaaagtatgagcttcaaggaacaccaagtgtgaaaggagtacatgtggttgaccaaaaacagggagaatacataaaaatacaaaagccaattcctgaagggaaaacaaagaaagtacagttggatgaacatgaccctggaaagttcattctgataggagaaaacttggaaaaacatattgaggaagaaatcttaaaggtagtaaaagaaaacatggctgtatttgcatggtcaccagatgagttgcagggagttgatagaagtctaattgagcacaacctagcgattaagtcaggatacaagcccaaaaaacaaaaattgagaagaatgtctacagatagacaacaagctgcaaaaattgaacttgaaaagttgttgaagacgaaagtcataagagaagtgatgcacccagaatggctggcaaatccagtgttagtaaagaaggcaaatggcaagtggagaatgtgcattgactttacagacctcaacaaggcatgcccaaaagatgattttcctttgccacggatagaccagttggtagatgccacagctagatgcgaactaatgagtttcttagacgcatactctggctatcatcaagtttttatggtgaaggaggatgaggaaaagacatcatttataacaccatttggaacttattgttttatcagaatgccatttggtttgaagaatgcaggagcgacttttgccaggctcataggaaaagtcttggctaagcagttaggacggaatgtcgaggcatacgtagatgacattgtggtaaagagtaaacaagcatttacccatggcaaagatttgcaagaaacatttgaaaacctgagaaaatgctcagttaagcttaatccagaaaagtgtgtttttggcgttagagcaggaaagttacttggtttcttggtgtccaaaagaggaatagaggcaaatcctgacaaaatcgcagcaatccatcaaatggagccgccaaaaaacacaagagaagtgcagaggttgacaggccgaatggcatctttgagtagatttctatctaaatcagcagaaaagggattacccttcttcaagactttgaggggggcaaacaccttcgagtggactgctgaatgccaacaagctttcgatgacttgaagaaatacttgcatgaaatgccaacattagcaagtccgccaaaaggtcaacctcagttaatgtatgtggcagcaactccagcgacagttagcgcagttttggtacaagaagaagaaaataggcaagtgccggtatactttgtctcagaagcattacaaggaccaaaaacacgatactcagaagtagaaaagttgatttatgcaattgtgatggcttcaagaaagttgaggcattattttctgtcgcatgacataacaataccatcggcatacccgataggagaagtgttaacaaacaaggaagtcgcggggagaatagcaaaatgggcaatggaactcttaccttttgacctgaaatacatatcaagaacagccataaagtcacaagtactagcagattttgtggcagaatggactcccaatgaggtagaacaacaggaagaagtcgaaaaaccatggatagtattctccgatggagcatgcaatgccgccggagcatgagccgctgcagttgtgaaaacaccaatgaagcaaacgttgaagtattctgttcaattagcttttccttccacaaacaacacagcagagtatgaaggcgttttgttggctatgagaaaggcaagagcgctaggggctcggcggttaatagtcaaaactgactcaaagttggtagcaggtcacttttccaaatcttttgaagcaaaggaggaaactatggctaaatatctggaagaagcaaggctgaatgagaaacatttcttgggaataacggtaaaagccataacaaaggaagaaaatggagaagctgatgagctagctaaggcagccgcaacaggtcaaccattggaaaattcatttttcgatataatcacccagccaagttacgaaaagaaagaagtagcatgcatacagagagaaggagattggagagaaccgatcttgaaataccttgtcagtgcacaacttccagaaaaggaagaagaagcaaagagaatacaactaacgtccaagaaatacaaagtggtagagggacagttgtataaaagtggagttactgctcctttgttaaagtgtgtaacaagggaagaaggcatgaagatggtggtagaaatacatgaaggcttgtgtggagctcatcaagcaccacggtcagtggcttcaaaagtcataagacaaggaatctattggccaacaattatgaaagatacagagaaatacataaagacgtgcaaagcatgtcagaagttcggtccaatgacaaaagcaccacccaaagaactgcaaccaattccgctggtttggccttttacagatggggaatagatatagtaggtcctcttccaagagcgaagggagatctgcgctttgtcgttgttgcaattgaatacttttcaagatggattgaggcagaagcagtggcaagaataacttctgcagcagtacaaaagtttgtttggaagaacataatatgtcgatttggagtcccaaaggaaatagtatgtgacaatggaaagcaattcgaatctggaaaatttcaagacatgtgtaaaggccttaatttgcaaatcaactttgcctctgtaggccatcctcagacaaatggagctgtggaaagggcaaatggtaaaatcatggaagctatcaagaagaggttagaaggatcagcaaaaggaaaatggcctgaggacttgctatcagtgctttgggcactaagaactacggtagtaaggtcgactggcatgacccctttcagattggtttatggcgatgaagcaatgactccaagcgaagtaggggcacattctccaagaatgatatttgaccaaaaagatgaagaaggaagagagataactcttgaaatgctagatgaaataagggttgaagctttggagaagatggcatcatacacagaaggaacaaagagctattacaaccaaaaagtaaagacaaggccgattgaagaaggagatttagtcttgaagaaagtgctcaatgaggtagctgttggaaaactcgagtcaaagtgggaaggaccattcatagtcaaaaagaagacagaaacgggagcattcaagttagcatatcttgatggtgaggagttaaagcatacttggaatgctatttctttaaagaaattttatgcctgaaaaaaaaagaagagaaaaaaaaagaaaaaaaagagagagagaaagagaaaaaggagaacacgggagctcgagtttgtagtatactcactcagatgtaaatacgaatgatatccaagttaatgtatataaacaggacgtagggttttta

SEQ ID NO: 51387 - DNA, 22899 bp, Oryza sativa
aagtcaaatacattcgactaacaaagtcgacaaaatagaactccgcacgctcggagtcaaatacattcgactaacaaagtcgacaaaatagaactccgcacgctcgaagtcaaatacattcgactaacaaagtcgacaaaatagaactccgcacgctcggagtcaaatacattcgactaacaaagtcgacaaaatagaactccgcacgctcggagtcaaatacattcgactagcaaagtcgacaaaatagaactccgcacgctcggagtcaaatacattcgactagcaaagtcgacaaaatagaactccgcacgctcggagtcaaatactctcgactaacaaagtcgacaaaatagaactccgcacgctcggagtcaaatacattcgactaacaaagtcgacaaaatagaactccgcacgctcggagtcaaatactctcgactaacaaagtcgacaaaatagaactcctcacgctaggagtcaaatactttcgactagcaaatttcgacctcgtcactccttcgaaaggtgaggaggacggcggttttcgaactattttgccttagtccaaaaccagctcaggaatgctcgaactctattctcgttcgagctcaaaaagcggaaaatcagcgtgacgaggtaaaacacgtttcgacctcgtcactccttcgaaaggtgaggaggacggcggttttcgaactattttgccttagtcctaaaaccagctcaggaatgctcgaactctattctcgttcgagctcaaaaaacggaaaatccgcgtgacgaggtaaaatacgtttcgacctcgtcactccttcgaaaggtgaggaggacggcggttttcgaactattttgccttagtccaaaaaaaccaactaaagaatgctcgaactctattttcccctcgctcgagctcaaaaggcggaaaatgcacatgacgagataaagtacgtttcgatttcgtaacttcttccaaagataaggaggacgtagtttacctaagggtgcttgcacaattgaaataaagagcatttataaagaaaagaagaaaggaagggtttatttgatgttaagaaggtataacaagttacatacaaactctacaaagaagaaagaaaagagtcgggataaacaatgttgagaggagaaggcattactgtatatgaaactattgaataacgccttttccatattctacgttggcgttcggatggttggaagttttgccaaaaggctttactagcaagattattgttcgaacgccgttccctaaactcaagtacaaagtcacgtaaactgtcatgtcgatggcttcgttgccatcggaaaaacttaaaagcaaatatacaagtattatcataataggcttcgagttcgtcatcggagatggcggtcctggcagaagaaagctttgcagggtctcgaaatgctaagtgcttcacatttcgagtaggcaaagtgttgttgcgtcgaatcacaagttttcgattcgagttaacctgcagccccccaaagaaagggaatttccatgaaaagcatgcaataagagaaaagcattatagtcagctacactataaatttttacaataaaggctctcaaccataacggttttgaagcagcaaaatagcattgttttcgaacatacgaagcatccttaactattcttttcacgaacgtcacacctgtgcgctcgagctcggagtactactgtctttatcttgttggctcgaactggccggctgtgactttaatcttgaggcaagagatgctcggagagacctcagggtatcttcatatcctttcttcttccagtaaagcacttggaaagcctttacgatgggttgagctgcatctcgaagctgtgcaaatttggcctcatcattaagcataccttgtatatcagctttaagggtggtaaagtgttcacacccatttgaacgcagacaggccgaaaggctctccacagcagttttcgagcagcgagatgcaaagggagtaacgctatcttttagcccaatggaaaattcctcgaaccattttcccacagctgctaaagtattttcttccgatagcaagctgatgtcagcccctagacttcgcaacgcgattcgaacggtctcgcaacttttcagaagaagttggcggcaactttcgttctcgagctctaaagcagatatcttctcgctttgatttttgcaggcgagttcgagttctttattcttcttctccaagacctcaacttgttccttcatcttgtcttctgattcagcgcgttgtcgagcgacgtcttgatactcgatgatttttcgctcgaatgctttttcacgagcgagtaatttcttcttttcctcagtaagcaacttcttttcttcggaaagctctttcttttcgccgcttaacttgcgcacgagatcggtggtgattttcttctcgtcggccattcgatcaagtttgcagcgaagataatcccgatccttttcgagtttagcgatgcgatcaagtgatttcttccatcgcgtgcaaatagctcgaagagctttccgagcaacaccacgttgaagacgagcaaggctcgcagtctgcgcatcagaaaataggttttaagtcaaaaaaaatacctgtgcagcagatacatcaagtgctgcccaagaggacataagatcattttcttccaaaaactccttttcaagatcaggagtaatcagaactttctcgagttcatcaccaatcgaactcagggggtggcgatactttaggtcattcaaacacaagtttgggccatgatggctactttccccgagttcattgaaattaggaagacccataagccaatgtccatcttttgcacatcgttcgctaaaaccaccaagaacgttttgtatcagctctggggaaggggttgcgatgaacggcagtgacggaggtggagtggggttcgaactacctgtaattcgaacacctccatcagcagcactcttccctgcttcggacttttcggccgcattgacgggcgtttttgccttttttgcaaccaaatctctatcagctcgaagagggtttgttgtctcaacagtatcacccacttgggtcgaacaatcttcatcgacaaccgtgttggctggggcaacaacatacagtgaagctacttcttttgtcgaaagggcaaaactagcatcagctcgaattggggtgacatggatggcagaaagatcaatacggatatcatcttcatccaactcttcatcactgtcaataacaagctgcactcatttagaactcggttcaggcggaggactgctggcagttttcttccttttcaaatcagctaaaacagtaggaggaggaaccgttttgctatcatcagattcagacgagtcgctcgagttgtcgctcgaactgttactcgagtcgctatcatcactcgagtcgttctcttcttcatcagctccttcctcgccttcttcttcttcagcattttcttcaccaatttcttcgtcaacatcttccaattcaacatcatcatcatcatcatcagaagaaggcttcacagatttctttttctttagtttggggacaatttcaggatgaacccggacagggatatcggagcctagagaggcgaagacccgattttgccttttcccgttttgaagtgtcaaaaatttcaaatgctcatccttggtataagggccaagaaatttccgaactgggcggaccatatcctctggaatcacaactacaaggaagaagataacaaagggagaaaataaatcttcttaactaagtcactttttcaagaaaaacaaggttcgcaaaaaatcaagttcgaaaaggaaacttacgatcagacgaaaccacaaatggaggaagactggaagggcaatcttctgggatttctccaagagtgatatcccagccgctcgaaagaggcctaattttgagaagaacaaactcttccaccaggtctcggcagctaaagttcgaaacaagttcttcgattcgaggttgtatggcagtgaactccggcgacaaagagactgatggctcggagacagctttcggtttcttcccagagaacgaaaaaggacaatccttatcattcagcaggctaacagggatttgatgataaaaccacttcgactgccacttgttcccccattttgctcgaatagcagacacagctggccatggacttccgcgcttcggatgaggagcaaagtttacacacccaaacttcgagttctgtttggtgtagtgccgagtacaatggaagtatgcaaagtcttcagcttggagagtcccaccgcagcttcgaaccatctattcgaaaagcccaattcgaactaaagcattcggagtcaattgaggaaactcaagtttgaacaatttcaggacctcgaccaaaaaagtgctgcacgggaatttaaacccggcgtagaagaaatcctcaaacacaagagtgtatcccagcttgggagaaggccttgattctcccactggtcgaattacaacatttcgaccagatatccaaccaacatcaacaagatcgtttaagtttttgtccttaatcaaagaggcaccaataccacaagaagtattttcgtggttttttgatttcttggacttcgacttttccgcagttttcttgtttttccccatgttgtgtagtgagaaaggaagaaatcaagcaaagcaccaaaactcgaatggaagaaggaagaaagagatttagttcgagtcttttgtgatttcgagttgatggcagaacaaacgagtggtggcgtaggtcacgtgatagcgacccctcctggccttatatagcgcagggtggtaagggtcgcgggtttacgagcggacacgaaacccaaagcgacgcgaccccttaagcgcaccaatgaaataccagcacgtggcataaaaaaaacaacatttaaaaaataataaataaataaataaaaataaaaaataataagaataaaaataaaaataatgaatagtaaacgtggcatatatgcatatttgaatagtgtgtttcgaccgaataggaggacggcggttttcccccttttttccataaactcaagcacggtttcggccgaaaatacacatcgcccttacccgtgaggggcttgttgtagcagggtgcaaacaccttttcctccaattcggtcaaaacactacgaggttttgcaagacctaagtatccagaggggaaaacactcattctgagtggaaactaccttttcaagaggaagaacaccttcccaaaaggaaaataccttcctagaggaagaacactcattcgaatagaaaatacctctttgggtgaagaacaccttattagggacattccataatcgctaatacaactacacatattttggacaagttacaatttcacaggtgttttccaaggatgaaagagaaggcaaagggggaattcgaattcccaggaggaagaagacggtccaggacggaaaatgcatttttcccaagagttcgaggaagagcactacccgaacaagagaagatgccaagggaagattccctggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccaccggtaataaaagccagtcaaaaacctgtagcaggacaagacatcttgaatacaaaagtaatcctcaaaagttgtgtttgctgttcgagctcgtttctaaggataggcgggaaaacacttctttccggcctatccccgatcttgttcgtgacctaaggtcacaacaaatagccattggattaaaaagcaaacaaaatagatgaaatgaacatcagccgttggatgaaagatgatcgagaaagaagattctggagtatgtactactgcatgaagcaaaacttattaatgaaagtgacaaaatcaaccaatcttacaacatgccagaagaattctacaaaagggtccactgctagagtagttctgaaaaatgcaatagttaattacataactttaacataatcatgcctttttatttccttaaaaacgatggatgaacttagagagaatctactgtatgcataaaattccaagttgaaattcatactgtgttgagagtaacaacaagaaatgcaatagattaaaaagaagaagaaaaaagtcaaatgctacagttcacagcaaacttacctgtcttatgtttgcttgctagaacactgtttgctacatcatcgtttcttttctcttgaatttttcatataaaattgacttcctgattttattaatagcagcaaccctattctggagttcatctggacaaatataagggcagtgtgcaaaccaaaacataggactgtcggtttcaaaagaagaagaagaagaagaagaagaagaagaaagaaaaagaaagccataggattgtccatttacccaagaaatctatttttgacaggtttaccatcatgacttattagaagagtgaatagaccatcaatagcaacagcccctattaacagtccctgcttcactgaacttgcgttctttaattatgagaaaggagggataagaggttgacaatgataggttatagaacattaaatgagtctaaggaacagaggccgctctcccttgtacattaacacatggtttccaattccacaaacacttaatgatcaccaataattctaatcaagataaggatcaagcacaagaataccataaaatcagcacataatgctaatacccagcacctcagagacagatggaacactgtgtttgttatgagtcactatctgcatatgcacatgatgccatctgccatccgataacaaatctgggatgttgcgactataaatatcgattatcaggtaaaggagtgaccaacgttagagcaaacgttttgaaagctaactaaaataaaagggaccacctatatatttgtcgacaaattttctagtaaaaatttgacagatgtaattatagtacaatcgtagtgtaattacactataacttgtatgtaattacactgtaacttgcatgcgactatagtgtaacttgtatgtaagtttcacgtaattttgaatcgttagatctattacaagatttgttctggtgaggaagaaaaaaatcatagcacacacatatgtgaaaggatttgttcccacgacctctattttactgaaataacatgttaccgagagattcttgaaagttacatacaagttacattatagttacagtgtaattacatgcaagttccagtgtaattacactacgattgtactgtaattacatctgacaaatattaggggaagaaatttgatgacaaatatctagcaaaatcgaaataaaatagataaatctgcaggtaaagtaaggcactctataaaagaaccaaactaccaaagcttgttttgtctttcacattcatttcaactcatgaaacgattgaccgaagcaagagatgttattgcataaccacataggcctagttaatatatttctgacatatatcattgcttaaattcctggaagtcatagttatgttgagcagtttggattattcatatcttcaaatatacccagtatgcatgggactggttaaggttccaactctcgatatgagtaggtacaacgtgaatgtcgtcaaaatcagatctttttccaaggtaactagctgggtggcccgcgcaattacgcggctattatctatataaaattatctattttaatacgattttatttaaaatttattgaatagttatcttgttattttaatacttttaaagaccaaaccatatcatctccgtgtttaattttatagtttttaaaagtcatcctattccttatctgtttgcttgatctattactatttatatttattctcctcggaaactttaaaattttgtttttatagtttttagagtttattgtctcattgagtttcgtttttataatttttagaagtcccatcaaacattgccactctattcctctactgcccatccgctgcctcctctctttattattactgggatttttaaaatcgaacataattattatttgggttcattttttactttttagaagtcccgtcaaaccattagcggctttgccactatactcttccacagctcgcctgctacctcccctctttattgtcattgagattttaaaatcaaatattattatcatttttttttactttttagaagtcctgaacttttaaaaataggacctggtagtttttagagtttattgtctcgtttagtttttagagtttattgtctcgttgagtttcatttttataatttttagaagtctcatcaaacgctgccactatactcttctacagtctgtctgctgcctcctctttttattgtcattggaattttaaaaatcgaacataattactgtttaggtttttttattttctagaaaatcccgccaaaccattagcggctttgccaatgtactcttctatggctcgcatgctccctcttctctttattgtcattgagatgttaaaatcgaacattattatcattggtttttttacttacattttagaagtcctgaacctttaaaatttggaccttgtagattttagagtttattgttttgttagatttcatttttataatatttagaagtctcatcaaacgctgtcactgtactctatgtaccattgtttagtactaaagatacaattatattacatgtatttatgttatcaatcttcaccgttctaatttggttctaccacagtctaacggcttggattttattcttcgattaacgtgataatttataattaaaatagtcttcacccgttgcaacgtacgggcaatttttctagtataataatacttctgagtttcttttttcacttaacaaaaattctagcatgaaaaaagttacaaaactcttaaaatttctactattagaaaccatatataaatgcattgtttactaatagaaaaaaaattcctagcaacataatcaccttgaaagattgaatggcaacatatactgatatacagtaacccgtgtatgtagttgtatgagcgttttcttgtggattcaggtttatgtttgctcagttggttgctttaaggataacacgatccattaattaagtccatgtccgtttcacacgctaaacagccccatgtgaaaggagtccggatccaatacaaagttgaattttgtgcttatacatctagtatttgtcagtgtggactcctaataggatttatgtaaattttttctctacgtatatattccatcaatctcaaccactaaaatctagaggtatcaagatctaatggctaatattttttctttttctccaattaacgtgggattttctagcctctacatcgaacgtgatgtcttcttttcgagctgtcttaataatataatagatattgataaaaacaataggagtcattgccccaacctaaatggcaaaatactcatttttagtcatagaacattaaataacactaacccaccatttgatcaatttcagggtggtgcttctttcccttgtcgtagtacatcatgatttcgtccagtaaaactcaaccacgggagcgtctcactgtctgcaagcaagcaacaaaaaatcactaatcaccacattttacaccctcgaggatcagtttcagaaccatcaacagttgaatactggacaaatctctcagctttcatggcaatgctcatgtttcagcacacacactcggatacagtatcaaatttgcaaagggagaaggcgtctcatctgataacaatcaccccatcctctcaagctctgacagtccttccagtccaactatccaagacccagtgaagcagcaatgctacgttagagcccaagactacacgcatactgggccacaaacttttcaggcccagtactactctgcctcactgagccgcgctcgactgggcccgtgtaatgctattgttcttttttttgacgtaaaaaatatatttttgacgtaataatgctattactctcgttcgatgtcggcaacagtggagtgagcaacagagtcaacggccatgcacaagcctgcagtgcagagcacagtactgctacgtccgcgacatgtcaagcacgagaaagctttggtaccggaattcagcaacgccagtagtgacgagtggtcacgagctagactagcacggatcaacacacagaagttcaagacaaaattggttctggagcattgaaagttgtccattttgattttatagcatccaaagttcacatctcattttgatagcatcggaagttacatccgttgcttctttttagcattccgtccaaacttccgttagttttattttctaattagtattattcttcaacaaaaaactaaatcaaaccccaatggtggccctcttcctcttgcttgtcacctccaaacagtagtcgtacaggagctcagagcggtcagtcatggtgcgaacacaggatcgatgctggctccacaagctcgtcatgtaatacgtacgtgagcccagcctcacaagctgatcatccgcaagccactgtgttcgtccgcgcttgctaggtgtgatctatccactttctaggctctagctttgcccggacagcgccatcgtcgatcgatctcatctgccattccgccatgctagagcttgttcaaatgcggctgtgccgcttccgagttcgtccgcgcgcactgctctcggtctctctcctagatgcgtcatccgatccatgaatgcccgaagcgaagcaacgtcctccagattattatcggcacccttgagctcgctccgatatgctgctcttgagctcatccatcggcccccgaagcaccaccctcgcgctcgtcgcgggctcgcctgagtaccgacccgctcctccttgccctggatccgttgtctgctgacccaagtcaagagccgccgcctctagcttgccagaaccagccaccatccaaggctccaactcgctcagcgctatactgtcgtggtcgagctcacctgctgccttgaatcgaagagtggtcaaccataggagggagagtgcaggaggaacaagacagatgtaggatggggtgaggagacgaactgctgacggaatgctaaaaatagtaacggttccagttttgagtgctattaaaatgaaccataaacttttagtgctatgtaaccaaaatcgagtactttcgatgccatagaaccaattttgccaaagttcaatggcctaatcttttcacttatacttatacttatcagctaaaatttaaatttatagctttaaatttgaatttaattttagactttttcatcgtagtttatttttagcctttgtttttatatcgttgagaacacgtatataaaagtagttattcataaattatttttttatttgtaaatactcactttattcacaaaagttacgcatattagagcaggtacaatagcaagctacaaaccagctataaccacatatcgagaaaaaaaggaagagagagaagaaagcgggatatagatttgtagccggctgcaagacggactccaagacgttatgtgtatgagatgtgggaccaagtattaatggtgtagtatatttttatagttaactattgtatgaatgggctattagactagttatagatgatttggagccaacagttgactatactattaaacttgctcttacttttgacaccaaaactagggaaaaattaaatcaccttggatgttacaaaatcaatgagtgaatgcaaacatacaaccaatgagtatttagatgactctttggcttctaataaaactcttcatttaagttctgaatatataaagactacaaatagaaatagcttattggaaaaatttaaatgtaaaatatgtataacttttgtggacgaagggagtatatcgtttgggttattccgccgaacagccaaacgatgggctgcaaaagtctgagtccgcccgggcagacgcggccagaagcggcgccgtgcatgctcgggatccggaccacaccgacggtcgacgactcgccggagcgcgcgcctcaagaacaaggaaaaaagagaaaaaaaacacggcgtcgcgcgccccgggcggcggccggcgcggagcggaaatcgagcggcgagcatcgcgcgtgcgcccgtgcggcgacatcgggcgcctcggatctacccaaccatacagatgcagcagctagcagtgggatcatgtttggaagttttattattattattattattattattattattattattattattattattattattattattattattattattattattattattattattattgtcttctcacgggcacagaaagataggccgatcgatgagagattaattaattaactagctaaacggtggctttaattctctgctactggtgtactaactccaaggtgcattggatggattgatcattagctgattgattagggttttaattaatcttgagctagctagctacaacgatctcgatcgatcgattgacctgccgcttgttttgtcattgttttcttgcttggtagcagaagtacagtacaagcataagtaaactgaaatttaaaatggatctacgaagaaaccattgatgagtgcatggatatatttgtcaatttcttgtatcaatttttctgatggtactgtgctgtgttctggcttggttttttatgtatgcatgcccacttgcacgcgtagaacttgttctacgtacgccacctttgacaaccttgccgcagtgcatacgtaacgtacgtacgtactgtatagtggtggggtgtcggtactcgcgtgtcttcaatattgttgtgagcaaaatctacgtgtatacgtagacgatatcaaagtaatacgtacacgtactaacctactagctagatggcaaatggacaaaccgtagtagcagattttgatgctcaacagatcgatcacatgcatgttccaatttgaacgggagaaaatactgaaatttaagtttctttcacctgcagacttagcttttcaaacgctctatatttttattcaaaatttgaaaatatatctaggttctctttaattagtataactccagatctcatatccatgttatatttgaaatttatatgtaaattatactggtttaaaattttatatgtttcataaaatgagaacaaaacgatttatccaaatattattaatgctatccccagatccacgaattaatggagctagagacaccccgatctaaaaattctcgagtctgaaattgtgcaaaacgggaattaatgtagttacgtggaatttagaaaataagttagaaggtaaaggttgaaaaaaccagcttatcaaaattctcacccattgacttctcataagttagttatcaaaattttgagcttccctagacaaggggcttcgattctatgtgtgcgtccatctgcatcaattctgtatagtgatatgtagagggtataagattgtaaatacctgaaggtaaattacctataactagatgtaaccatgttccaatacaagtcatcgccgctatctgttgtccatcttattccgccgttctattatacatgccatgcatcgtgtcgatcgatcgcaagggccgtagcaatttgacgatcaaattttacatcgaacctcgttcattgtacgcttcgcaccgtgacatctactctaattcctaattagctacgccccaatctgcataagagtgccgcagcatatgggcacggcttaggcgccggccgctccgtgacggaacgggcaaccgcggccgcgcactcgcttgcattgacctgtcgcggccggacgaacgagccgcgcgcggaacatcgcgtccgggggctccggatcgcggtcgaccgccccgcccgcgcgcgcgcgcgtccacgtacgtgcggcgtgccgttccttccttccccgacctcacgtgggcgcgcgccgtgcgcgccacggccgccgcgcgctcgcgctcgcgcgcacgtacgcgcgctcgatcgtacgggacacccggggcggcaacgccgagacgcgagtgagagacaagagtaaaacgcgcgcgcggtgcggtggcagcagcagcagcagagcgcgcgcgctgcgcgtaccgcgagtccgcgactgtagtctgtgcaggggtcgcgcctcggcttcaagttttcaacggtggtagccacaggccaccccacatctccacttgtgctgttgtgcaaccgctcgcgcgcatccgtgtccgtgcatgtgtggaagaaaaaaccttttaagcatatgcatgtgcagcagtgcacgtacgggggtggtgatgaactggtgaggccgttgtttgtctagctcgttacaaaacctctaccccctaattcgttctcacgtcaagaagagaaacgtaacatgccgtaattctcgctgtaattcagtcattctgatacggcgcgatcgatctctgaacagtattgaattctgaaatagtacgtctgctactagtactagctgagctactgagtttagcagtaaaaattgcgcctgctttgccgaggtttctgctgtaaaaatattccatccacgtactacctcttatgcccgtacgtgcaaatcaagagagaattcagagcagtagtagtaccactccgttttttacccgaactagctaaattctttacccgtgcagaaggtatatcaggcgggcaaccgggtccagcgtacgtccgtacttcgatcaccttgcacaagctaggttaatgtccgggccggagatagatcggaaacacatgacacatctgttgcatgtacacacaaaagatctagctgcaatatactccgttgcacggttgcaaggtgattccgatttcgaagcattcatcagtgcaaccggccggggacgtgatcgagctgggccatgcaccgcatcgatcgctgggttggtacacgcagcagcaccggccggtttgcttgctgctgcaacgatcgatccagatgaaaatcagagcgcgtcgcacgcgggaatctccgtatgatacgcgatttccccctcccgcgcgcgcggccgcgacggcgcaaccaccgatcagcaggacggggaggggtagttccagtacgtgctcgccacggccgcctgattgactgctgctacgaaatgcacaacgtcaaaacggagaggatcggatcggacggctacgtacaggtacagcgccagtacgcgtgcagctacatcacgtctccgagaccatttcgctccgataccgtattgagttttccgtatatcaaaaatcattagctaaaccctagaaaaagcagcagcgataaaatttgatggagtaatagatatactacatccgtcccaaaataagttcttttttagctttctgtatctaaagtttgatcgtccgtcttatttaaaaaaattacgaaaaaataaaaaaaaattagtcacatataaagtaatattcatgttttatcatctaataacaataaaaatatactaaaaaacaataaaaatattgatcataatttttttaataagacaaagagtcaaacattgtatccaaaaactgaaaaataagttttttttaatggaatggaggtagttcatgagtttagtaaacaaaattttaaatcgtagtgctcgtaaatattacacacgagcatataatttcggtaggattatagtatggttttgaattcacttctggctttggttttcgtcattttaacatgtgtacaagagggggctcatttacgtgcgtgtgtgtcctccgtataattgaaaagattattatctgataaataatacacttgtatatttttgccaatatgtggctactggctgttgcaactttgacagtacaacctgaggggagaagagaaggtgccgtccacggatggcatcatggtaagtgtagctgcagtggacgtcgccgtcggacggcctgctggtcggtcagtcactgcagcatgtaggcaaggcaacagaacacacgacagaacaagacatttgcgatccgtcttgctacagatttttcctacagaaacttgcgcccggtgtttcagattgtgatgtgagttggaagcgtgcgaccgtgtgaatgaatttcgatggctataaaccaaagcaggggaaataccaggtgctacggtaacggtagcatcaatgcatcatggtgccgttccacgaaatattcagggaaaaaaagagagagtacaaaatgcagagcgtgctgtcatatagtacaatcttgcaaaatttcaattccaaattcagtgacacacacaaattttgggccattctgactccacttcttcgattctttggtatgatgaagtactacaaacagagcatgcagatgtagttttttttttcagacaattcaacgcatttgcgcgcaaaaattcccgtaatcgcattcgtttagtaacggttcatggccgagtacacaccaacgatcaaatgcaatatgatcggtttacatgacagtaggatagatccagtctggtaaatctgccgataaatatgggtaccggattacagtcaatcccattctgggagctctaattaaagaaaactgaattgcctccttgaaattgcaccagtactaggaaaccggcaatttttgccttcaaaattgccaccgtgctccaccagctgtacaattgagaatagctttaatttaccctacctcgctaagttatcgccgcttgtatctgttagtatattcagcctacgcgccgtcttcgtgaactcgctgcaaattcagaacaggtactttagtccatcaagtattatgttcggtacacaaggaagaaagaactgtagcaaacacgaattgagaacgatggtttcttggacataatggatagaaggtgttttggtgtcccagcttggaactcctctaaagtcaatgtaccatatggatgcttccaaggcaagaagacctagagtttgggtgcttcaagttaagctaacttaaatataccacttaaaagcctagaaatatcacaactacgacaatgtggacatttcaatgttcttaaaatgatagccattagccaatttaaatggagttataaaggttaccatatgcatcttatcagatgaccctagggaaaatttgaagtaagtaccagcgcattaatgatttgtttacagcataaaacccgagaaaataggataaacggccttctatttgatgagtggacatgactaaataactaaccaattcataaaacaggaagtattctgcttgaacaaactataacaataatctaaaactggactgacctgaaaggttcatctccagtgtgcttgagtgccccagccgcatcacggtagaaaacatgactcatcagctcagctttctcgatgccgaacatgtcagcaagccgccggtataattcctcatatgaaccaacaacagagagatcaagtgtgcgcccgacatcctccgactgcatgaataccttgcagtgccctgtttccagcccaacatcaagtaccttgttgtcttggcacaatggaactcctccacatgacaaattatctgtggtgccattctgattacttctcgggcttgaaacatcggagttactcttattcaccgtattttcagcattaccatcagaagagctcttcttaacatccaccgaagcagcatcacccaaggatatctgctgctctgtgagtatgggttttccgaaaagcatcagctgggctggcgccttcttgccatctgatttcttgttgttctgggggctaccaatggtcaacaagcatgagatatcatcccgagcagccggatgaccgataattagaccagcggcgatcctcggctgcatgccgtgatcaagctggtgaaagccgtggggcgatagactcgactgcagtttgttaaggtggagatctgataaagatataccaaattgagcatgcctggctccctgtatgcctgcaggagtgccatccgggaaatagcacataggaccaaccccacgggcgagcgggtttccatggaacatcggtgtcggaaattggccgtcgatgggaagctcggggtacaacggcacgcaaagcttcttccgtggaggcgagaatggagcaaggtggatggccggcatgtttgacacaagctcaaccaaccatgggctcaccctcttcacattctgtaacaagtccggttcatcccatgaaacctgcaaaagccattcccaaaacatcaatgcaagcaacaaaccatggacacgatcctgaataccaataatgctactggaacattttgtttgcagttgcagtagtccttcataggacagtgcactttgagacagagaattcagaactggattgtacctgaagaagcctccatggtgaattaggcatctaatggggtcagcaacctgcacggccgatacagtgcccatgaaccagctgatccttgatgagtcctccgtctcgaatgccatcttgaacctcatgccggcgaaccactgcgtccgcatcgccgctctgaccgccccggccttcacgcagaactccggcgtgctcgccctcgggtagtagacgacctcgaatggttgcccgctcacggcgagattggccgcctcgacgacctcctctggccggacacgggctctgaccttgcccctggccgccgccgccatcttgttgccgtcgtcgtcgcccctcaggaacatggagaacccgccgtaattgccgccggcggcaggtgtcggcggcggcggcggcggcggcggcaggaactccgggcctcccacgccccctttcttggcgcggcggatgccgacgcagagatccccgttctcggtgcgcatgaacacgatggagtcgccggcgacgagcttcttctggttcacgaaggtgctccaccccgtggtgaggaggtggcgcctcggcgtgccgcggtagatgtggcggaacttccagaccacgccatggacgtccttggcgaggacggtctggacggggggatcggcggagtagtcgagacgcgggaagatggtctcggcgcagtagcgcggcacggagaaccccccgccgttgttggcgtcggactgcgtgagcgtcttggcgaacgacgcgggcttctcctcctgcgccgccgcggccgcggcggcgccaatgccgtcgtcggcgtcaccggcgtagccctgctcgttggcgcggacggggacgaggcggatcttggcgaacacctcgtcggtgtccggatcggccatgaacctgacgcccgcgacgcggcagagcacgagcgccgggacgcgcccgcccgggaactcgacggggccatgcccctgcgcgtgctcggcgtggccttgcgggaagtagtacaccttggagctcaccggcggcatctggaccatgccgccggcgcaggcgtgccacagctgcgggtccaagcacttgtcactctcccgctcccgctccttcgccgcggaatccacgaaagttatcatctcttcgacgcaaaaatctttcacctccaccgatcagctcgagcacaaacaaaattcagcggaattcgagcgccacggcgatctttatggatgaaatttcccacagcttttaccactaccacaaggtgaagaagcttttcagctgcacagccgccatcatcgtcatcatcaatcagagctcatagctgaaaaaggctgggggaggagaaagaaccaaccaaccagcagagcagaaaggaggaagaagggaaaaaaagaaaagaaagaaaagggaacaaagcgagcaaaagagagaattttggctcagaaatcttgcagaaaaagggagacgcaacccagaaaccactactcaccttttctcacaagagcaaaagatgatgaatttgaagggcaatcttgacacagctcagctactactaccactactatcttctctcctccccctctgcagctcagctatctgctctgctgctgatgctgatgctgctgctgcttctgcctcctttcagtctctcaggtgagcagcagcctcagattcccccagactgcagctgacatgggggcaaaagaactaaatagagagagagagagaggggaaaggagagagaaagagaggagaagaggagtcaagggaagaagaggagcttaagcaagtacttctactactacccactagtacagtccactgttaactcctcttgtttagtggtctcgttgattaattaacactacttttcagttcaacccctctctcctcctcaagtactcgatcaacctgatatttttgcacaaggggtattagccgatgattacacaattattcacctctcttgtttggaaagtagagataaacaaatgcatgcagccgccctgcaaataaactgaattaaaatatttgtgttaaccaaaactgcatgacctctttccatgatcactggatttacatgatcactctcatcgctatctcgtgatttctttcacaaggggttcaaacaaactcataattctttctttgattcttctcagaatcaggttactagtaagttattatatgaaatctttttggtatgaaaaatcgcgaagggcaagtgtgtgagcgagggagggacacctcgtcgggcagcgggcactgccacgtgtgggtttaggaggaggatgatgcgatgggacgggatgggatgggatcggggagatgttttggtcggggaggcgaggtcgcgagaggcgaccgggcgttgcctcgagattcgcgtggccggcgcggccgaggcttccgcgtccactgctgctggctgctgctgctgctgcttccaccgcttggccaagctagctcggtcgcatatactcgcatgtgaaggttgcttgttctcttcccatcactacctctgtttcgtaaaataaggccacctttaattcaaaagaaattcatagaagttttggagaaatttatttttatagaaattttttctatatagcccttcaaatcaaaggaatggatcttatgaaatcctatgaaaatcttatggattgtctaatgccatataagttttggaggaattctaaaacctcttggaaactttcctttgagtctttatctctcctctaatttctgcgtttttcctgcggtccaatcaaacgaccattcctatatttttcctgtgttttgtaatcctctgttttacacttacattcctatcaaaattctacgtttttcctattactatgttttctcattcatgcgattcaaaggggcctaaaaaacacaatcttaaatacaccctttatccatcaaccaagaatttaaagtgttttatttatcaatataaaaaggaattaacttatccacagtgttataaaatcaagaaattatgcgtatgcatgctactgatgagtattaaaatgactttctagatttcagttaataatttaatttagcacttaaagaagatatgcacatcttatttaaaagaaccagaaaataaaatatgcccctatggagaggaaataatcttgagtcggtttgatcatcggttttaattttaggctgtatgcaaattgggactatcttttccagatttttaaaataaatttaggagttaaattcaatagtgttatgaatggcatattgggcagctatagaatggttcggattttgactccgcatccgtaccctatgagtgatgtgaccaaaagactcaatttatcaattaaaaagatttaaataataaaaaaatcttgttttgttaaagaacaatgtatcttcattttgaagaaaaaaagcaaatatgtgttgttaagaagagatggcttgtcttgaaatatccgatttctagtagtggaaccaccttccggtagggctgtcaacgagccgagctcgagcgagctcgtcagcctaagctcgagctcgatcaagctcgagctcgactaccgagcttgtaaaaaatatatatatttcaaagataacctttaaaaaaattaatttctagtttatcatactaataaaaaaggaaaaaaagaataaaataaatatattatgtcaatataagacatacaaataacatatttgatctcctaatttattaaataacaataaaaatgatatattactaggctcgttaaaagctcgagctcggctcgacaaagctcgcgagcttagggagaggctcgggctcggctcgtctggagctcgagccgagctcgaatcgagcctagaacgagccgaactcgagcagctcgcgagccttgagcttttttgacagccctaccttccgggctagtcgggtgcccgcctgggctctttgtccgatctctcgtcaccgacatgtttatgcaaaaaaaaaaaatcgatcactagtaaacgttcttcgatactcagacttagacaatgccgttggctcaaccattgattttagttttcaagcttagggtaaacttttctatagccgtacgtgttattcacgaaaaagctaacacgcgatcgatcacgcacggcgatcagccccctccccccacgttccttccttttttttttcaccgcattactttcctgttttagtaagtttatacacctaaagttggtacacatcaagtttatacatctaaagtttgtatacccaaagtttataggttaaaagtttatattaccggtttaaattcgaaatcgaatttggattcaaatatatttttatatagaatatttctatacataaagtcaagtttacacatctaaagtttgtatacccaaagtttataggttaaaaatttatatacccagttcaaattcgaatttaaatttggattcaaatatatttttatataga

SEQ ID NO: 51388 - DNA, 4304 bp, Oryza sativa
tgaaattcatagtgtggtaggaaggggagaaattgggagatgtctgcatgttaggggagggacaagggtgctgatcgcccaaggcgatcactcgcccattaggctggccctgttgttcaagcttattttgaagaggtaaaagtagcaactgtactgtatgtctgtacataagtgtgatctgatcaagtatttttggcgtgaattatattgccaaactcttgttcaaccacgctatatatcttgtaattaagtatatggcgtcgattagatgcaatcaggagtttaggactccctgtagtatttattttgtggaaattgctattcatacgatccaactgtccgactcacatacgactaaatttaatcaatagttgtaaacggctgtaatatatataaacatggttttttaatcgatttatgattatatgtctctagttatacataagttctacgactagatcgtaagtatagcaatcctctcttatttcgttggcatgaaacttgaagcacaagtgatgacccttcaagaagcaataactaaaactaaaggcatgaagtgtaacttgttgggcatggtccaatcagttcgctttcctttaattatcaaagtgtgaggttttttgtcgggcttggattggatctttctttgaaatggtcacaaaaaggaaaaaaaggttaataatatccgaaaagataagccatgggacaaagcataccactgaaagaaaaacatataggagtagctagctagcacaagcgagaaattaatcaacaaattaatcttgattagttcaagcgtcgttgaatgatctggaccgacaagcgtgtaaagatatggtcaaatcattcgctgtcgacaatattaatacacttgtctcttttgattggtcacataggaatgaccactgtagagctaaggtcatcatgattgttgtggacttgtgctttcgtttggtgatgcttagtttttgcttagtcgtcgtttggttagaataaatctttagttgggggggtttgatttcttaattgatcaaggtgggaatggaattgatgaaacatgcaatggatcccccacagctctcaaaatatagctctaattatgtcacatagaatgattgaatggaattgatgagacatgcaatggatcccccacatctctcaaaatatagctctaattatgtcacatagaatggtttcaatcaaatatttgttagttttgacaataggtataccaaacaagtacctactctatgggatgcatgaatttaacaccaatttaatatttcttatatatttatatgaactatgtatacattttctttggtatatatacctctaactgagcatatatatagtacctacttaattagtgatcgatctcttgtcagtgtccaattaagacgacttaactatgtttttatctgggccagatatattaacaataagatttgtgggtcctaacacatttggtggttaagcttaagagggatcacaataagtagtttagtactaagctgacatcatggctacaagactccaagattgcaaagcaacagatcctgcttaaaatcgttgtctcgtccaactcggaatcttgctgtctggactctggagagctttgcttttggtacaccaaccatggtagttgcttaaatgttcacacaattgagccaataaacctgggtgccatgtacttaatttaagttgctcgctgtaagtagctaattccaaaggataagagaagcataaaagatagtatatgtaacttgtagccttgtaggtacgtagtatagaacataaaagatgaacaacaggatatacgcaactctcagagcttctttggaatatactatttgaaaaacataggaatagagaaaacactaaaatagtttattaatatacgtggagaacagagaatttaaaaatatagaataaaataacttgtgatgtttggaatagtttattatgaattaatgcattcatatcaaatagacacacttacttatgatattctaaaattatagctatttgaagcgttgtacatttgcctcacacttagcaaggaaaaaaagagaggttccagttgatgtttaattcctaattttttttccaatgaaatttgtgcaaaggaaaatatccctcaactttggacctgttcgtttctgattctggatttcagatttcatttgagcgcttcacaagctcttaaaaagtatgcatgtttcgtacgaacatttatatttttctccccggaatactattccaaagccaatttttaactttgtagtaatagtcaatttattcatttatgctctcaaatacctctaaaaaactcagataatccatcagttataaaaaaaatctcaaacggggcctttgcctgtgtctcaatccaaaatgagttaatccttcacttttcctctaaaaacccatcgaaccataataggccttagacttatttcgaacaggggaattttgattgacactaccctccatcttctaggggaatttttattcacactaccctccatcttctggggccctgtttagatctcacctcaaaaattttcatccagtcacatcaaatattcgaacacctatataaagtattaaatataagcttaaaaaaataactaattgcacagattgcgactaatttgcaagatgaatctttaaacctaattgctccatgatttaacaatgtggtgctacagaaaacatttgctaatgacggattaattaggcttaataaattcgtctcgcggtttactgacggattctgtaattagttttttattagtgcccgaacaccatgtgcgacactctatataatatctgatgtgacacgttaaaattttacacccctggatctaaataccccctgaattctaaggaggacataaaaaaaagatattaggatccagaaaataggttgatcaggataatcatccaccagatccatccatagctaggttttgttcaggggagaattattgtttgcttctgcataaacagtactaggtgacagatggccactttattcacactaccctccatcttctagtagttcatgtggtacatcagaaatgatggatgcttggattatggatcagcagggagggaatattgcaagatctcccccaacccaaccaagccagccagctccaaagcaaacaaagcatggccctgcactaccgcatgtgtgtgttcagaagcacacacaacaaccaatggacagcagaggccaagtgatggggcaattggccatgtgctaaggcctgcacgcatgaatgcctccaatggaatcaagattggccaagctgtcctccccctcctattcttcacccagctaattaagctaagcctctgctgtaatacatacatttcatgtactaagtgccactgatacgtgggctgggatttaatccctctgtcctagaatatagcaacgtcctagaatcggatataacgtatcatagtactacgaatctggacagccgatacgttctatccgattgtaggttgctagtatattctaggatgaagggagtagatgtcagtgacacctctactacaggtacagtacaacagacgatttgcattctttgtcccagctaagctagtgatgctgtgatagtgtaacgtcatgttcgttttacacacgcatggaggacaccatcaagcttagctcttccccactctcagctggtggattggatgctaataatttgaccaccggaaagcacggggcactgccgcgacaaaagagaaggattggctcctcgccgtatgatcacctcgggttacaatctctctcagttactgtgtcgtccaggctaagcctgagcataacccggctggtccgggctggcccggtaagagaacccggttcggcttgattgggctgagattccatgccaaagcctggcccgattacaagggcagcatggctggctctttttgggccgggtttgggttcgggcttgggtgtgggctcatccagttgaatataactttagagagtgaaaaggaaaaagtacaccgaaggtccctcaacttgtagtctagttacaaaatcacccccaactgtaatatatatatatatgatatcctttaacttacaaaaccattcatttgaggtcccttggtggttttgacttcggttttatccgatgtggcggctgagttggcatgggactcacgtgggccccatatgtcaggacgccacatcattatttcttctcttttttatcttttcttttatttcttctcttctcctctcttctcaacgcagtcgacgcaag

SEQ ID NO: 51389 - DNA, 23154 bp, Oryza sativa
gtagtactttacaccgaaatcaattaatgtaccgcatgattaattaattagtaggaatataattttttttgggaaacaatctcatataactaactgttaaaaaatatatatttaaaacttaaagtatcatcgaacaggttccttttaattcgcagacaatgagacaagacgatcaagtcccacagtgagttatatgctgcttttgggtgtgcaacaactaacctatataatgacccatcctaaactaggccatagctaagttgtttagtagttttttcatattacaagacttttttctagtaaacatgtatatgaatgtgggcaatactaaaaagtcttgtaacctaaaacggagatggtatatactactcctactacattactccctccgtttcacaatgtaagttattttagcatttcccacatttatattgatgttaataaatttagatagaacatcaatataaatatagaaaatgttaaaatgacttatatatattgcgaaactgatgaagtagtattcatatgtatgcatagtacgtagttaatttggtacactcatctattgtggaatagtcaaatgtatatagtgtgtggaagtggaatagtcagatgtatatggagtgatctgccaattaaagtttgtgtgtgtacgtgtatcaaacatgcaggcgtcatctatccggccctgtctgcctgaaaatatatcactgatgcaaagcatatatgctaagattcgggacaaatatgtgaacatgttatttactacagtaaacacggtgtacgcacgtacgaatgtacgagcccaatatatttgcagtaggcttgagatattaattaatttgtataataattaagttatgttcggatcttagttcattaccgttctctgtactgcatgaatatatcccccaaagatctcactgcctcatgcaagcatggtgatataatgcatgcagatcgagtgatatatattttcactggcaatatatatctaggttattttccctcaaaacaattgagaatttgctctatatatacacagtttcaagatttatgacatatacattaagtttccaagcacccttaaaatttctaacattgttaaggctctaaatcaaacacatccaacgttgaaatatgggtatgggcgttaacaaagtaaataagtccttaatttgattttttttctgttaatactcatgcggccattattggcaaatctctatcttaattcttacccctgcaggtaacgcctatagttaattcaagcattatatacctggcctatattaaaccatagtaccctgcttggtcccaactgtgcatgtacgtactgctgcaatgttaatcgaaagatataaaactgtactaaagaactgcgatggcagctagaatgcagagaggcttctgcacgtatgattggtcactggctacaattactggaccagcagctaattgatcaacatgtacatacttcatctgttccagaataaaacgaatgtaagtaagaatgtgatataatctactagtataataaatctagacataactttatctagatttattttcctagattataactcatcttaatgtaggccttgtttaattagattcaaatttttttcttcaaacttcgaacttttccatcacatcaaatgtttgtatacatgcatgaagcattaaatgtggatgaaaaaaaccaattatatagtttgtatgtaaatcgcgagacgaatcttttgaacctaattacgccatgatttgacaatgtgatgctacagtaaacatcgcaaataatggattaattaggcttaataaattcgtctcgcagtttacaggcggaatctgtaattttttttgttattagtctacgtttaatatttcaaatatgtgttcgtatacttcaaaaaattttcgcacacgaactaaacacagccatagattgttttttttaacggaggaagtatatatgatactataatatatcgtccgtacacgtacggtgtatatatgtcagtcttatatactactaaggttgtgtttagttccacgccaaaattgaaagtttgaagaaattggaacgatgtgataaaaaagttagaagtttgtgtgtgtaggaaaattcgatgtgacgaaaaagttaaaaatttgaagaaaaaagttggaatctagacagggcctaatatactatgctcgcatagttgcaccagcagcttggtagctatagtactccctctatcccctaatataagacgtggccaaagttggcacggtctccaaaactaatctttaacttataatttctcatatattataaggtttgtagaaataaaattataatcatatgaaaataaatttaaatctcaatctaatgatataatttttaaccaataaaattcatttcatattataccaagtgttggttaaatgttttaaaggttgaatcttaaaatgtgtgcacgatttatattatggaatggagagagtaataaattaagggagagcaatgcatgcaactacgtggtaattaattaagccagtaaaaatgttatagttgcctggagacataataatgcaacgtacgtacgtgcaggccgggaactagctctcacagtctcactagctagtcattgcatgcccccgtgtactccagccgtctaaaaaataaaataaaccctaggtttccgtgtgtactccttccatctaaaaaataaaataaatcctgagtttccgtattcaatgtttgactgtccgtcttatataatttttttttataattagtatttccattgttgttagatgataaaatataattaatactttatgcgtgacttgtctttttatttttttataatttttttaaataagacgacggtcaaacgttgaatacggaaactcagtgtttgttttttttacggaggaagtacgtacgtagtactacacgtttgcaataatatattaatcagcaaggaaatattcgctgtaaattaatacagctatagctggctagctgctcctactatacgcgtacgcatgcagcgtacagtaccatatttttgttttcagaaaaattaagggtacatataggtgtatatagtagcgtacagtactgtaaatgtaaggagagcaatggatatgatcaaattgtcaattgaatggtaccatgagtacaattatgggagtgatgaagtattaatttgagcatgcatgcaatgcaacggacgtaggagaggaaagaaaaacacttactgaaacctatgtcatgtatgatcttggaagacatacgtataattatatagaagacgtatttacacatacaccactatgcacgcaaccaacttgcgagtgtgccctctctctccccacgcccacgtgggtttgtaaattaaatggacataaacctgctgcaaatttctacctcactaattaaatacctattgaaattgcgtttgtctaaatccacaaatccgattttgctgccacaccaacccagccaacaacaattgtcagaaaatggatgatttaattttgcagaaaatatatggcgactcatgggggtccattgtcctttttccactgccttgtccagatgcaattcaacatccacgatccaacaagattctcatatttgaaataagtattatcccattttcaatctattatctaaaaaatgtgaatagatcatgtgtgtttatcgatctatgcatgcgcattggcggatctagaaatctagatgaatgaatgaaaattactatcatccatgcatgccacagcaatggtcgatcaattgtcgaattgtcatgtaatattttaataaatatgaatttttttccacataggaggtataacttctgaccaggttctaaattttatggatgaagttataaattccactatcaccacaacaatagtacatgcataaagaaaaacaaatgcatggtctattggttttacacaattaatagcttgtgcaaatcgtatagtatcgatccaaggacttagaaatatataaacttatatagtagagctagtactagcaatacaaggatacgaacttctcatgctgtcatgtaagtgtgatataatcagatcgaatatacatacaatgtacaatgaagtacgtgggtccgaactgacatggacagattaatgcatggttgtgatcaactttaaaattgttaaactctaaggaatggaatgcaggaaggaccacgatatatatacacacacacagagcaccagacaaagtctgtttaatgccaacggatattctgcttctcccgtatatttcatccttcctgcatcgatctttcatgcaatatatctttcatgcttattatatagctactccaagaatatgtagttagatccctaatctagattgtgtaatttgatagaaatgatatgtaaaatccatgcatatagaagtctcattcagagatacaatcaattaaaaatacttatattttagaacgagtagaaggttctcatcagctgctgaacaaagcaatatattatttttcgagcggtgaaatgaacagatcaagcatatatcatttttttttcactcggtgaaatccccagatggagcccatgtatatataccgtatctctgtggtgccaaacacgtagggccctagttaatttcttgtcgtccaaatggcgagtctttatatcattggcgccaaattaaactagattggccccagttagttaattaattaattaattaattttgtttttggaatggtccctatcaattacttaattagttgacacatgttaagtttgatatatgttatgttgttccataattcagttggtcacttattagaggagctagggatttgtttcttttccaacaaacataacttaatttattgctgttgtgcacacatttgtgctagcttgatggcagatgccagggatgtaaaatatttttattgtcttaaaaaacaaatgcataaatatatgctactgtattgggtagtacagtctcatatggaccaaaattaaataagctattgagctactagcggactagaactagatgaaacttagccatccttgtttaattaccgtaaaaaaaacgcatatattaatcggtaggtgaaatatactccctccggtaaaaaaagttactttggttagtgtgaagtcttaaaacaatgaatataaatatctattatattttaaagatatttagatttcatgcacatatgaaaataacattctcacggattattatttcaccaaattaagatgctatatatcataagagttgtagtttaccaggtttaaactttaaacataaaacttgtttaaaactccctgctagaaatgcttgtatggtttagtagtagaaacgtggacttgatccggatatataggctgccaataatgcaatgacctgcaaacagagctactactagtgcagaccatgcgtgccgattagacatgccctacccattctgggaaacaggtttgcatggttggtgatcccatgcctgcttgcttgttgcatcatcatgtggatcgatcgatggatcgaattcttaatcctgattaattaattttgcgtgtactttggagttgggatcatggggatccgagcactaaacttcctcatgtcgttgactccatgtggcactggattacattttttcactttgggatcatcagcttagccccacggcaagcaagcaactagctcgatcgggtgaataataataatctctctttctttggacttctcgaaactgaatcgagttacaagtccaacacaagcatgaagaattgcaatgggctatcgcaactttcagttaaaaagttcagctaatattctagcttgggcagctggttaatttagtactccgatccctctcttcctaaaaaatatatataggttgtttacgaaagataaaaaaaatcccttttaatcagctaataatcaaaatttaagttttgaattgttggattcccctcttaagcacctaattggttaaaaatgcttaaattttcgtgtattgaaatcattgttccagaaataatgatatgtgtacaaattaaatttaaattgtagaaatagttatatttggggatggagtagctctccggcttaattacatttatttaactgcattgagacaaaattaattcagactactacagcttaattacattgattaattgcattgtagacaaaattcagactctgggccaacgctagattgagttttattttttattttttttgggggggaatgggtaggagctctaccatttttttaataggagagaaaaaaacaatagttcacctcaaggattgagttggatcgatcagatatcattccgaccaaaacaacttgctcgatcgatccagacgggccatcgatgtctgaccggttgtcgacagattcgtcaggaaactcgctctcgcatgcgtgctcccgttactccattgctgggatgcaaactgcaaactcgcaatggcgaattaatcctgacgcgattcatcctctttacagcttagcactactccctccgtcccatgataattcaactcctggattcccaatgcaaacttagtacaaccatgaaaataccgaaatgccctcaacaacaacattacacaggattgtactgggttctctgcactgtcctcactgaaaaaaaaggtttaactggattctctgcacgcatcaattacacaggtatccagcaaaaaaaatgaagttttaaattgaatatgttaacaaaaaattaagaacctctagtctgaaaaaagaaatcgtcaaaaaaaatactactccacaatctacaagatggtttgcatccataatctgttaaaaaatacttctccacaatctgtaaggagtaggaattaatctgcaagaactagaaagaacaaagaaatgtgtttgcatccaccaaggtggcctgtagtcatgtgtgtatttatccagattgaccctgcaagaagtcatcaccaaaatccaagaacttagtatagttaacaaggtgaaagggcagaaataaacaccagagaagaaagagtgatggaaaaagagtggtggaaaagtgtacttgggtttattctaatggcaaagcttctcgaaccacctcagcgctgggagacacaaaatcgttggctccttcatcagatccgccattgcaaaagcttgtgcatcaggctccctgcaacagatccactggcgctggagaccataggcttgcgcctccgccgtcgtagccaagcagcacctacatgttgcgttcgccttctcctgcatcacaatcgcaagaccctacctctgccgccgtactgctagtgcctcatccgagccatctcaatccgccggggctggcgccgcccccgccgacctgtcgtatccatgacatcacgggaggtcgcagggagggagagatggatggagcgtggagggaggggaaatgactcatcgccgtcgagggataagtgaaggtcgtgaggagagggaggagatgagaccgggcggtggtggttttttttttagcgcggttgtgtggtgggcgagaggagagagacgggcagggataaggatcattgaatatttctcgagtgttacgcagaagtcggttttttctgggacaaatcctcaccccgatttctttctgggacggagggagtatgtctgcaggcaatgcaattctctgccgatgcaaccaactgcagcctgcaggattgcaggcacacacgacggaacaaggctgcgcgcgtcttcctccggtggagatgattggttgcgcaagcgcagtacaggcggcgacggcgatcgatcgatctggatatcaacttgcgcagtggcaggaaggcggccgggctgcggcacgcgtgttgcaggttgctgtcagagtcggaagtggcgaaaatattaagcacacgttactgaactttcaataagattttgatgagatcgtagatacatcgttagttttcgtctatctagcatgcgttagaagatactcccttcgccccaaaaagaattaacttagaagaaaaatgtatgtggacacctcatatatccacatacatcaacttaggaggggacataggttaattctttttgggacggagggagtgcattcgtagatgagtatagtattacgtctgtagtaatgtgtgtgcgtctgtcgtgtactccctccacggctaaagaaacaaatatagaaacggatataacatattctaattaatgaatctggacaaaagtttatctagattcgttgcaccaagtttagaccctgtttagtttcaggggtgaaaagttttgatgtgtcacatcggatataggacacacatttgaagtattaaatatagactaataataaaacaaattacaaaattcgtccgtaaactacgagacgaatttattaagcctaattaatatgtcattagcaaatgtttactgtagcaccatattatcaaatcatagaacaattagacttaaaagatttgtctcgtaatttacacgcaacatgtgtaattagtttctttttttaatctatatttaatactttcttcgtttcataatgtaagtcattctagcatttccacattcatattaatgttaataaatttatatagatatatatatctagattcattaacatcaatataaatgtggaaaatgctagaataactaatattatgaaacggagggagtattttatgtatgtatctaaacattcgatgatagggtagaaaatttttacgtgagaactagacatggccttagtaattgagaagaaaaaaaaagttaggcaaggcgatcgatctctccgacatggggagtgattgggaacacctggggccggaaggtgtccgtgcctcggcgcctcagcctattggaatcttcatctttagggatggttgattggttgcttcttggttgcctccagcttgcagcaccggccaccggcccatcccgactgagtttgagcctgccactgccactgcccaggcccacccccccttgagcatctccaacccacacgactcaaactgaaccaggccccccctgtacttgatgatggcaattgcttcgaaacgccactaaatttcacccgaatttcgtcactttcgtacctcattccaaacataactcacttccaacacgagtaattttggatggagattcataaatagaattcaataattttgtgaacttctcatgttgtatgtgtctttattagttggtgtgctcctgtttttttaatgactatatttctttattttgttgaattgctgtaataattggttgtagctccctgaggaaaggtcgggattctattccattatcctaaaaaaaaataactcacttccaacacgagtgctcaatggaatattctatatattctcgcaaaaaaaaaaagagaaaaggatagagtaatatatattcaataaatgagccactttcaggcgtgatcgaacgacacaacattgatgggtgccatacaggcagccaaaaagaatgataaaaacactgaaagagagatcaacgaacgcattgccgcgtgactttacaagcaagtgatcacgccactatcattgacgttacagcacgctaaaaagcgcccaaaatggatcacgaaaagagcgagagagtagaggattagggctaaagttacaacatacatggcccacacggagtatggcgactgtatatgtacagcgacaggtataatcatacaggtgagactcttcagaataccgaatcattgtcatacagtgctccatttcatctcgacgtgtaccatcccgttcctcgagttgatcagatggtatttttcgttgatccgtccgttgttcacgacgtccactaggtttatatccacatgccccaatgattcctgaaattttcggagaaatgagaggttgattttagaaggcactatgaactggatgtgattatattctctctgtttttttttaacaactggttgtgaatatcattatcagaagagatggttttgcaatcagcaggtaacaacagtgactgactgaccttattgcggaagggaagccggagcccacggcgtttgcttactacttcgatgtggatcttatcatccacaggagcctcatcaaccatgaactgaaactcttcgttccatcttggatctcttgttttcttgattatctgaaatgccaagttaaacattttaggttcacataaaagtattaggtagtactactatgttcttaagcgcttttagttggggtataacgtggaactacaacataaagttagtgtggcaaaactaattccaaaaataaaataccttcgtttccttcctttctcccctaaaatgaaccacggcatacggattagtatgacgctttccctcgacgtcttctgcattttctactgaaaccaacagcaaccctccactaggtgggacgtccctttttacactgacattgccttcaccatctgacatcagaatggtactgttgctgtcatctctgaagggatcaaatgtcagctctacgacaagctttcctctgttcttcttgttatgaggatcatttgggtccatgcttttcagaaggtcaagtgtgaacagtttactctcataaggagtaagcaagcggaggggaactacttgcatacccagtttatcatgcattttaacctgcacaaacagaaaaaggaaaaggttattgttatttcctacctatgccaagcaggaaaagagcatagaaataacaattactgctcttacaaatgacaaaccaacttatcagaagaaaagttgcatacagcaaagctaaaccttttcccaatcaaacatgcggagctcaaggatttgtgtttcaggatccttgactataaatctgaagtgttcattccactcaggattcaggttgctcatcttaatagacgtcttctttgaaggcagtttctcaccactcaaacggagcttgacatagggatcagattttccaagcaagtccatcttgagaagattcatggctcgaattacctttacatgtaatattccaactggtttctttgtcgcaccactgcaaatgttccacaccggtaatatgagaaagatcaaattaaactggagtacattcaaaactaaaacaaccttgtttcagctatagaagccccattaacaatgttatttcttttgcactaaatgaataacaaaattatgtttttcccaacatttaatttccttcgccacgtacaaatgcacttcctttttaaacgggtccaaggatagcaatgtttattgatgctaatatgttttctgggagactcttatttccaaattatcttggcaatatatgtctcaaaaagttcatgttgaatgagaatatactcgagatagaagattatcaagatgaagacaggatagacatatgcaactcggcatgcaaatttggaattaataaactcatccaacaacttctcattgtgatccttacaataaaaaaaatatggatgtcatttgtaaagaaaatcacctcgcttcatctaaaataggaatttgtataagcttaggccagtgatacaagtttgcgatttgctttgatattttctcctgtcagaaagcaaaaaccactaataattaagaagtccacaagctaggaacatagtactggtacccaagatagtgaaataaggaatcgtagtagtaattaaatgggtacaattaaactacaagagtccatcaggacgttcaaattcagtgtcctctgtgggaatataaatgttaaagagaaaattagttacccggacaaaccgatgcaagccaggtattgccatgacatctccacccaacaatttgaatccaaagtcgatatgtggctttataataaaataagagttagttttatttacagagttgttttaacattgaagaaacagattaataccttctccatcagtgaaacacacaagtttgcaaagcagggaaagcttggcacaagaggcttcagagtcacacgtggtgtcagcattatatgtaaatctaaaagctgaaacagaaatatgatcagtcagaggactaatagtccattctttagaacgagataagagaaagctaacctgagccgacacttggaaagaatgcaccttcactttcacaattacatttgctatgctggcccaccgaatcacaggttcaattaccaactctttttctctcatttcataaactttaattcctgcttgtcaaaatatcgagtagtataagaatcaatcaatcttaacaagagttgactgacagcgtaagtgcagactacagattttgaactgctctaccaatctatattatttacaacatagacttgagttatacaaggatacagaaacactgtacttataatgataatcatgatttgaggatacaaggtctgtgtcactgaacaaattgcatcattacagaaagtactcttacagaaatcaacagaccttggaacgtaggaggaagagccccaagtgttaagtgcccaaattcaattgattttattccatattgtccaacatattgatcaaatgttggtctgattacacttcttattgtgttgcagattgcctgatcaatgagtcaattgagtcttaaaaaaatgaatcaattgaattacccaagctgacaatggttcgagaagaactctcaacgctcagatgatgaagcactgaatattacactaaaacttggtagcaaacaggccatataagacttgaaaataccttatcaaggaagggccacatatcaaaaataaacttgttaatccagtcaacctgcaaaaacataaaatgaattctccatttcatgaattgagtattgtgtctttaaatgaactatatgtaatgtagcatttatggtgtggataaaaagaaacaagaacacaaaaataaatacaaagtaccagcacacattctctcatatatgtgcctcagtcctcaagagcttggctatttagcaatttatcataccgatcaatatgatttcttgaccagattgctaagctaaaagaaatggaatcctacaatagattaggataatggaagctgtcaccaccaacagcgtaatcctctctaatttcatttgtcaaattttggtattaacatattgtatttatctctctatgaaatattttttttttaaaaaaagaaatactctgaaaaggggataaccaaaagatttccaaataaattgttgatatgtgaaggtgtattctaattttttttcttttcatgggaaatacaaagatgctaagataattaaatttccataaaagttacaaagactccatatataatatcctacactcatgttactcaggggcctgttatacatacttctatattatcatgaatgctcacgccttgttgtactgttgacatttgacaactaaacagagattgatttacgacacacataatcccaaagcaacaaattataagtcgtttaaatagtagcgcgccatgtttatatacccacccgttcataatctggacacttcacccacaacggaatatctggtatagttgtctgtaatgtctcagaatccaagtcgcgtagtggtctaataataggatcctgcaaaagtcaacagtcagtttccctcaaaaaatgttgagatcaaatttgtactatagtatttactatttgggtttgtgtaagattttgaatattaatttatgttgaaccctgcttgatagtagtatgtagtaaagcagtggagctcaagaggatcaaaccgtctgaatctaccatagttttctggaccctggagaggcaggttgaaaatgcttatacagctccatccagtattgaccattggttgcaaagtgaaatagtggatatccaacttgactttcagtcagattaatgtcaccaaacactggtggttatgacttttcttttacttagcatagtggatttgattatttcttttcttatgaagtaagtaatccaattttcgttagtctcaacataaaagggtgcatcggagtaggctatatacattaagcaaataaccaagttggatttttgctctgtcgcatctaaccatgtcgttctcattccaatgggctaacccaccctgtaactagctgaaatgattctaaccatatcagacaaatatcatatgtactactaggctaattaaataacacgccgtgcactacaaaatattctgtattcatatgcaccaacccgtttcacattgctaaaccaaattaattaacaaatgcatataaaatacatcttgtgtttttcatgtatttggaatattcgttcagtaatcccatagcaatcccacttgtcccaaataatcccaagcaaactcccccagtacacatcaatatatcgcaatctaataaaatccccagtgtctagctggcgcatcgaaattagtcaattttattgaaacaatctcactaaggaagcatatgtcagctcacggaggcatcgcaattggcaagccggaatcggatacgcaagctagcaaagcaaagctgttcaaagctggaactgaaaagtgagtactggacggcgaaactggtaaagagacgtgcttagtcagagctgagaaatggcactactccagcaggggaagacaaggactttggagcacacgtaccacgtcccgttttccccacgtcgcatcctgaacaatccggtagtctaatcgtacgggcagaagaaatcaagcacgtcccaatctcggatttaatttctacaaccattttgttgggttagttggtgtgcacaaaacctcgatcgaaatccatcctgctgctgttcatgagtaattttgatatgataaaccgcacacaaatcaacaaagtgacagtacacagataacgaattgctaacgatgaatgcgttcaactaaccactaaattgctaggattagtacaggacgggaaggatcgagaaggaaggaggcgatggatggactgacctggagacggcggcgaggggcgaacaagcggaggtagacgaggtaggcgacggcgatgccgagggggaggccgacgccgaagccgaggaggccaccgacgagccccatcccgttcccgcccgctcccgcgaatgcagcggcgcccgcggcggcaaccgcatgggaaaccacaagacgacgatgggttggtggccggccgcctcccctccctccccagctacccgccgcggataaagtaatggccggccggcgaggcggcgagctcgagctcctcgcctcctcggagacgtcgagcgagacgaggcgtgagcgggagccagcaacgcgccaaaagcttagtttattgggaggtagcggagaagcggatgcgggagagacagcggcgtgggtggtttagcttagcttatatgggtcgctcgccgccgcggcaaaaatccgcggaaatcctcgcgtttccggcctcgccgcggcggcaaaaatccgcggaaatcctcgcgtttccggcgatgggtttcgcatcgcgcgtgggcttttgcttagctaacaaggctactacggctcagggagggggaggaggaggaggaggaagcccagtttcttgtctcgtaagaaatctccggaagcttcgtgggtttagtgggcctggcccatgtagggtgaaggttgggcccacgctggtaccaggattgcgagacaagctgcctttaaaacggctggccttctcggcgcttctcttcttcctcctcctcatttcaaattcgaatcagggcgagttggcttctcggagaaggcagaggagagagagagagagagagaggcgggatggtgaagcggcagcgggaggaggagccggcgacggccagccaatccggcgacgacgattccaactccgacgagtggaaggactttctaaacctagatggtggcgaagaggcggcggaggtggacgacgactgcaacctggcgccgccggagaaggatgcagaggcggcgaaggcgagccaatccggcgacgacgattctaacaccgaccagtggaagggctatctaaatctagaagatggcgaagaggcggcggaggtggacgacgaccgcaacctggatcagccgccggagaaggatgcggaggcggcgaaggtggacgtcgaccgcaagctggatcagctgccggagaaggatgcggaggcggcgaaggtggacggcgaccgcatcacggcgctgcaggagaaggctcgggtgcgcatcctcgacttcctcccgatcaagtcggtgatcctcatgggttcgctctgcaaacggtggcgggagatgtacggcctctactggagggatgtcgccgtcgacgtcgagctccccaccgacggcgatgcgctgagcaagctagaggaacgcgcggggcagcaggagccgaaacgccgcctccgctacttcttcctcctcgtcgtcgagagaaaaaatgttcagagagaatacttcaattcctgcctcgaatacgccggcaagtgctctcccgaggtcatccacatcagtgatcgaggaggagcgggccgcaagtttaagatgcacctgacgagcaaacagctcgtgcgcctctcgataatcggcgtcgcgttgggtcatttccagggcaagttttgtgaaggcgtctccttccccacgctcgaggaaatccacatcaagaactccactatcaataaaatggacgacctcaagaatctagtcggcgcgtgccccatcctccgcgtcctcgacctgcgcggatgcaaaaccatcacccaaatcgacgtcgacaccgctggagagcacctgatgagcctcaccgtcatggactgcgaacgcgtccgacggctgaccgccggcaaacacctgcgctcctttcgctacagcggtaacttcctgacgtcactgtcccttccggacaacgactcgcttgccgacctcttcatcggcttcccgagaagccaatctaccaccccggggcccgaaaattcgttcaaacgcctcccagatctctcgaacctcaccttcctcaccctgtgcagcacttctctccgggttcgttctttttttttctctcgatcatgttaatttcatctgatttcattttcatctcaatcgtgttgtttccacttgattcacaaggttgtttgctacttctgattttcaggctgtaactgtggcgggtaataccattcagacaaacttgaggagtttaagagagcttcagttgctcatgttcaaattggaaccgatcaacctcagtgacgttcgtcgattcctgaacacctgcggctactaccctcagctgacgaagctctttgtgcaggtcaccactcaccacctgctattccattgcttgcattgcgtctcgatctgttactgtttgactattttgtctgttcgagtggagccaatgttagtatagtttcttctttctgatgattccaaattatccctttgtgatttcagctcccagaaagagattgcacatacacggagaacactagctcagagaatgtggagggggaacaacaggatggcttcgaaaagcttgatgtggtaaagatgacgaacttcaagtacgactggaatgagattcggctgctgcagtttctgttcaagaaggccaaactcctccagaagctgatactagttcgtcccataccagtaccggtagatcgccccttccgactccaggttcccgcaaatgtccagctaactgattgtgctgatgattctacagtcaagtcatttcattcagaactccttacctcgaagacgaactagtgttcagtcaatagtcgagctgcttatagttctacagatctggagcattaataggttggaaaagagatacaggacaagataacatgtgcagaaacaagtacagtctcgtcataccttgatttcttttttccttctgttttacttgaaaaaaggtgattgaatgacttggtatttcactgtcaatttatgatgtatttggcattttagcaactttagctatacatatgagtttacagtgaaatatgttcttacctacttctgtggaaaaaggattagtacaaaataaacttggatgcagaatccttgggcactgaagtggttcctttctgtgttcttttgccacaatgcgagttacaactgaaattttaatcatccatgtgtaaattgactttctgtggatgtgatagctagatattggatattgtcatgtcagttatgaggtttactaattgtttcttgtcaatctgaaaagagtttaggagtttacctgaatgtaatttgttctgcattagcatagtttagttatggagattgatgcggaagctgttatgttaaacctgaaagttgatcctgtaatgtaaactgaactttgtggatgccatagctagttttgaatatttctattgtcggttatagggattactgtcctcctcaatttgacaagattacctgaatgtttgttctgtgttagcataatttaatataggcagactgatgggatatatcaaatgggagattctgccattgtacctcatagattatttgtttactgatactagttcaagttatgaaatgcttgatgtgatcctcatgagccatgatactagtactgaagagtatagcaaagtatgaaatgctagatgactctgcagatttttgaagatttgtagattctcctctgcctgttctttccatttagcagtacaagtcaacatatttgtttcggcatatgtttgcatcttaactgacaccatataccttgtctttttcaaatggtgagttccataatggagtaacagattaccagtattttcacctgtagtttcatagttatttgatccatgtttgcaaagatcaaaatggacaaaaacaagagcagtgttgtagctagtaatttcgagatttttaactatttggacgggttagtgtctttgtttttatcgtttggaagggtttggatttcattcataagcatgaaacttagcatagacttgcacattaaaacatgacatgagaatgccatatccagctgcttggattgtgcagttgttttagctaaagtattatgtgtctgtaacgtaattgtgatatgtgatccctgccgttggaagcatatggactcactcaccctacagcaccactcgcaagagaataaaatgctacacaacctcatgtgttatgcaaatcaaagaaactgaaatgaaaacggaaacccagtaaatgagtataaattggggaagtggatttttgtcccttgaggggacatcccctcgtcttgtgcatggcgtttaaaagttatcattttttttaaaaaataatgtcaagatagatcaatatatggtatatcttttcgcgaacatgcaagttaaaattcgacttgtgcaattgaaagcaaaaagtaacaaatttgatcgtgaattaccgttctatttatagtcaaatttgttattattgtttctacttgtataagttgaattttaatatgtatgtttgtgaagtgacatcacatattgatctatcttactatttttttcaaattttttaatggatttttaagtgacatataaaaataaggggatatcctcttgaagaattaatagagttttccataaattcgtgacaaactgaaacataccacatgattgcaattctgcatgccctcttccccttgcaactcccatcaaacccgtataaccaccacaagttcactgtcatattcaccggcgtattctcacttgccccttttcacttgtttaattgagtataacccctgtgcacctctattcttgtgtgactaagtgcaggattgcagttcctgcattaggggatcacactgtaacatctggattcgagtgaaattccccccaaaatgatgaaaacgttcagcaatgtagcaccctcaaacgctaaaaaaacaatggctatatataatcccccgaaatttccactcatcataagcacaaggagtccacaaccgccacaaccatcacaagcactactgccatgacaatctgcccgaggctcgccgccgcggcggcccgccggtgcgcgctcgacggcttgggtatcgtgtccgggagcgcgcactcctcgccgtcgaagtagagcctcttggggaagccttcccccttggcaatgttgacgttcggcgcgtccttccgcgagaaggagatgacggactgctgcttcccgggcacccttgggtcctccggcgtcctcccgtcggtgatcggctcgaggtaggtgagcccgggcaacccctgcatgaagatgctgttgttgaacggcgcccccatcttggtgccgttgaaggagtagacgttctcgtagccgctgtagtggtcgcgcatggtgacggcggcgaaccagtccttgaacgtgtagtcctgccagttgaagatggtgatccgcgccgcccacccggacttgtagttgttcatgatgtgccagttgacgctgaggccgcagttgtcgccgcagggcatcgggttgggcacgcggcggtgcttgatcttggcccaggcgcgccccttggccgtgcggttgtcgaacgggatgagcagcgcctcgggcggcagcggcgtggcgcgtgcgtccgcgtcgcacgtcgccgtgtcgttgccgccgccgcagccgccgcagctcgcagtgcgcaggtgttgcacggcacgacggagtcgtcgtagtaggcggagaaggagacgcagcacttggcggcgcgcctcttggggcgggtgatgttgcacgccacctgccacgacgcgacggccggggtggacgacatgagccccgtctggtcggggaacaccacggggctcaccctcaccggctgcctgcacgcgtactgcgggttcagcttcccgatgatcttccagttctgcggcgggtacagcgccgtccggttgaggtccggcggcagcttgaacacctgcatctggaacacggcccgcgacttggactcgtccatggtgggcggcagcagcgtgccgttcttgcagcagaaggggatgttcccgacgtccttgtccttctcgcgctccggcgggaggtccacgacgatgggccgcttctcgcagctgtacgccggcgtgaagtcgaagtccttgtagtagccggcggcggggctgtacacgcaggcggggccttccttgttgagcgtgtacgcgccgcgcattttgtagatgaactcgccgcgcttccactcccaggtgaggttccagttgtcgagccggccgatggggctccagttgtcgatggtcacctgcaccatgtagttgttgccgaacgcttggaggacgtcgtaggcgatggtcaggtcggccttctgccgcggcaggtagcgggtggtggtgttcaccttcttggccttgaattttgggtccttgacgcagcacacgtacatgacgctctgcttgtgtgtgggcttggggcaacggaacccggggttggacagcttgatggtcctgggcatgggcgctgtgggcggcttgacgccgaactgggtgccggtgatgtcgatctgggcctggatctgcgtcaggtcgccggcggtctcgatggagttgaggaggttggccatggggtacccggcgaaggtgacgccgccggagacgttggcggggaggtcggtgccgtcgaggagcacggcgccgccgacggtcacgaggatctccttgtgctggaacccgacgaacatctgccacgccttgaggtcctcggtcatggtgttgagcaccgtcgccgtcgccttgaacgcgaacgcctgcgccgtcgcgttcttggtccgcgggtactccttctcgcgctccgtgaacgtgtacgtcaggaacgcgccgttgcacgcctcctgcgccttgaacgacggcttctcctcctcctcctcatcctcgccgtctccgccgccgccattgttgtagtcctgcgcacgcgcgccggcggcggcgacggcaaggacgacggcgacgcctaacaaaagcgccgcccaccgccgccgaagcggcattggcacccccgtcctctgcccagctaagcgcgaacggaggagaggcaacaagcgttcgccggctcgctcgaccgatcgaccgacgggcagtggtgggaagcaaaggcgttccagcggaggaggaggaggaagaaggtataattaggcatgcactgtccgtggtggcagctcgctaaaatcgaggaggcctctcgtgcatgcgcgcgtgtccgtcgcgttgcctcgccgttgatggttgcagatggccgacgctggtttcgcgtggctcgtcggacgaccgagtcaaattgaccggatttggacaccgtcgttggcgctggttcgtctcccccgtgtcaaccgggcacgagccatatatattctaaagttattcaactggataacaaacacagaggaatatttttgtttcttttcaagaacacagaggaatgattttgcctaggatgcgaattttcgaatatttttttaagaaataatacttttttaaatagaggttgacaaattaaaattgcaagtttaggccctgtttagtttccacataaaaattttacatcctgtcacatcgaatatttaaacaactacatgaagtacttccttcgtttcacaatgtaagttattttagcatttcccgacataaatattatgtctatattcattaacatcaatatgaatgtgggaaatgttagaatgacttacattgtgaaacggatggagtattaaatataggctaaaaaaataactaattgcacagattgcgactaatttgcgagatgaatcttttaaatctaattgcttcatgatttgacaatgtggtgctacagtaaacatttgataataacggattaattaggcttaataaatttgtctcgtggtttcattgacggattctgtaattagtttttttattactatccgaaataccccatgcggcaccctatataatacccgatgtgacacaccaaaagtttacacccctgaatctaaacacccctttagcaccccatcgaacaaccaaaattcgataggcgtacatatcgatcaacacctgtggaaccacaattgttcgataggggataaaaaattaaaaaaaaagaacaaccactatgtgccactgtgcatgcagcacatatagaacatccacaattcgattggccccttgccatgacctttc

SEQ ID NO: 51390 - DNA, 4799 bp, Oryza sativa
gaggaggaggaggaggaagtcatggtggtggttcccctcgaggcgcttcccgacgacggccttcctgcagcggcggcggcggaggaggaggacgtcatggtggtggaccgcgtcgaggcgcttcccgacgacggccttcctgcggcggtggccccggtggaggcagcggccccggtgggggaggaccccatggtggtgattcccgacgacgcggttctgcgcatcatcagcttcctcccgctcgagtccgccatccgcacgacggtgctctccaaggagtggctaaggctgtggaaggaggattggggccagaaatccaggcgctacgagatccgcgcccgctgcgcaccttccgtggaggacctcctcaagatcctggaggaggagcgccgcctcgagcgcctctccgtcgtcgtccacaccatcatgaagagctctcacctgagagaaatcatcgagagatccgccgaccgccgcgtcgagcagctccacgtcgagctgaccaacccgaatgttgtagacaaggtcaggttccacttgccgatcttgagccgcgtgatcgcgctccagcacctctcgctccgccaaatcgtcgtctccaagatgcgcttcaagccgcagcagcgcttcaacgagctctcagaaatctgcttccacttcgtctccatcgagagctacatgctgagaaatgtgatcacgcgctgccccaatctccgggttctggaccttcgcagctgctttgacctcgacgccgtcgccatctcgccgggcgggccgaagctgagcagtctcaccatcgccgggtgcaagcatctcaataaggtgaacgtcgtcggtgtaaccagcctccgctccgtcttctacagcggccgcttcctctcgtccttctacctgccgcgcacaagtcgccgctcctccttcaccgacctgtacatctgctacgatggcccgataatccccatggtgttcggtaaatgggcacaggatgcactttccaaactctccaatctctccaacctcaccatctgcagcaattccctcacggcctgtttggttggagggagtttttaggagggattgggagtttagaggaatggggctattaagagttttgtttggttgggagacatgagaattttggtaggatagggatggggaattgaggaaggaactccctccttttcaataattaggtaggggcaggtaattgggaaggaattcctcctttactttttttaagcaaatctcagccatccctttttattaatgacataatctccaactaaactccctatcaatttccatcacctctatcaaacaagatattgggattaaaaatcaaatttccatcttaatctcatcatcaattccctcgtgtaaactcccaatccccttccctcgagttaccaaacaagccgtcaaggtttgttctgttctgttctgttccgttggataaggatcatgttgttcttgttttgaaatcttttggtggactcatcgatgatttgatatccttcagattgtgcctagtttgcctgatgaagaacgaactacccagttgaaatggcttggcggctttcggcgtttgaaagagttgcagttgctcatgtttgacataaagaccatcaacgtgtttgatatctatgcgttcctccagagcttccacttcccaaatctgaccaaactcttcctgcaggttaatacattgcacctcataagcatttctggaatttggatatcgcattgcttaaagtcgtttcccccttttattgcatctgatgaaatctgcatatggtgttctcatctaatcatgatactcctgaacacgattacggtctgtgcttgcagctcccaagaatcagggaagatgtgcaggaggcggtgagagaagatgtgctgcagtcgatgagcgaaggtgtgccagagtatgccttagataaccttaaggtggtaagaatgatgaacttcaacaggaccagaattgagatgcatcttgtgaggtttttcttgaggaaagcaagaaacatcaattcactgcaacttgtttctctttttcacaatgcgattccgttgggtttggctgttcaacaaggagacatcatccaaggagctttggcgagtggcgttatacaagagagcaactctggcgctggtacaacccagccgtgtcattctgaggtcttcatcgatttttagttgccagtcaccagtcagagttatggccctatagcttgtaatatccgagaaactggaaagtgctaatcgacagtatacaaatatacataattttcacctttagtttcttttctgcatcttcaattttagtatcaccagagaaactgaaatgcatgatatccattatccaatgtcttgtgcctgcctgctttgtttttgtgttaccattcgcattatatttttcatagtatatctgaaatggcatctctatgaattgaaaacatctccaatacatctttcaaagccaatttgactatgttaaagactgaattgtgatcctatttttgtagtgtacttctgaactagtcatgatcttcttttcctgtttgttatcttgggtttcagattgcactaacagcgattttggatatactgcatgtccttgtgtttatttctgatatgatctatgggattgttacctacatatttctattaatctatcttcacataatttgtcagaactcagaagtagctcactgaaatgagctgttaaaattctggagttagtagagaattagtttcaaggtttgggttactaatattagtacatagaacacactgctttttccttaacctttactggcataaaatgccaaatgacaacaagtccaatggttcctttctttgacagtgcattcttatcggtgtggtcatacctatctgatatatacagttccacaaatttctgaagttacgtctcgtattatactgtcttgctgctgttttaattctgaagctatcttttgctttatagccctttgggtgactgtatattcttattggtgtagtcatacctgtcttttttgtttatgagaactgtcatacctgtctgatatattatatatactactatacaaacatccgagcttaccttttgtaccatgttgtgttgctgctgtaagcctgtaacagttcccaaagtgtttttcgcactctgttaattactgcattaacatgaattactgcttgttgtactgtttttgtatgtcctgatgtgccaacctagtcctcctagtgatcattattttgacatatttactctttactatctatgtgctagcttaatattcttcctgcttaatattcttgcaagtaggatgaagccacaaattcattcataaacagatagggtcaattcccagatgtcacaagcaacaccatgtcattagaatgcttgagattggaggtaaggagaatgatgtcatttaggtggtgtttgaatctcctaaagatgaagatgaagataaagattatttgaggtggtaataacgtatgattatttgaggtattaattattaaaaacttgaaaaatggattaatatgatattttagaacaacttccatatagaaagttcttacacgaaacacaccgtttagcagtttgaaaagcgtaccacgagtatccaaaagtttatctaacttttgttgaagaaaagaacaaggccttaggatggtttgctgcagcttacagccttacagcagtaggacagcaaactgaggcaaagcatcaacaagatagtctcattccagagtcttaggaatgtttgagatatggtttagaatgttagttgtgataggagctccattcctagggatcaaagttagtatttgcataatggagttgattgtgttattttcagcaagaaaaagatatcttccatttttctccgttttctgtgagtactattccgggtgggaactaggaatggtgaacacaaccttagtctctattcccttgcattacttatctacaccttgaacttgtttaacttacccttgtattagatttagaaaaaatatgtaatcaacgctgataagaaaatttatgaagcaatcatacttcttaaatatggtaggtgttatccaattaatattcctcttcattaagtatcttaaacgcatcttatgataaatgtctgtgtgaatgcgcgagctacttttctagttaaatcaaatagtagataaaattgagtagatagcatgagtgcatgacgtggatgccgagctcgttgatgggccaccatagaaaaatctgctgctagcaacaggtgagatggtgtaaagatcctcgatatattggtgaagtcatgcaaatcttcgtccgctggccagggtctcccctgctcgtcgatgaggtcaaggtatagatggctaaaaggcccgtccggcacgtcccgacccaagcacggcccaccagcgccatcgggctggtacggctggcccatgggctgcacctccggtccaggcacagcccaccagtagtcgggccgtgtcgggccggcccaaagacatgggtggcccatcgtgcctttttaaaataagtctattttccctcccttctatttgggctgtgacatatatatagctaaaataagtctattttctctccctcctctttgggctgacatatatatatatatatatatatatatatatatatatatatatatatatatatatatatatatatatatatatatatatatatatatatatatagctaaattaagtatattttccctccctcctctttgggctgacatatatatagctaaaataagtct

SEQ ID NO: 51391 - DNA, 23915 bp, Oryza sativa
  unsure (1)..(23915): unsure at all n locations
ttgtgtgtcgggcctggcctgcggcccatcgtgtcatgccagcccggccgtaccgggtcggcccaacgtgttggtggagggcccaggcacggccccgacccccgttgggccatgctgtgcttgggccgggccataataccgtgccgtggaccggaccatcgggcctcgggctttttggccatctagcctcaaggttgctcatggatgctgccatgttggtgttatcagctggcatgtatccagagcccatcggagtaacagatggagtaggctgaaatgtaacattagtaatcgccatgcctccaaaccagatttcggtggccttgacaactagacttgtgaacaatgacttggggaagcgaccgatcagttgagggtcattgttaaacccgtagtacaccaaccaatcccctgaagtactgtccggtacatcattaaccaaaattaaagagaaatactaaaaatgtatgcacttcgtccaaaaaaaaacgaatttaggaatagatgcgacatatcctagtacaacgaatttggatcagattcatagtattaagatgtgttacatctagtaataggtttgtttcgtggaacggagggagtaaacaattgtcttaattctcatgtatcactcattgcctggtaccttgagggtgtgtttagttcacgccaaaattagaagtttgattgaaattggaacgatgtaacggaaaagttggaagtttgtgtgtataggaaagttttaatgtgatggaaaaattggaagtttgaagaaaaagttaggaactaaaccaggcctgagtacttttaagttgatataatgcttgtctccatttggtttatatcttatacatcttgtctccatttggtttatatcttatacatctggtttatatcttatactgcttgtctccatttgtacttttaatttatatcttatacatttacaaaatttttttgaataaaacgaattatcaaatatgtgtttaaaagtcaacatcatcatgtttcaattccaatctatactttctatatagttggtacccactaaagctaaaactcaacatgtaagcataccacatcatcactcactagcaattactattctagcctattttaaatcccatgcaaacatggcatatatcatctacaatattatattatataaatcaacaagcatgtgtcaaatcatcttcctcacattattttttcaacatttcaactttcatcatttcgacaatatttaacatatactcatccgtgaatcccgcagcaaagcgcggggtatcacctagtttcttatatagcaatgacgacaaaagaagaagagatgaccggggttgatgagtggataggcgacaaagaaacatgaatgtggcgtttgccatgggagagcatgttataaaagttagtcgatatagcggaacgacgactaaccttcctgatcgcttcagtcatcgatcacccaagacatgccagataatgacacaggaacacacgatatttgttaacgaggttcagccgaagcctacatccctcgggctctgattatgggcgctcctccccaaccaatatagctcctagccgctatgagtccatggcatcgctgccatcctctccctgcgtgtctacgctacattgtagtcgccatggttacattgtggtgcccccctctctatttaagagagatgccgggttacagagtccgactctaactccaccccctaacacctattacaactccaagtccaactgtaaccaaataggactagtatattcgacacctattctaacaaactccaccttggtgaatatacgccacctagaagtagtagaatcatcatgctgatccaccggtcctccagacttgggttgtcttctttgcagcttcaccgcaagccgcccgacgagtctgcgccaaacccgccgccaccaaaagcaattgctatcccagcaaccacttcctcctggactccacctgcaacagtgcaccctcgcagcttgtaaagatgcgactccaccttctctccagtcatcacagtcatcttgcccttcatgatctcaatggtcttcctattccgattaccgcggaatattaacccttcttcatgcaaggttccaagcgaaatcagattcctctttagccctggtacatgcttgactccctgaagaacatgttcaccttcatcttctagcttgattttgacttcactgtcacgcccaaaaattcccgaatagaattccaagcagaatgtgcaataaaatccccgtccaggaccggccagggtacacaaacgacaatgttgacattcagatccacgtcttacaaacatcataaaagtcttacataaatgcagcggaaaaacgaaagacaacaggagctaagccttgactagaactgcagcgggaacaccactccacaggcatcctcgacagcacggacgaagcctactcctcggagaaacctccatctgacacatactcgtactctggggttgggaaaaatagagcaagactgagtactacccactgtactcagcaagtcataccggaataggggtatgatgcagggaattatcaaaggagagctagagtggttcatttgcataaaacgagcatttaaaaacaaaaattgaaagatttaaacagttgtaataattaattaatattgatcatccgctgtccaacgctatcccacgttgcaacaggcctaaccatccacctatactatccaatttcattagactaaactagggtaagactaatcacggtgaatctggttgaccgcccataaccgcgggcacggctattcgaatagttttactctgattagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaatgggcagtcccctctcgtgcctaggtgaatccggaagcgacagaggccgtcgcagggcccgccccgctccatcacgcccacccttgcctggatgcgtcgactagaggaaagctacactacaagcccagccgttgcctacgctggcttgtggtaagtacgataagttcttccagggcatcccgcgaaccggtccttaacttccatgagtgcgactagcaaaaccatgcacccacagcccaccatgtgatttatttttattaaccaacaccaaaacggtggtactaaaccaaccttatcaattgaacctaaaggctatgttttagtgagctttccccattgtgtgctagtggaactaagcatggctaagcaattcctagtccaaaatctattcatgttataacccaagctaacaaaggagcatgatatcaaaatggcatggctgtaacaataggtaaacacctcatagtaacattataaaacaatgcaatatttgaagaaaaacaatagagcatttgcaatataggatcaacatgttcaagtgacaagcatgacttgccttgctctgctgctggaggaacctcggcgactatttcgaagtacaccggagcgtcggaagaaccgaaatctagcgacataccaggcaaacattgcaaacaggctataagactactgaaacagggaacaaaaccattttgaatggattctacacatttttcttgatttactgagacttgaatgggcttaaacggagcacggatgaattagttatgaattttagaagattcactgtgtttattactataacaagaagtccttaaatcatttattgcgcaataaatcccagggctgacgtcatcaagggggcgcgacgccgacatgcggggcccaccggtcagcggctcgggagagagggaaaaggggcgccggcaagcgggccccactcggcagcggcgcacgggtggtcggtctaccgtggaccgggaccacgcgggtggtcccccgccggtccacgggatcgacagcccggatcggcccggggccgattggactgtgcggcggcggcctggctcggctcggctcggcacaaagccgaccggccggccatggcaagggcggcggtacgcgcgcgtccaccggcgacggcaagcggcggcgcgggcggcggcagcggacggcaccccggcggcgacggcgaccaaaggcgacggcgagtgcgggtggtggcggcgcacggggaatcggggaaggaaagggaaaggggagggagtcctcaccggaggggatggcgacgaccggcgacgaggagcgacggagggaggtcgacaagcggcggacggggaccgggacgacctaaagaacgaaaaggaaaagattagagagggagagaggggccatagaaggcgggaacgccggccaaaggcggcggacatggcgactctcaccgtcgcacggtgggaatggtgctccggcggcgaacctcgacgaaggaggggtggacggggtggatctcggccacgcgaacccgacggcggcgacggcgctgtgcggcggctagcggtgaccggagtggcgggaaaggcggcggcaggtagatgcacggtgcgggagtgatggagagcttgggagagttcggcgaaatgggaaaaagagagagggggtggtggcggagcttaaatagggagagagggggccggacgtggccgggagaggcgggattccgccggccaacgtgggggagtgggagaggagagagaggcgggattcgaaaatcgattgtcgaatcccggccgtctcgggagcgcgggcgagcgggagagagggggaagtgggcgcgggagacgcggcgcacgcgcgggcgtggccgacgtggcccggaggaggcggaggcgtgggcgcggcggcggttgcgggcgcggcggcgcggcgcgaggtgggagacgggtccgataggtgggccccacctgtcggtgaccccgggagagaggagggggcgcgggctgagctggggcgtggcctccggccggcccagcaaggcgcggggagagaggaggggaagtgggccggcggcccactaagggaaaaggaaaaagaaaaaagaaaaaggaagaaaggaatttccagggatttaaatattgcttatgctcaattttaattggttaaaattatttctagggctctgaaaattccactaaaaatcctgttagtgaatttcaacatgtagaactcaagaaaaattccacatgtcagattcgattattatttgtattactttcttagggttttctcttgatttgcaccggcattttcttagggtcatttataaattaaattttagacttgggaggagaacttcagggtgtgacaaacacctactcccacggccggataacttgtgtcatcgcctaagtagacaaaaccaaactcaccagacttatatgaagagaaccactccttccttggcgtcacatgaaacgagctagctgaatccaatattcacgcttctgcatccttagactgtgcaattgacatcgtgagaagatcacaactatcgctatccgagtcatttgaagaagtcgctgcattagccttagtttttcccttcagtgttggacactccctgcttatatgcccccactcatcacatctgaagcactgcaccatcttcttctttttgttcttctttaccttatgcccagcatgatcttctttgactagaaaaccctccacttgagatgtttcaccctatttgttctttctcatctgatcacgagccagcaacgcaaaagtgatatctttagttttgatggtctccttgccgtacgtcaaagtagtcaccacatgctcatacgattcaggtaacgaacacaaaagaactatggcattgtcttcatcgtcaacttccacatccatcttcataagatcagtgactagttgattgaaaacattcacatgtgctgtcagatccgccccttcctgcatctttagcccatacaacttctgcttcagatacagtttattggtcagagttttggacataaactgagcttccaacttttcccaaattatctttggtaaggtctcctccatcacatggtacatgacctgatctgagagacatagccttattgtcgcagccgcctgcaactgcatctcctcccaatcgtcatcctccatcttggccggtttgacacccttcaaagcctttgaaactccttgttgagctaacaaatctttgaccctagtttgccacaagccaaaatttctggagccatcaaacttcaccaaatcaaatttcatacctgtcgacgccatcttgccaacccgcgacctgactggtctgtcgccaccagaatactcgcctttctcagtaccgtatgtattcgttttcacaatctcgtcttgtgatctgatctcagatatagactagcaaacccccgttcgctataatccgatgtgactaatcttccgccctcgatgtgcctctgctccgcacgatcttgtcggcctggcttggtccacccgtacctctacacagtaggcctatagggccccttgtacaacgtttgaccaatcccgccgagccacctgcttcgcttgattgctgacgccgagatgtgtagccttcaaaaacgctgccgcttcttgttgctttggttcgtctccctccttggctgcctatttaaagcacaaccaataggaaatcaatgcggccacgagtcggtgtccatacacgactgcatctgattccgtaacaactgcggtcgaattagccatatccgactctgacaagtcgattttttccgccaactcctccagccgatttcttttggcccaccaatctctctctgtcagcttttttacatggccctgccatacaataaacacacatgcatgcagacgctagtgctgctccttgatctgtacgatagccatatatcaatgcaagccaactgcatatacacgtggcctttcgaagtatgtacaatctccaagactgcagcttccaggtccatgcgcatgtgattgttgtatcctgctcgatttggtttttcttcttgcctttgctcgttagtctttgcacgccgtacgtataagatagcacctgtgctatctgtccgtgactatgcacgtaccgcagtcgcagccctcgtgttcaccatccacgaccccgtcgtccaggccctccacgtccgccgcgccgcgccacgctcgtcggtttcgccctttcgtcactggcctcctgctgccgcggatccgcgatcaccgcgtgcatcggacgcgccgtccatggcgctacccctccaatctctccagtcgccttcggccacgcccggccccgtcttccggtcacgttctgccatcgccggtctgatcgcgagcgaggtcgccgcctccgcaacgtcctcgttgtcgccatcgatctcatcgccacggctgacgatctcctgtcgatgcgcaatccccacctcgtgtttcctcctccacatgtcttcttgatccaatgctgaaaccttatgctctgataccacttgttataaaaattagtcgatatagcggaacaacgactaaccttcccgatcgcttcagtcatcgatcatgccagatgacgacacaggaacacacgatatttgttaacgaggttcagccgaagcctacatccccggggctctgattatgggcgctcctccccaaccaatatagctcctagccgctacgagtccatggcatcgccgccatcctctccctgcgtgtctacgctacattgtagtcgtcatggttacattgtggtgcccctctctctatttaagagagatgccgggttacagagtccgactctaactccaccccctaacacctattacaactccaagtccactgtaaccaaataggactagtatattcgacacctattctaacagagcaagccgaggagtgataaagaagtaaagtggcggcgatggcaaccacgtagcacacggagctccatacaactctagccaaactaccaacgaaacaatggcgtcttttgtaagcattgtgtcaagggaaatgcctagtcttttgcaactcgtatatctgaaattctgaatgatgatggggggcctttaactcgacactaatacacaatttgttcaccacttttgctgcctgaagctattatcctttgcatgtcaccaaatgcttcgtcataacttgttaatcgaaacgttaattaatagaaacagttaccccatgaaaccaattttgcattgcacacacaatacacgaacatgaatcatgcttttgcagcacacgtcccacatatagttttgataatggttctgtacacggtataagttttaaaattgttcctccaaaagaaaagcagggaagaaaaaagaacaagtagcagctaccgtagtagagcctgcagaagaaggcaagggagagcaaataaggcaagaaagagcaatagggaaaaagatcgagtggcaacttcggctgtgttgagatctagggtgaaaagttttagtgtgtcacatcagatatacggatacacattttaagtattaaatatagactaataacaaaataaattacagattccgcctgtaaactgtgagacgaatttattaagcctaattaatctgtcattagcaaatgtttattgtagcaccacattgttaaatcatggagcaattaggcttagattcgtttcacaatttacacgcattctgtgtaattagttattttttcgtttatatttacatgcatgtgttcaaacatttgatgtgacatggtaaaaaattttgccagaggatacaaacagactcttcattgatcctctgatcatctccatgacattttgtaagataagccaaaacttgttggctctgagtctctgacctagaggagtgccattgcatacatcacacatgcatgtatattgttgcactactgcgttgtatgattggcctgttgttgttcagaacttcaggttcatggcctcatgggattgaccgagagaggagaagcagcgcagttgactgtctctctctcaggaactaccgttttttaacaaattgatccttttcaaaaacttatttcaaaactagtccatgcaaaaaattttaaccaaaaataggccgtggactcagcgccattgactttggcgctaagctataacgtttcagcgccaacgtcatttgcgctaagctctaatccgaggtggcgtgagtacgctgagtcatcatagctcagtgccaaataacttggcgctgaggtcccaacgatttaaattaatatgaagacatatctagcaaagttccactgatagcataatgctagtagaggtctactctcaccttgaggagcagggtttgattcccatccgacctttttttttctttttagttttccctttttcttctctctcactctttgtttttttctttttctctctcactcactctttattaatatgttttttctttttctatctttatttagttttccctttttcttctctctctcactctttattaatatatgttttttatttttttctctcattttctttttctatctttatttattttttcctttttttttctcgtaatactatcttcaaaatatatgtttaatatgcaaatttttttgaatttgaaaaaaatatattgaagtggtatattatatggcaaatgagaacttaaactgaaatttcaaataaaattcaaaataaaataaattatagaatctgaaaggagcatatacttctttcatattggcactcaaaatcaaattcaaaataaaacaaatttacaaacggaacagttatttttgtaaacaataagagtgagtaggcaagagataaaaacccaaaaatacaaaattcaaaataaacgagttattgacgcagataaacgagcagacctgcgcgcggcagcagcagtactgtaccagtaccctggtctctgaccggtcatccgcatcacaaataaaattaataaaaatccagatcatgtactcctacacgcagggagggaaaagagatcagagaataatatgattcctgtagctcataggtttgtcaggatgatgcttggaactaagggtgtgtttagttggaaaaaaggaaatttttgggtgtcacatcgaacgtttgaccggatgtcggaagtggttttcggatacgaatgaaaaatctaatttcagaactagcctgaaaaccgcgagacgaatcttttgagactaattaagccgtcattagcacatgtgggttactgtagcacttatggctaatcacgggctaattaggcttaaaagattcgtctcgcgatttcccccataactgtgcaattagtttttctttttatctatatttaatgcttcatgtatatgtctaaagattcgatgtgatgtttttgggaaaaatttttggggaactaaacgggccctaaatacaccatccttgtcattatcatccgtttcaaaatgttcagtggtaactaataaggtatgtgatgtatcgtctaaaaaatgtgctatggtaacctatgtgctacctcatgcatgtcgcaatacatataccatctataccagttgatgccacaatggataggcattctgagcaaaggatgtgcttgtgtcaacaatatcatacagccaggagaccaaggagcaaagactgcaagagcaagagcaaacaaccagcttgggcatctctcagcttttcgatcgcctgaggctctgagctaggacagctttttttttccttcttttttttgagcagatgacaagaacctgttgttaccttaattggatcgaacatgttggacctctgtccgtccaccagcccaactgaacaacccaacagcagcagcagcatttcgaacaatgttgtatgagaacgaaccaaccaagaaaaacggagcggtccattagtacgtgattaattaagtatttactatttttttaaaatgaaacaatatgatttttttaaacaactttcgtatagaaactttttacagaaaatacaccgtttaacagtttgaaaagcgtgcacgcggagtacgagggagaggggttggtaaccatgggtgtgtttagttcctgaaaaaagttggaagtttgaagaaagttgggagtttgaaaaaaaaaatttaagtttatgtgtgtaggaaagtttttgatgcgatatgatgtgattgaaagttggaaatagggaggaaactaaacacggcccatgggttgcaaacacagcccaagtgttatctgagtctgactggtggacccacccgtgggacgagcccattttgatgatggccaatatcagagggcactagagcagagctgggctgggcagcagctcacaagacaatcgctagctagctttgagactttgagagtgaaacgagaaccaaccgacacacaaagctcagagacagagagagagagagagagagagagagagagagagagagagagagagagagagagagacatggagtactccggcgccggcggtggcgcgcctccccctccacctccctctccgccgagcgtgtacccattcctccctccggccaccttcattccaccaccgccgccggcggcaacagccgagccgtacgctccaccatccttgatcatctccccaccaccatcaccatcatcggtcttgcattactgggggttggctgttgcggttgtcttggtcgcatgtaccatctccatctggatgggatacatgctcgcaaagttcgagcgccgccgccggaggaggaagaagaaggaggagaaggagaatgcggcggccgggttggcggcggcggcggcggcggcgccctgcagctgcaactgcgcctgctgcggaggtggttcttgtgctgcccgtgttcatatccagcagcagaacattttctcgggggcagccgcaggcgccggcgccggcgacgagtacgacgacgaggatcgctgctgcgaggtcgggctcgcgatggtgctcgtcgcgacgacggtgtgcggctgcagcatcatgtgatgtgacaccgaggcgcggcggcgggcagagagcttcgaggcgtagacggcgaccacgcggcggcgatgcatgatcggtggaaggaagggcgccttcgtatcatctccctaccagtagactagactactctaatttattgcggtttctagtgtttcttagatttttctcttgtactataaaaaataaaaatacccgtgcgttataacgggtgaagtctattttaatcttattattgttatatggtttaattaaaataaaattcactgctagagttcgcttggatatatatatttttagaaaatcatgagctgcatttaggagtcctatcgtctcaagttagcttgagagttcttttaaacagatttcttatgcgatttcttatgtattaccaaaagtgaacgatcttaaaaaccgacgcaaatacgaatatgtatttacaaaagcaagcgaacttaaaaacagactcatacacggatgacgtaccaaaatactaataaaaatatcttcaatttttataacagtagagatctagttgctgcaatgatgaaaaaaaaaacgttctgcttattgagtcccccttccctacccgacgaagctgacggcaagaacgcggcacgccggcgccgccccggcgagacgccatggccgcgagtcgcgagagcgagatgtgttgatgggccacagatatgattatgggccattgcccattgggcttttcacatactttttgtctgtttgcggaaaaagtacaccgaaggtccctcaacttgtcatcgagttacaaaatcgtccctaaccacaaaaccggatatccagtgtcccttaactaatcaaaaccggtcacaatagttacttcagtgttttttgacccgattttatcctacatggcagttgagttagcgtggaacccacatattaggctgccacgccatctctctccctccctcctctctctctctctcactcttctctcctgttgcaagccggccggcggcgaacacggtggcgcggcggcgccatccgggagggtggtgcccggggggggggggtgcacgcggcagaggtcggcggcgccggtgccgaggaggaggaggtggtggcgctgttgtcgtcgtcgtcctcggcgccggggaagaaggtgggcactgcggtggcggaggcgagggggttgccgcggctggtgcggttcgcggagttgccggactatttgaaggacaacgagttcatcctgggacactaccgctgcgagtggtcagtctgcgacgctctatgcagcgccttcgcctggcacaaggagaccctacgtctggacgtaggtcgccgccgccattgctatatttttgtcagtggctactttcaaagagttctaaacttgacgtaatggtgacacttgatacattactccatagaatgaaacaattaatttcaagtccattgtaaattactaaattctataaactacaaaaattactgttgtattacataaaaatcattgttccttttttcagtggataaaaggaatcattgttcctaatatgccatcactaaaaaagccaataagtaaacaaaactagtaaaataataaagtacatattatgagtgcacgatgtggctaccgagcttggagttggtgactgcaaggggacaccgtagaaaaactggtcgtcgacaatacgggtgtaggaatagtacttgggggtggaggaatagccacccaaatgttaaacccgtagagcaccatccaatctcccgaagcaccgtcctatacaaatatatgtcaattaaggagatatatatattaaaatgaaacattacattcgttctcttatttataaacatgagagattaatttgaagctacttctctgttttataatgtaagagtttctagcattgtccatattcatatagatgcactaatatctatatgaactagaaaagatacccgtgcgttgcatcgggtagagaaaatttaatttgtacatatgtgttgcaatggataaataattacatcctattgtttcatttattcatgtgcttatttgaatcacttattaccaaataaaagactatttgtgcgtgcaaatcttgtatatacatgttcttagcgacacaaaagcaaatgttgtaaaataaagtataataaaaaaaaccaaaaagtcgaattcaaggttaagttctaaaatttaaaatttgacttctaggaataagaataagccaaacaattaggccttcaaacacgagctcgatttgtcatccagcttgatctcaagtcggatagaaattgatgacggacagaatcagctggcctcattggttcattgttgctgaggctgattctcaacaaaagcccatcagttcatttattgggctaaataagcatcagccattggtagtggatacaatcattcccgactctttttctacggctgatggaaatgattatgccgataagcatcagactgcttatgatgaaaagcaacatcataagccaattgatggatccgagcaatttcgattatcctttattttaattggcatgttcttttcaaaagtaaaataatcacggcgacacgcaaaggcgcgcgtggaaaacggactcagagggacactacatcgtaagaaaaaagaaaatgatttgacaaaaatataaaattaaaaccgattcaaatacggacgacgcactaaaattctggcggaaacattttcaatttttataatagtagagataataataattattattagttataataatttttaagtaatagttactttaaacattgaatatattatcatatcactctttacgaacattagctctacaatttttaaaaataaattttacacccactatattatattgtgtacccattattatagactaaatttaataaaaaatatttatatatatatattcacttaaatcggtattggaccatcatatctatcttttcaaaaaaataaacaaagccttgaaatgctagaaaatttgagaaaaaacacatatcccttgatttttcaattaaatcgatagatgaccattggattagacttgaaaaatcctgttaatcactctttctaaatcctaatcattccggctaatcaatcttcctatctctaatgcgtaagtacggttcgtatgtaggtgttacatgtaaaaaaacgtatgaccggcaaatcccctctcactgaattagattaaaaagatctaatcccacctgatctccaagtatgtacgtactgttatgtgtgcgtgcacgatcagcacctcctaccggctaccacagtccgcgtactcttggcccgcattttatttacctcctttttttctagccacttctttttccaagtatgaatcggactttttttttcgctgtttttttaacacctttttgctgtttatctttggctttctttacggggcggttttttttcgcgtgatttttttcgtcaaaatcacagacgacggtaacctctggctaaaaatcggaaggtaaagaatgccagagagactacgcgattttttacatgggcctagacgccacatgatttggaacgcgtgggaagagaatcggatgaagaaaaaaaatacggcacgacatacatgcgcggtgaaaaagaaatcgaacaaaaaaatacggttaggtggatgaatcagacgacgtacgaaaatcatgggtaaaaatatcttaaacttttataatagataaaaatataagtaatgatagaaattcttacaatataaaatagagggagtaacaattatgcaagttaattagctaaccttgaatacattgagtgcgatgtattgccttgttccgtttagctcggagatgctagggataacgtcgccgggtcgtgtggatgcgtccttcttaggttgaaagccagggcagtatacgtctacacctgttgttggtgcaccagcagcggacatctgtttttcgagataacttatcagtatttatcagtatatatacaaacgacacatatatatatatatatatatatatatatatatatataaggaattaacaaaaaggataagaaatggaagtagctaaaatactatcgtaagttttttgagtaaaaaactttgtatagttgaagtgtaagggattcacccaccgtacgagcgaggtaaaacacagggcgttcatcgcctggtagaacctacacgatattaagacgatcaactggggattaattcacatcatggcatggtcgttaagagaaaaaaactgcagggatgaattaaacaagtgacctacacgccaaccaatctgaatgccgtcgaaactggactctttgttgagaatataggcatataataatttaatatattccataaataaattatgatattacatatatatatatatactagtattaacgcattattagacatgtaaactaagcagtaaaatatgaacagatcaaatatgcgcaacatgtcgaacacgtatcgaggtggcggaaagaccggttgctcggcaggaactactcgcggttgtgagcatcgacgaaggcgcgcagcacgcgagcggagaggaaggcgagccgtcgcggacgaacagggagcagtcgcgcgaagcgcttcccaaaaaccttattgccgccttctccctgtgcaggacgtcgaaggcagaggttccggagacctgctctcccgatcaccggtgcacgctagcgagtgggatggagtagtccacgagcgacggcgcaacacagaggaggaggcaaaccctagattgatttcgtgtattttgcgtgaaggtggcggctcggtttatatagagataggtcgcttgatcagggcgcccgcacgatctccactccgcgtaaccgaaccggataagtcgcccgtaatttacccggacgatttttcggaatgtttccaaaacaaaacaaatccgaattttcctgcagcaaaacaaaactgcaaaatgaggctgcatctgtgtaagggtgaggagccaattttacggaccattcaacacgtacgtcgtgcacgcacgccgcctgccaggccaggcgagcgagtgttccccctcttctctccaccacacatgcttcaagtggctagaagagcctcctcccttttaaggaggtccccctctcctagaataaacaatgtggtactaaactccatatgcatgccatcccatgaggtgggcttttatgattttctaaagaattaatcttcgaatgggccttagcccatctattaattccaacgctctttgccatcatcattattattatcagtttttacccaaactccggcataactgttcaattggccggggcttaaattgaagccataaacatccatcgttactataaatccatagtagccatcttcttttggttgtgttatataccctaccatctgaaaaaaaaacatggggcagatagataaataagtatttcataaatttatagtaggtgaaaaatgattgattcgtaaataaaccactttacggtgagtataagaaattaccatactaatagaataagaaaaaaaggaaagcactatgtttattgtggtattgggattatattggcatatactccctccattttataatgtaagccattctagtattttccacattcatattgatgttaatgaatctagacatatatatctagagcaattttacggtctttgaggagggtacctcatagtacttaggtaagtactaaatttataatagaaaaagtggtaccttatgatatctcctcaaggaccgtaaaattgctcatatatctatctagattcattaacatcaatataaatgtaggaaatgctaaaatgaattacattgtgaaacggagaaagtattaatgatcaatataaactaagtgtataagaaattatatactacttcctccgtctcataaaaaaccaannnnnnnnnnnnnnnnnnnnacggagggagtacgtacttacagaaataacgtacttacaaataagaaacaagagttatataccaaatgcaaaactgtttctaaatatcacgtcaaaaaaaaactgtttctaaataaactttggtcttgctccgtggaaaattcaacagtagtaagctttgaaaagaaaactcacgtgaacagcctcgctgtcaacagcagcacggttcaatggctgcacccagtttgatctgtgaacaagctctgcaccacccctctcctgatgaaccattaatcccaaggttacatgacttgtttcgaaaacgaaacaaaaaacgtatgttgaaaaataatcctttttttcgaacgaatttgcatcagaatgcgctcatggctatagcatacacctaaatccactacgcaatgacgatgcaccagcaatgtattgcttaccgatcggttcgtcgaaagcacaggaagaatcatcagcaagcagatcagaaggaggccggggattgtcgccatctcgtcgatctcaatagttagcaataggatttgtagcgatatgtagcaaatgcaataggtcgccgcgtggcttatgtaataatatataggttgccgtgtttgatacatatggaatgtgttcttttggaagaaaaatatgggaaatatggaaatcattttgaatgaaatatggaaggcgactcacgcttcaaggtatagatggtcatatggcccgaggcccaacgacctagcccaaggcacaacaatttggcctgcccaagcacaacacggcccaactgggatgtgctcgtgccggcccgacctgacagcaaggccgtgcctaggctgcttcctcggcacggtgggccagcacgaccaaagaaaaatagttgagggatccatcgtagacttaatttagccatttgaggtacaacccaaagacaagaggtatacaaaatagacttattccagccatataagatacaacccaaaagagaagagggaggacaaatagacttattctagccatataagatagcccaaagagataagtgagaaaaaatatacttatttaatagagaagcacgatgggctatcatgccttcgggcccgcctagcacggcccgagtcttattgggctgagggtgcaacctgtgggtaggcatggcctggcccgatgtattggtcgggccgtggctaggcccggtcatggctggaccaggtggcccatttggccatctatacttcaagggggctgataggcttcaagaggcctgataggtgggttttaaagaggcactacactggaccttcaatgtgtcgtaccacgtagttgaaagtgattaaaaaaaggagggacatcttatttgttccagtgaaaaaaacagagaaagccacaaaaaggagggacatcttttatcaaacatcagatgtccgcgtactctactacatgcatgtagacccaaacacactcgtggtgtgcgctggcattttcttagaaatattattattttaataaaaagtcacaaaaacaaaagttggtatccggatttatttgcaaaaatagggacctgttgaactagcttagtttgacaagccaggcaatcgaatggagcgcattcgacgggatcctatcaagtggagcacattcgacgggatcctgtcgatccagccctgagctcgtgctgctgccgtcgtcatcgtcatcctcgcagtctccaccatggtcgtcgcctttcttgccattgtcatggcgcaccccactgcctgtgtgctgcttgctgccgcgttgacgcctgctagcctcccactgctcctcagcgagaagtagctgcccgccatggacctccgtttgatcttcaacgtcggcgtccaccgccacttgcagccgcccgacgagctcctcaacggacatatcatccatgtcctcgagcatctcaattgccaccgtgacttgcttcaacctcttcgggaccacgcgcaggaccttcttcaccacgtggctgtcttctatctcctccccaaggtcacgcaggctcgcggtgggcccgttgatgcgcatcgcaaagtcgccgacggtctccccgtcgcggaacatcatgttctcaaactccttcatgaagcgttgcacactcgctgacttcacgcggtcgtcgccggctcgcatcttcttcaccgagtcccacgcttccttcgccgacgtcttcacggcgagcccgaccttcatcttcggtggtaccgcgtgcaagatggtggccaacgcccgcctatccttggtgaccgcttccaccgcgtcccacaactccagcgcctccaagctcacccgcataaccaaggcccactgatggtagttggccctggttagcagcagcagctccatgacgctggaattgggcacgacgcgctccacggaggcatcggaggtcgagccatctccgatcttcatctccaggctctgataccaaatgttggcttagcctaggaacactctcacactcatgaacacaaacaaaataacaaatgaaggagtatagaggcttcttatagtccggggacacaccaggagctagcctccatgccggccattacgccacgttccacaggacccgcttgatgtcgccgtgagccacacgctcgcccagacgacgcggcttccttcccgaaccatgcgccacgcacaccactcctctaacaaactccgaccgagcgctctgcagcacccctgcactcgcgatcatgactcgatcgacctaacaagacgcacacaacgcacactacacaacacagacacacacacacacacacgcacaggctcactcacgccatgaacataccatggcgagtttatttccagcaattatgagctcataaagtaattccaggccgcttggggagcctggcactcgccgtcgccgtcgccgtcactgtagctgtagccgtcgccattgccgtcgccgtcgccgtagccgtagctgccgacgtcactgtagccgccgacgccgccgtagttgaagacgttgacggtgtatatggggccggtgaagtggggcccagacggcggggccgtcgccgtctccatcgttgtcggctgcttgctgacactctgcttcttcttcttcagttagctgatgcaccaatggattacgcttctgacgccgacgaggagcagtgcggcaacggcgatcgtcgccaccatatacaacagcgattccacactcatcttgctgccgttggcctttgggttggtgttggagtcgacagatgcatgagtgtagatgccgccggcggcaatgatgagtgccaccgccggaggtggaagtggaggtggaggaggaggttgcagagccattgtgtgtagaaagtgaaagtctgtgtctcacattcgcatcgactattcatcatatagcctgatcgaggttgattccatggaatcattgggcttgttgtgaggtaatactagcattgtagtctgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggctgaaaccctaaaactcatcgtagccggcatgctcctggaagaactcctcatcagcaggatccgcttcatcttcttcagcaactgggggggattatttatatagagcaagggtgagtacgggagtactcagcaagccatgggaagtaagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacctggccaacagctttttcaacggccacccgggccaacaacttttcaaacggccacccgggccaacaacttttcaaacggccacccgggcctagctgatcccatcagctacagatttttcaaacaccgaaccccttttcacacagcaatttcacaagcagtagtcaaaccaaactacgctaggaatcacctcacatccgtccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattcgacccatgtggtcgtacttgtcttatgtttggatgaaattccaaggaattggtccttaagtgcgagagcgggaaaccgtacacccggtacgttccccggtccgcggttttggaaattcatttagtttgcaagcaccgacccaggtgtcgggttttccaagtcttttgtaaaactccagttttacccaagttgttactcagattttaagtttgaaggcgaccgtcgatactggcacagggtgcacgaatatcgaggcgtagctggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaaaatgttcaaaggtggcttgccttgctcgagatctggagcttgatcctcgaaatcctcgcactgcgggtcttcgggctccgaaactacacgcaaaacgggacaactcaacaaacggcgaaaataaagccctattaatgacctctaagcgtgccattagatagatctcgagatttgagaaattttggaatttgaacggagtcaaacggatttacggttggaaagatattgaatttctaagattattggatttttggtctaaaggaaaaggatttaattaaatccttttttttggaaaagaaaagaaaagaaaaggggagagggagggaatatagacttccctcgggcggctagggcgcggcccgagagaaagggcggctcggccgagcttaacgggccggccggcccaagaaggtggcccagagcggcccaagacgcgcgcacgcgggagggaggagagagagagccggtggaccgggctcaccatgcgcggtcccgggtgggacccgcttgtcagcggctcggctcaccgtgcggagggagtacgtggctcatgcgcgcgggcgggggagggacgcggtgcacgcgcgcggttcgcggtggacgcggatgcagcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcgggcggcggcgagcggcggagcgaaccacggcgatacgggcaaaagctagcacacgggcggttgttcgtgatgaggggagacgagccaacggctcggattcgccagagggagttcaacggcggcgaatcgcggcggcgacaaccggcggggagggaagagggaaacgccgacgaggtcacgaggga

SEQ ID NO: 51392 - DNA, 19906 bp, Oryza sativa
ggcccggaggaaatcggcccatcgacccccgggggaggcaaaatagacttttgcggaggaatttgatttggaaggatttggattcggatttgaactcgacgatagatcggggattgagatcttgagatgacacggacactagacaacaagcaaagaaacaaatttcacaattagggtttttaagagataattttcccgctaggcgccacgacggaacgggcgctacatagtcccgctgtccgcatcttgtttcttcaaatgtcatgtttattcgtcgccgtgcgagggtggtttctatggcagttcagggacatccacctttacaagattactgcaacagaccatcttagccaattcgtcaggatatggtatacatggagcagcaaacccaacccaaccaatcaatcagctcacgttacatagttcaattttatggggtcttttgccatcccctgtaaatatttaggctctataaacctctttttttttcttttcttttttttggccgggttgattgaagaatagccaaccaattttattaagatttggaagagagacatagttcaaatacaaatttgtgatgtcgacagaaaacagttgaggcctggtgctaaaaccaaatcgtacgtgcacacactggaaacaaacactcttgctattttgcaccttgaatagccctgcatgcttcatgccataccttgatcttgtccgctcctcaaaaaccctcgcgttccttttctgtaaacctcttctccgtccatacataagcggcaatgcttttgccgattcttaaaggaaaaaatgtgaagggtggtttcttgtacaaaggtctgttcctttgataatttttgtggcttccgtgctctttcactgtagtttcacatctgctgaatttggtttctctctcacggttttactttctactgtttcttctttagggtgtgtttagttcgcgaaaaaaaaattttgggtgtcacattggatgtttgaccggatattagaatgggtttttggacacgaatgaaaaaactaatttcataactcgcctgaaaactgcgagacgaatttatgaagcctaattaatccgtcattagcacatgtgggttactatagcacttatagctaatcatggactaattaggctcaaaagattcgtctcgcgatttccatgcctgtgcaattagttttttaatctatattcaatgctctatgcatgtgtccaaagattcgatgtgatgtttttgggaaaaaaaaattgtgggaactaaacaaggccttatttcccagcttctgaccttcatgtcatgtcacgatatttcatttttcactgttaatgaacagattgcagagaagcaccctgtgcttacatgttaactgggtccttttggatgaaacagtggctactaaagaacttgaggagatgcaaggggtggcgctgcacgctaaattttgacacaaaagttgaaatggatctaaaaacccatatgtggattgttcatgaagtaatcagttagcttgagagcttgggttgttagaagcttactagattgtcagtggaggaagttcatgttgtgtggttaaagtgtacccatctggagaggttaactcactgttcgaacagtcgtgcctctagtcatgggctttacctcatagatttgtttgcatgtgctttgtgaaaagttgttgtggatgggggaatcattaccagaattagccaatgttgtaaatggataacctggtgttgacggtcgttaagtacaaactttaaccgtcaaatcttgcataaaagatatcaaatataatatcaaaacttagtggtaggtgtttactactaacattttccattaaatttggtaaatatatgtttataggtcatttatggatgaaaatacacccgccatgcgacaaaatgaaccttcaaccaatcgcaagcgagtacaaagattggagggttcacatgacaatcaaaaccgacctaaagttggaccaaaccaaccgacctaagttggtggtcagaggcggtgggaatggtttggccgaaccagacttcgcccccggcttaattccccccttgcacgtggtagcgtcctattggatggtgatgacggttataggtgaaccgacattggaacccaattctctaatctcaactcagtggtacggataggtggaatggagaaaaatagggaaacacagagggccaaggcccccactatttatatgtcttcaaattatattagtgcaaatatcattagggtcactcttcacataccatggtgcacatgtctatttctaagagtgatttattagttccaatcatatttagtcgtgtcatatgactccagtaaatatatagtggatccgtccctggaacgaagtgtccatttctttgtcaggctgatggacccacccagcttgcattggtccaccgtgaaacgagcccaagagtgcaaggcccattttgaagatggtctacatatcagggggtagtgctgggcagcagtagcacacaatcgcggcaaaaaccccaagctagcttcatagtgaaacaaaaaccaactaaaaccaactaagctcagaaagagagtaatggcgatgcagtactccagtgcgcctccccctcttcctcctcctccaacctctccgatcgtctatccctttctcctccgtagaccttcattccctcaccgctagcaataaccgagctgtgcgctccaccatctttgatcagctccccaccaccatcatgtgtcttcttgtcggttttgcactactggggttgggtgttgcggtggttttcctcgtatttactatctcgatctggatggggtacaagctcgctaagtactgttggaattcatagttaatcctgctattttgttttccctgactgtcaatactatagcgtgtctagcgtttttcgctttctgttttttcagttagtttgttcctattttcccgttttgtggagccgacgctccctgcgtggtgttcgattgtgcgcgtcgtggagttgtgcgtgtcgcgagtgggatgtgtgggatagcacacattgctaacgttcctcttttcccgctttgtggagccgacacctccctgcgtggtgtgcgatcgtgcgcgtcgtggagttgtgtgtgtcgcgagtgggatgtgtgggatagcacacattgctaaccaatcatggcgtacattgtgttttttcagttagtttgttcctcttttcccgttttgtggagccgacgcctccctgcgtgctttgcgattgtgcgtgtcctggagttgtgtgtcacgagtgggatgtgtgggatagcacacttgctaacattcctcttttcctgttttgtggagccgatgcctccctgcgtggtgtgcgatcgtgcgtgtcgtggagttgtgtgtgtcgcgagtgggatgtgtggggatgtgtgggatagcacacattgctaaccaatcatggcgtacattgtggaggaccatggcataaaacccggttgtgtctttctttatattttagagaagaaatacagaaaagttgccgcaacaattcgcagcacaaactcatgtgttcgtgttcttcagctccacctctcacgttgagtttgattctcaatcttttatagcgattttatgaagcctggtaacatttcgtatcagagccatgtccatgccgacgccgccaccgtgtccgcgtcagcaatcacgctcgcctcctcccccgccgtggttgccatcgtgaccaagagcttgtgtcattttggcgggtggtgaaggaggtgggcggcccggccaactacctcatgttgacgaagacgaactatgatgattgagcgctgatgatgaaggtcatgcttcaagcgcgcggactgtgggatgcagttgagcatggcgatgctaactttcaggaggatcgcacagtgctggaggcaatcctccgtgtcgttcctgccaagctgctcggcacactcgccatcaaagctactgcctaggaggcttgggacacagtgaagacgctgcatgtcggtgtcgaacgtgtgcgcaaggtgaaggcgcagactctcttgaaggagtacgaggcgattgagttcaaggatggcgagaccgtcgaagattttaaagttcaagcaaatggtcatgaaaagtttcaatatgtatttttgaactttgataatgatgtcatctatgcctaaaaaagagaaaagaaaaagaaatgttgttagggagtacgaaccattttttaatgtgtaaaggggtaaaatgagaaaaaaatagtttagtgggtcaaatgatcaatgaaacaatttgacggagtaaaatggattttctctgtatatttataaagtaaatctgcatattataaataaatatattgtatgtacattacaaatcaattactacctccatcccaaaatgtttgacgccgttgacttttttaaaaatgtttgaccgttcgtcttattcaaaaaatttaagtaattgttaattctttttctatcatttgatttattgttaaatatacttttatgtatatatatagttttacacatatcacaaaagtttttgaataaaacgaacggtcaaacatgtttaaaaaagtcaatggtgtcaaacatttagggaaggagggagaaatatacatgacatgaaaaaaatatatatactagatagcagtgatcaaaatcaatgttactccaattccataacttacaaaagcaacgaaataaacaacgctagtaaggagtagatggcagtagtgctcgatgtggcatccgagcttgttgtccttccgggaccaccatagaaaaactggtcgtcaacaatcgccgtgtaagagtagagcttcgggttggatgagaaacctataaaatgtctcgccgttgacaacgcttgcccctgctcgtcgatgagttgaatgttgctcatggatgctgccatgttgctgccatgacctgccatgtatccgctgcccaccggaggcagagcgggtgtcggctgaaacgttgcattattaatcgccatgccactgaaccataaggctatagccttgtaagccaggcctgagaagattgatttggggagacgaccaattagttcagggtcactattgaacccgtagtacaccaaccaatcccctgaagcactatcctgttaaccaaaagagatattaaaaaaaattaatacttcgagagattactttgacaattgtatttgccttcaattaattaagcagaccttgaatactttgagtgccatgtattgcctagccccatttggcctggagacactggggataaagtcgcctggttgtatagatgcaccgctctcaagttgaaaaccagggcattccatgtccacataggttgaacctgatattagagagctagcactcgatgcctttttttaagataaattgttagcaagagtgaggacaatacaaagttacaaacacctggacaataagaattaggaaaaagtatgaattacccccctgaactatcgcggtcgtctgaattatccccctaaatccgaaaatcagacatcgttcacccttaactttcaataccggacaaattacccccctcgacccaatccagagcggttttgcctacgtggcgtacgtgtggcaatccagtcagcattttcttattaaaaaaatgatggggtccacctgtcatcttccctcttcctcttctcctctctctctctctcatccacaagctgacaagcggggacgacggggatgggcggtggctggaggaggcgcagcacacggagcaggcgcgctggcgatggccgagatggagaagacaagtgccgcccggccatggaggcggccgaggaggcgcagcatggcatggcgcacggcggtgcggggaaggcagtggacggcgcggtcggcgtgcacggcggtgcggcccagctagagggtcacccctcaacagctggcgtgccaggtagggggcgcgttcgtgatttttgaggttctttcgagcgccggtgtggtgagtgtcgcgtcgccgctacgggggaaggcgcagcatcctcaggagtgtcgcgccaccccaggcaaggggcaagaccccccacatccccaccaggtaagcttggctaccaggtctttgtggcgagtcttcggaatgtccgagggcccccaaagctccagccctgcctcaccaagaagtacgacgatggcgccgacccctccgagtccctccagatctgcacggcgatcatagaggcggcggagggtggcgaccgggtcatgacgaacatcttccccatggccctcaggggccaagcgcagggttggcccatgaacctgttaccgcctcggttcactcctgggaggactcttgcagttttgagctccaggtgccgtcgaaacccgggaccccctgtgctggctcttctgtagcggctggctttggtcccgccggctggctacggtgcccggcccagctcaactgatcgtcctttcaagcttcaagtattttcaatttttcaattcattagcttaaaatcttatatttaattttcctccattctattctcatggccctgcgacactcgcgtgttgcgcatttgtttggcccctcggtggtaagagcccaacctctctcccatctacatgaatgattcttcgctaagtgtgggggctaagtcttctagccttatcctagccttaagttgagctccgggtgccgtcgaagcccgggaccccctgtgctggctcttccgtagcggctggctttggacccgccggctggctacggtgcccggcccggctcaactgtggacggggattgctggctctagaatttttcggctctcacactcgtgcgaaagtaatcgtccatgaagaaggaagagagattggaaggaggccaccgaaaggaaagagcgaacaaaatgtgtagcgttgaggcgcaggctcatgggagcttgaccttgtttgctaagtggtcgcaggcttccctaaagggttcggaacccatggtggggagccctcttcgagccaaaggtttgaaaggtcgcgacgtgtaaacaaggataaacaaaggtaacaaaggaggtgttacaatacccggaccaaagcagacctctataggaaagctcagcgttggccggggactctttttgagcttagcatttgtaatactttctttaagtatatatcttctttattcgcgcttatcagcaaaattatcatggcttatatttatctctcacccatctcttcctcgcggtcccatgattaccacgtgtcgcatgctcgtttgccccccttggtaacaaaaagtttgtattcacttcacccattcaaatgattctttgctaaaattgtgggggctacgattcctagctctatcctaaccctgcgtcgagctctagacgccgtcgacgcccggggccccctgtgctggctctcccgtagcagctggctttggccccgccggctggctatggcacctagcttggcttgatcgcgggtgaggattgctggctatggaaagttcagtcctcacactcacgcgaaaataatcgtttgaatagatgaagtagaacatgaacagaggttaacaaaaggcaggggcaagcgaggtgcgcagcatgaagtcgcgggcccgagagaatctaacaacgtttgctgaatatatacagaaaataagttcacaacctaaggtacgggacggtgagtcgccctcaagttggggcgaaaaagacgcatgggccctagtgccagcaaagaatggagaagagaccaggcccacatcgttagactaggagagtggcgtcaaccctggccaccgggggaaggttttggtcagggctaacgccgggggctactgtcagtgatatgggcccgggggtatcacatctagagggatgaggccaccctcaaacccacgtggctccctgcgaggggggatcaagcccggggtggagcggtggctacccccacccagctagagggaggaggccgccctcaaacccacgtggctctccccgaggggggtcgagcccagggtgttggggcggctgccccttcccagcttggggtcgggccgcccccaaacccacgtggctccccgcgaggggggatcaagcccggggtggagcggtggctaccccctcccagctagagggaggaggccgccctcaaacccacgtggctctccccgaggagggtcgagcccgggggttgcagcggctgcccttcccagcttggggtcgggctgcccccaaacccacgtggctccccccgaggagggttgagcccggggtggcgcggcggctaccccctcctagctagagggaggtggccgccctcaaactcacgtggctctccccgaggagggtcgagcccggggtgttgcggcggctgccccctcccagcttggggttgggccgcccccaaatccacgtggctccccccgaggggggtcgagcccggggtggcgcggcggctgccccctccaagctagagggaggaggccgccctcgcttggggtcgagctgccccgacccccttcacgtatcagctcacgtgtacagggttaggtgggcgcgcctaacgcctacctaactgcatttaaagcggtctatgcaaccgcgccatgccgcatttaatgcagcgtgctgcgcatctgaccggtctgtgaccggttgaatgaccgatgagacggcgactgtgtacccccgccctgtcagtgtgtcaggcggcgagcggcgtgctccgtcccgtcccatcccatcataatgatgaggggcttcacagcttcttatcccggtcagagctggtccaaccactctgaactgacccgggttcccgttttctggtgtgaacgagaacccaaaagtcctcatccattaaatggcgaatgacaagggcgccatgcatgatttgatgggccccgcgcagcaaccgacgtgcagatagcttctgggctaaggcaaaagacatgtaattaatatagagaatattttcccttctccctaggtagcactcgcagcacatgtggtatccccttagagtataaaaggaggaccatgcctagcggagaagggggatcggactgaggatccctgagccaaagcttgtctaaccctagcttgcataccagggattcagggactttctaagcacagaagaatcatacacacaggagtagggtattacgctttatagtggctcgaacctgtataaacctcttttgtctcatcgtcttggaggagcctccgagatcaagatcacacacagtttcgctcaccaaatccttgaatctcacccgctgcccccgaccgaactctcaaagggaggcctcacagcctcccgctagagagggtcacctctcgacaaacgtaaaatgagatattttgtatatataataatatgaatgaaatcattgcggtgaacataaccattcaaaagttggataagcaacttcaaattatttgtgcccatatgtaatagtccgtatgtgaaataatggtacgcataacattagcaatactccaaactgatcacttttttatttttcttaagctgcgtgcaattggtcatgaattagttcctaccatcttttctcctttttattttcacagaattaggcatttttactatcttttcgtacaatgctttttagcaccgtacatggttttatataattaggcgacctaactctcttcattatcatctcatgcgtgcgtgataagaccaaattttcttgttctgtttgtgtaggtcattgcgcttgttccttgatattttagatcttaattaactttgtgtataataaacatatataaaagttgattttgatatggactccagcattgcattacgatcgggctagaagtttttataagatggaagacgccttgcttttctttttctttcagtgagccaagtcagtcgacgtgattttttttcattagtgtcagaatcgctctctttttttttcattagattaagatttgatcttgtgattataaattttggtcccatcaatttaaagaaaaatcaatggtcaaatgttttttttcttttttttctttttagtttattagagtgatgcatggcggtttagaaacgtttataagagtatcaagttgcagcttaaaaaagtttgtacaatgttttaatagatttttaagtatataatagatatcattatctcatattccatcattcgctccataaaaaaaatattccatcattccatttcaatgtttgccaattgactttatttttcttttggttgaaacggtatgagtcctgtaaactgtaccctgatggcgccatctgaacgtgtcatggcttagtctgctacgttttgttccttgcaactgttctatacccttgagatggtgactgcctttagctaacaaaatgcccacttgtgcatacattctttcttttttccactctagtaattcatacgcacagttcatgctttgttctgtatcagcagttgattttcccgggagaacagcgtatcagcgtgtgagataagcattactccctctgtttcttagataataccgttaacttttaaacatatttttattatttattttattcatcatttttatataaatatataagatgtaaatcatacttaaaatattttgaatgatagaacacctcacaataaaataaattataattatatattttttaataataagatgaatagttaaatgtgtgataaaaaatcaatgatgttattattagaaacggatgtagtattattagtagatccgattgattacgtgtgaggccaagttaatcaatcaaaatcatccaccaactggtgcagcagggtccagtcatacaaagaaacacggccatatgtgggtcattatgttttgactgcatcagatcccgaattcgtgccacgtgatctgccgtcgtgtattcgtgtccactagaatatcagttcttcccggaaagatggctggtttatcgaatcatcgttgattactcgattggttaagaaagcgaagagctttgccccaatgctcagggaagcagggacaaactgagctgtgagaagtaggtaggctgcctttcagatttcagattcttttccacatcttcccctttctccccatcgctttcctgcatttgtacctgtcgctgctgattctagaaatccagaatttatttggatgaactgagaggtgtgaaagacagagacagaggagaggaggatggggttcttcttcttcgcgtcccgtgctgctgctcggttcttgggcgaggctaggatcatccaccccggcgtctccaccgctgcgcttcttgttgcagcagccaggtgcggccatggccatctcttttcactctgaaatcttctaaaattttgccctttttgtgggttatctttttgtccattttagcccccctttccccatcttttcggttttgtagttactttcctgtttgatctacaactctgacgctatagaacagtagactttgaggttttgttctttgacacttggataatcaatcatccatccactgtactgtataaaaaatagttcccctttaacgactttatccataagatcggtcccaagatttcagatttcagaacctatccgtctactactttttgtatatgcatttgctaattctgtgatttgtttattggcttggctctgcagtggtggaggccttgtggcgtatgctgattctgctggagagaatgcatcatcagagacatctcaggaggctcccaggaagaagaaggttgtggttcttgggactggctgggctgggacgtccttcctcaaagatcttgactgctccaagtatgaagtgaaagtcatatcgccccggaattactttgcatttacacctttgcttccgagtgtgacttgtgggactgtagaggcacgcagcatcgttgaaccgatacgaaagatgcttgagaaggtatgccttgtgttcatcaatagaaattccgatacgaaagatgcttgagaaggtatgccgtgtgttcatcaatagaaattcttgagccatgttaatttagccatctatgttactttggctgtagttgctggagtgcagaattgtggactgacacattgattgagtggttgtgccctattgttcttttgtagaaaaggaaagatgttgcattctatgaagctgagtgtttcaagattgatgcatcaaagaaagctgtccattgccggtctgccgttggaacaaattttgatggcaatggtgattttatggttgattatgattatttagttgttgctcttggggctacagtaaatacattcaacactcctggtgtgatggagaactgctactttctgaaggtaaaaatcctgaacgacattcagtagccttccatgttctgttatgtttcatattccaaccctagactctcttccaagaactgagcctatctcagttggtagaatgtgtaggtgtgcactcgcggttcccaggtctggatgttcttaggcttgaatttgttgcttatcatccttcacacacacacaaacaaacttgttcagtatatatatgtcatgtttgttgcgatgtcccaatgcaatagaatgattaatattttccctggagtagccactcggccacccaatatcattacatcctctgaaccatttgcttctgttacataatttagcccctactccttagtacaggataagtattcagtatgttgtaatgacattcatggaactacttactgtattctcgacttacagtttgcattgtaaaagtcaggaagtagaggatgctcaaaagatcaggaggaatgtgatagactgctttgaaaaagcttcacttcctaacattagtgaagaggagaaaggaagattcttcactttgtaattattggtggtgggcctactggggttgaatttgctgcagagatgcatgattttcttgttgaggatctggtgaagctatatcctgcaattcaagattttgtgaagataacaattattcagtccggtgaacatatattgaacatgtaaggcccttgctactttcaagaaaacgttttagccttctgaagaagaaaatttgttgtagttgtatctgttttctgctaaatattatgactagttttggggcattggaggttccttttttaggcaagcatttcaaacattatgaaaacaacagttccatatttttttaacattgataccatcaggtgtagcatcagcagatgaccttttcatccttcctgtgtgatcactatgtgttgtttcaggtttgaccaacggatagctacatttgctgaaatgaagttccagagagacggcattgaggtgaacacagggttcagagtggtaaaggtctctgatgatttaattacaatgaagagcaaatcccttggtgaggtatcagtaccatatggaatggctgtttggtctgctggcattggtactcgtcccgtcattatggacttcatgcaacagatcggtcaggttgttaaatttaaataaggtcgtttagtctgctggtattgaaagttgaaacttgtccagtttgcctgatcatgttttatttcaagcatttaattgaagtatccaaatgttctctcctttaacagactaatcggcgtgtcttggcaactaatgaatggttaagagttcatgagtgtgataatatatatgcaattggtgactgtgcttcaataactcaaaggaaaataatggtatgtccaaagcattccttatatattgtttgacagccaatagtgattgacttacaattccataccttgtattgatcatgttagccacatgtttgcattaggaagttagcaagtatacaatgccttgtgaatatatagattggttgcaagataatgtcaaaagtattgatttttttttctgtaggccatacatgcatttaggcactcaaaagtttatatttggcctaataacaagcaccatgaacatctgagttaccagcatttgggtttatattttatcaattcgctgacttacttttcctattctttcaggatgacatttcaacagtatttaaaatggctgataaagacaactccggcactctaacactcaaagagataaatgatgttcttgaagacatttgtataagatacccacaagtagaactgtatatgaaaagtatgcacatgcttgacattagggatttgataaaagatgccataggtgattctcacaaggagtcgatggtggttaacatagaggagttcaaaaaagctctgtctcatgtggattcccaagttaaaagtattccagcaacagctcaggttgccttcatttccatatgcaagtcatgtcccaatgatattttatcacagatttgttgtaatatgtgaagaagaaaccttgcacgtgtgaacattctgcatttcttgaaactttgccaggttgcagcacaacaaggacactatcttgctgaatgttttaacaagatggaccaatgcaaagaacatccagaaggtccgttgcgcatgacaggaacaggatcaggacgacacaatttccgcccattccggtacttagctttatcgttatacctgcatagtattgatttgggcctgtagtcagcttgttttcattagatatgctcttgacagaatttttttgcatgtatggtgtgcaaaactgcaaatgtatgctaattgagccaaatcttttttgtaacattagctcatttccctctacttatgcttgtttatctttccatgtccttgttttcaaggtacaagcatcttgggcaatttgcacccttgggtggagagcaagctgctgcagagctcccaggcgactgggtttccatgggccatagcactcagtggctctggtactctgtatatgcaaggtaagaacctgctgtcagcagcaaggccatcctctaccatctgtctgaactctactatctgtctgaactctgaagaaatcaaccatggcatctcattctactactgctctctacttcattcacagccttatctcttgcatcatgcctctgagcttactacaattcgtttagctgcaattctaccctgagagtttgtttctttcctccatgttttgtgtagcaaacaagtgagttggcgcacacggatgctggtggtatccgactggactcggaggttcatatttgggagggattcaagccgaatttagcactgccaaatgctgcatcatttcttgtagagataacattgctgaataattttgttgtctttggctgtgtttagttcgtgtgccaaaaaaaaatttttgaagtatacggacacatttgaagtattaaatgtagactaataacaaaacagattacagatttcgcttataaactgcgagacgaatctattaagcctaattaattcgtcattagcaaatgtttacttgagcaccacattgtcaaatcaagacgtaattagactcaaaagattcgtctcgcaatttacatgcaaactgtgcaattggtttttttcgtccatatttaatgctccatatatgtattcaaacatttgatgtgacggaaaagttgaaagttgaagaaaaaagtttgaatataaaccatgcctttgtaacatactactgttgaataataatgtggtgaactttctttgggcaaggaaagctgtttcctgtccctttcttgtcctgccaaccgaagctgacacttgataacactacagtatccttacatgcctgcactccagtgttatttgctcctactgccacatggctctctctaactgtgactgagagggtgagagtttctgcaatgatcggtcctctttagatcctccgagctattaaatagtcctctaaagttttgttatttagagtattaaacatagattactgataaaactcattccataatctctaaactattttgcgagacgaatctaataaggtatagtaatccatgatttgctacagtgatgctatagtaatcagccgctaatcatggattaatatatatcattagattcgtctcgtaaaatagcctagaggttatataattaattttatcagtaatctacatttaatacttctaaataggtaagattccggagaccaaacaaagccaagtcgcttcgatagtcactgactgggtcactgcagactgcatccgataggtgggtccctggcagctacggtgggcccacttgtcagccacaaccttaatactattgccttggataggtgagaagtgtgaaaatagtagcagttcagtagctgagtagcaccaactttgactgtcagtaatcagtaataacaaagctgaaagcaagtagcagtaataacagcgtgtctgcctcaaaggtagccatgaaaaccgtagtactacatcacatgtttggccgtaggccttgcctagccgtatgcatggtcctagtatacgtagtagtattgtggtacgcatgctgttgcagttgcagatggaatacgagtagagatgtggtactaatgcagaggatcaacagtaccacgcattagaatcactgtgcaccgtcggatcaagagtgaaaggaccagattgtgtgctacagtaaattcggaacagtaccaaatagtgcgctacagtgctttgaattctgtagctacagtaaatcgacactgttcatggcattagctaactgttcccctcacatgaacagtgctcttctgcattacggcagacgatccggatccgagatgtggtaccctctcctaatgctgcactgagcaaatggtccatccttgcctccctcatctgtcggctccatcacatgaacaccaccacccagtcaccactcaccaaccaggcaactctcttctcttcatatagctgaattcctattaattgcaataccataatatcatgttgaattgtttatgctatccattatgcaattctggtgtttataagcttagtgttgattatatagttcattttaaaaaaatatcacagtgcatcttatatgacttatattaaaaatagtaaattttacattggaccacattttgttattattgatgtttagctttcgaccatcttttaattaaggttttcacttaagactgaataattttatcttggtggtaccttagaccaccctcaatttttttttccatctacatccaacttgtcatatgtcaggaaaaaaaatctatatctttttttagataatagaatagaatatcccggcctttgctcaacgagctacagccaaaaaaaaatctatatctaactgtcaaagtttattggcgagtaggagccgacgtattcgaaatcgttcgtatgtttgagaagagagtagagtggtctaaagtgaaacaaagcaagattactcaatccaagatgaaaacattaataaaaggatggtctaaacaaaataatggtaataaaaggtgaaacaaattaagtaaaatttactaagaaccattacataaaaatctatgccaaaagaaaatttcggtcaaaattgacagtcttcttctcaaccatatccattgccatattggccgccctatgttgtcctgcatatttgttggtcctgctgccgatggaagatatcaggacagttaaagaactaagcaaaatctggataaaccccaatcacataattgctttttaagatcatagtaatagtcatccatcccaaagagcagatcgataaaactgatgaatatagttctatttcttgtgcaagatatgaaggtaataaaatatactccacagtgggtgcaggccagaattctcaagattctatctgaaccgatctgctatgctctctactctggagtctgaacagatcttaaccgttgttttcccattccaacgacaatggtcgtaataaccatataaaagtgttagtagtaccgaccatgtactatccttttacaacgttttcttccatgtttcattgcagttgccgtacagtaaaagtgcaattacacgttggaatgaatgcctgtctcctgactaatccatcccataataatatcccatcacatctcacaagcttaaactccaaggtttcttaagacaccttactagatacgcacacacgcaatcgagaacacattttgcatagatcgagtgcctttctctcgcagcatgtcctggcccagatcctgcactcacaatcaaagaaaaaaaaactaaaaaaaagtagagagaaacagagagaaaatgcaatagatgaactcattagcagcatagactgagcttagctgtttctgtactgtggctttaccttgaagtttcatacggagatacggctcatgttaggtgcccaacagcaagaggagcttctcttccaaatgccaggacatgtatgcatggatactaacaagaaaagagaagcgtaaagcttttgctgttattttagtcagggaaaaaggaaaggtacacttgatgatgtctcaacagttcatgatgagcactgcataatcatcaggctcaactgtagctcatggtctcatcccagggagatgattagtgtaatacaggcaacattctcattctcattctcattctcattctccaatccaaaaatattcttttgcactcacccaacccacccactgatataatccatcattccattcaactacacacctaatcgcagtaaattgttactccctccgtcccattttaagtacaaccatgagttttcgtattcaactttgatcgtccgtcttatttatttattttttatgattagtattattattattattattatatgataaatagtactttatatttgacttatatttttaaaaaaattaaacaaaacagacgatcaaagttgggtacgaaaaatcacttataatgggacggatggagtaattgggtttacataagaaaacaagctggatttgtatgcaaattgcagggaatacatgcctgcaagattccaatggaagaagaaagcatcaagtcaggaggggtaactagaggacagatcaaaggagatggtagtaacatgcacgcatcaccaaccagtctacactacacgatctaccttcactcacagagtaacagtgccatacacacgggtgcagtagtacgtgtacaaaaacaaaacaaaacaaaaacatttgtcacatagttgcatcatcaactccatctttaatacttcccaactcaccagcattgttatcagctgcaactctgaactccaagaagatgcattgctgcattacataggtaggcagtttgtgtgtgcattgctgttgctgcagagatgggagaagctgcagaggaaggagcagtggatggaagctgccatggtgaagcagcagcagaagctctcgaggtgctcaggtccatggcaatggcgtcctcctcgctgacatgctccatcccacagttcccggcgaaatggcagtctatcaaggacaagctccggcagctctgctccggcctggattccctgtgcggcagcgtcggcttcggcgtcgacgtcggcggcgatgaggagaggcatggcgtgctggtgcagcttgtggcgtcggcttcggcgacggtgaggagcatccaagccatggcgtcgcagtgcggcgatggcacgtacaagggtgggaggctccggctgaggagtgatttggacaacctgagctccaagctggaggcgcacatgaagcagctcagggagatggcttcctccgggatgccgtcgccgtcgcaggccatcgtcgcggtgaggccaagcgccgacgccggcgccggcgagaagatgttctacatgcgggatctcttctccagggtcaggattggcggctctgtccagaggagccagtcgctggccaccatcggggagctcctggcggaggacgaggtgtgcgtcaagatcgtcgccgtcgacatcgacgacggcgtcgccttgctcaccggcttcct

SEQ ID NO: 51393 - DNA, 11047 bp, Oryza sativa
acaacgtgtgggccgtgtgcgcgcacggcggcctcaccactctgctccacgcctgcggcgacgccggcagcggcggcaagctggtggcctgtcgttcgccgtgctgcgcaacctgagccgggtggaggaggtgaaggtgttcatggcggagcagggcgtggtcaccgagctggtgaagctgtcccagaagaaggaggaggcgcgcaagctcggcgccgtcgagctcctccacgccatggcgctcgacgacgccgacgtccgggaagaggccgtgagcatgggcgtgatccagtcgctgctccagtgatataccctgacctgccatactcctacaaggcaagggaggtcgcccttgcagccatctggttcttctgcttctcctccgtgaactccattgatgacctcatcagctcagatgttcttggctggcttctcttctacctcaacaatggcgattacgccgttcttgagtgcacactgaaaattctgcggcatttgtccgaggtttctgaggagtacaacaggatgatgggcagagcaggttatctcagtgcactgtcaagcttgcttggagcaaaatcatgtcgggttcgcgaaatggcagctcaagtgctctctagcttgctgttgcttcatccgaatcgcgtgattttcatccaagacggcgacaatttgaacaggttgctgcagttgcttgatccagctgagggaaaattggtggcaaaggacttgatcctttctgccatattgtccctggcagataccaacagtggaaggaagaagatcatatcatcagagcatttcagcagcctgaaggaattagctgatactggggactttgatgcaaagaaggttgttaagaagctaggaactaacagattccaaacaattttcagcaagatatggagtgtttaagttattttgacttcttttttttccttcagttcctttactgaatacacccttgatttagcattagtttatttgatttgttgtctatagtttttgcttgtcttgtaatatctatattcataattatgatttctctatgttgtacatttccacttctgtgaaattcaagtatcaatataatgccttcagacttctgtcatgatcaaaaccaagggactatatactagggtttacattatcgtcaataaccgcggttaccggccttaccgtgggggtacggtaatagaaaaaccacggtaacctcctcaaattcaaataatttttttaaaaaatgaatttttgataatttttgcacagttttgtacggtttttcacggttaccgtgcggtaaccgtgcttaccgccagggctgtggcgcggtaaccccggccccagcggtttgggaaaccctgctatatactgctactcttctgcagtttcgtttctgaatatagattagcaacaccgatttttactggccaacatttagcaaggcaggttcatcaaactgtttggcttctgatgaaagagcaatctcgattctcatctcatcagtctcaatttgcagggacacccaaagagtatcacttttattcctttgtgaagcaaggacaccaaaagtacttgaaaacagaaaatacttattttccataccatgtattctgagccgtcaactagacaactagacaactccagcaaatatcctgtactacattgtagataggccaaatacagcttcggcatctgaccatttgttaagactagcaggactgcaggaccaagtgtgtgttaacctgttaggaagtagccaaactaacagattaacccattcttattactttactggtaggagaaaaaaacagagagatagaacaggcaactgacaagtaaacacaggcacacagccatactgaaggtctgaagccaaacatgaggagtaacatttataacactgatatctctttcatactagcaaacaatgatcagcatttagtgagacaaagaacaggttgtcctatccaccaatttgcttgtttccttctcctatctttcgatacaggcgttcatcccgtgatacttttaagattagcacgtgaatctccagcaacgactgatccaggcttctgtttgtgggccaaaattcaccagattggcttgaattttgagtctgtaaatttactcacaatctgacaaccaatctgatttgtgatagactgatagtttacatgccccaagactgaaaatgcagtggtttggactcattgtcccatattagcatgcttatttatgcattttatcacccttatcatccctgggcagctaaattttgaacttactatactggagccaaacaaatttatgaggaaaaaatagaggtgtcagtttgtcactggatagttgtttcttgctgtcccaacacacaaggaagcagctaaagacaaaatgtagggaaatcagtaagccacttattgacttaaccacaccatgaatcctgtacttactcgaagtctcaaaccaaagagcacacttacaattccaaaacaagaaaccatagaatggactcatcactactactatctcttttcacacattgactagcataggaaggccttgacaaaagaaacaaaaaaaaaagaaagaaagaggaaccagaccatgagatatgaatgtaacagtagccggaccatttatgcaacacgcccctgcaaaaagaaaagcctcactcgaatgctagctcaagataagcaggcaccttgaacactcaagaagaagacggagctgagctgatggaaggaacggatcaaaccatggtggttcatctcaagcttctgcgaccgcctcgggtgcttcgacgtcgagcgcccgcccgtcctcggctgcagccgtgaagaacgagcgcttcccgaccaattcggcaacccgcttggcgcatccggaatcgcgagggctctcgtcaggaggcggcatggtcctgatctttgggagcatttcagcaaccttggatatcgtttgaggagagagtggatcattggaaggctcgatgaccttcgctctgatttcctcattctggttcgcatcccctgatgatcctgggagagactgcttgcgtcgcctctcctgtgctccactgcttccaagggaagcgccaggagtgaggctgtagcggctcgggatgaccctcatcttggagctcccgccatcctcttggcagtggcggcggcggcggcgctgccgctctgacttgacgacgcacctttgggcttgagctcatccaccaccttgttgcctccccttgtgtcagtagccttgccattggattgcctcctgggcctggggctcgggctcctcgccttcgctcgacttgctgctgttccttgcctcgagtccagtgtctgccttgtattgctcgacggccatggcttggcggggacggcgaattgcttggagggtcgggtttcttctcgaatggcgttgagcttggtggtgaacggcttggctcgcgccgccgctggtgccttgctgccgacgccgtggtggatctccaacggcccgaggctgacgcccctgcgacgctgcaccggaggctccttgattggcttcaggatccgcgccgtgccagcgcgttgctgttgctgatgctgcgccgccgcgggcaccctagggttcgccgcggcgatctccatgggcccgaggctgagccccctgccccgcgtcgccggaggcttcttggtgcgcagcggatgcttctcacgattgacgatggagatcacatccaggggcccgaggctgaggcccctcggccggggcctcaccttcgcgaccatctcccccatcggagcgtcgtcgcggttgggctccggctgcttggagacgcggagatggtggagccgggacgagaggcgcaggatctccgcctcgatgtggccgatctcggcctcgacgtcgtagccggcggcgacatcaacaacctcggggcggtgattctccttgtcgcccttgcggacggccgcgacggcggggctttgggggagccaagccgatctggaacacgaggagtcgtcgaaggcggcgttgttccagacgtggaccagcgggatgagcgggtcctcctccatcgcctccgccgacgaaccccttcgcctcctcctcctgcaacaacaacggcggtggccgcagagatcagagaccaggcgcaaatcaatcgacgaacaaacaaacaaacaaacaaacaaaatcgaaccgaatcgtcagcgagagcaaatcgacgagcacgcacctggatcgaatcgatcgattgatcaatcggtcggttgattcgagcggattccttcccctttgcgcgattagcgcggagcttggatcggattaggtggtgagaacttttgaaatttgtgggaaggggaggatgatgcgaggagggggcgagaggaagagggtttaagagccaggtcagattcgaccgttgggacttggggagcggagggggagcgcgccgcttatatatttacaagtggatttttctttcttagaaaaaaggaaaaggaaaatacatgagcagacactgcggatggagacatggtgtgtggtggggttaacaagaccgaaagacgttgtaggaagtgcgcatccaccaaactccgctccttgtcttctctccatcgaaccatcctgaaattcattttccttttgccagttttcgtctcatttttcgggggacatgtgtgcacactatactactcctttcaaaaaaaaaaaacagtatatgctttttgtgtgtactacgctagttactactacctccgcctcaaaataagtgcagccgtggatattcgtgcccaacgtttaaccgtccgtcttatttgaaaattttgtgaaaaatttgaaaatatttagttacacataaagtactatttatgttttatcatctaatagcaataaaaatactaatcataaaaaaattttaaataagacgaacagtcaaacgttgaacgtgaatagtgtaaaactacacttattttgggacggagggagtaccagtagagtatggtttctttatacttacgtttttaacgttgtttaatcgaggcatcgagtgttcctcccatacaaattagagccgtagattgcacgaatgcgcaaaccccacaaacagaaaacagagggaacaggaatgtattggagggcgtttgctttctgagttcagaaagttgccgccaaattacaaacttgtgtgagttttgaaatttgaaaggggaaagatcaaacttattcatttgttcttcgcacgtcacgtcatatagggcctgtttggcacaggctggagcttagacaaacagtttcagctccaccaaaattgggagtggagctgggtagagctctctcacaaaataaactagagttatggagttgggtttagtcagctccataactccactccagacccaactcctggagctaaatttaggagttggagctgtaccaaacaggcccatagtcgctaatgcaaaatggtacttttgcttgggctgatggacttgccaatttgccatcagcccatcagcagcccatgcgtggtggcggccttcggggcatgacatgaaagccccttgtcttcaactcaatgggccgcggaaacaagcccattgagaacatagtatgacggaactcgaggaaattagcaaaagcccataggcaattttataccccatctccttataccctttttattattgactttgcttcagtacgtcacgcatgtacacatagcatgtggtcaggcatacctggcccgtatctcacgagtcacaatcctaaatgaactttctcttcctttctcttctttatttgagaagatgagctaattttctctgtaataaacacctaaacaaaggaagaaacactaacacaaatcgcaatctgccaagcaacgtgatcgtgcagcttgtggagtaagcgaaccaaataattgagcagctttgccaagtaacagaaacaaataaacaagtatgccaagttgccaagccatagagcggtagagccccgtcacacaaacggtttggtacgatgcaacctagcttcccggggcacagaggagacacgagacaggccggatcgccgtcagttgggcccccagagcagcaggtgcatgatcttctccgtcttcatgatctccgtctccgccgcgtgccgcctccgcacctccgcctcccacgctctcgctctcgccctcgccctcgccctcgacatcgtcaccgcctccgcctccgcctccgtcgcctgccggccgcgcccgtccaccgaaggctgccgctgctgctgctcgcccttggcggcgtcgcgctcccgcagcagcgacgccgcgcggaacgcggactcccgcttgcactcccgcccgttgcacatcaccgccgcgccgatgcccaccaccacggcaccacctgatgctcgcgtgccgcgctcctcgtgtcgatttcgtgtgcaaagctactagtaatagccagcttagccagctaatttgcctttctggcatgttatatagggcgccacgaaatttttgtcgcccatgcgatgcggtgacgtgacgtgactggggctcggctcggccacgggtggagcgcgtcgtgacaggtcggtcggtcgcggcctcgtggggttgcggcgtcaagcgtgcggtggggagcgcggcggcgtgcgcgcctcgactcgacaagtcgacagggcgggggggaaacggtggacgggagcgaccacggatttgggccgagccgttaggcacacgacgggggccgtcgtcgtacggcgcgaacccagagaaaacggccgttccaaaccggtgggtatgtgcggctcgcgcggcgcgggatgggggtgtgcaccgcacctggtgctctgttccctttctcctctccgcgtcggtgcaaccaacaactcgcgaatcggccagcgatatgttcggtttttattttcttcgctctgtgactctgtctctgtctcttccatttcttttcgtttctattttacgaggaggacatgttcgagttgtacgctgcggcgccggcgcaccatgctgcccactacgctctttttttctctcgttaagatagtacttattttatccctatttttattagcacgtttttaaactactaaacggtgcggtgcgttctgtacgaaaactttctatatacaagttttttttaaaaaaaatatcaaacgtatacatttgttaagtttgcaatagttaaaatttaattaattatatgctaatagttttcttattttacgtgcgtcaacttaatctttattttcatcactttttagagcaagtacaatgagagactataagcccgctataaacatatttcgaggagatgaaatagaagagaaaagaacagagggctacagatttgtagccaactgaaacacggactcccaaatacatgtgtgcatgacaagtgtgaaaagataaattgactattaagttaactatagataatttaaagccagcggttggctatactattaaacttgctcttaaacaccccagctgcgaacccacgcgcagcctctggatactcccgaggatcaccgccggcgcatattcgtggcgccgtttttattttagtgcgattgaaatggagtacaacaagtgtgtttagtacttgttgattgagttgattccgtcgcatttggcgcgtgcccatttgcttagtactaaagcccagtctgtacgtagaagactaaggcttaaggctctgttcttttggttgagttgggaacccatccctccggtacggaaaacgaaacagtccattagcacgtgattaattaattatttgctattttttttcaaaaatggatcaatataatttttttaagcaactttcgtatataaactttttgcaaaaaatacaccgtttagcagtttgaaaagcgtgcgcgtgaaaaatgagacgggggagttgggaactccaggaaacgaacagagcctaaaggcaaacggaatccacacaaaagagagaatttcaactgttataaatagcagccgtgatgtggagagtacgctgattgttggatacagcgtgcagctcttacggcggcagccggcagagcgtgaagaatctagaggatgttgaacatggtaacataagacaagtatcttctgcaagcctttgtgatgtttcatgtgaactaccactcaacttcaacatatctttctttagtgaagagcaaaagaaccttattaatttttctttaacagagaggagcggtagtagagtactgatacatgacttcatgtgtttgtcacttaattaaaagttcccaaaccgtttgatttgtgttaaatcttataaaatccacaatctcattaggggttatatttcaccaacaaacgtgatttcaaaccatgtctgacaattacgcacgtgtgattacactttcaatagaaaagtacttcatccattccattttaagtgtagttgtacgtttctatgtctaatatttctgtccattttatttgaaaattttattaaaaaataaaaataaagtcatgtctaaactattattcatgttttataatctaataacaataaaaaaataattacaaaaaaaaattaaataagacagatggtcccacaactatgatatgggacggagagagcagtgatgtttataaaaacaatgagagaggggaaaagaaatgtttatcaatttacgagtgctcaaaagttaatcactaatttgactacacactttcagaaaagatcgtctgtgactttgttcagtgacaccagtcgatagaatattctaccggtgcaaccaaacccaactctcaagctaccctcaaccctggtttttgggaatcagtgtgtagtttactcgtcccaaaccagcaaccggagccccctgtttcgcactcatcgcgtccttcctcgctgccacccctccccacccgccggatcccccatatataaatgcccctcacctcgtctcctcgccattgccgcaactcacagctcagtgtcaaccaccacaaccacaagcaagcaagccatacacatcaagaaggcgtctgcgtgcgaggaaatcatccggtttttcaagctaaaagcgtgaagatgagctcgtcgtcgttgagcaagaaggcgtcgtcgttcgtggtgacggcgagcatgagcgcggtggaggcgctcaaggaccaggcggggctgtgccggtgggactacgcgctccggtcgctgtaccagcgcgccgccgccgccaagcaggtcaccggccgcgccgtcccggtgtcgctgtcgtcgcagaccggcggcgcggcggcgtcctcctctcccgccgccgcgtgcggcagggccgccaggtcgaagaggtcggaggaggagaagatgcagaaggcgtatcacctcgtctgctggggacctaattaaaatctgttcttcaaattcgtgatttcgtgtagtagttttttcgtttgcaatttgtccacccctcattttctggtgtgtaaatcgagccaatacctgcagggatttttgtattttgatccgttttcatgtactactacttccccatctgattctgatggagaattgctatgtgcaaactacggagtaaaaatcaacaagatgatgcgattgttgcacggaattaattacctcttctctgttgggtgttcatcatctgttgcaacagaaataaacaaaaaaaaagaatctttagttctaaccataactgagttgctgcattgttgttagtgcttggtagtagtggttgcatggcagagatgccaaacgcatgattgagtgaagcgctgatgatgatcagatcaccggccaaatgcgcatcaacatggaccggttaccgttgttcatcaacgctgcactcaatgatgcatttgattctctgtttccataccgacttgtcccctctgacatgatctgcatctcgttatataatagtgtgcgctctggaaaacactggatccaagcttgaacaagtggtactgcgtgtactactgtactacagctgctgcaactttcgtgtgttagatcgagcttgtactactgccaagtgattagcataggggtgtgtttagttcacgctaaaattagaagtttggttgaaattggaacgatatgatagaaaaattgaaagttatatgtgtagaaaagttttgatgtgatggaaaagttaaaagtttttttaaaaaagtttgaaactaaacacgatgtaggtagagcgtgtcttcacggccccaacgagtttcacgaatgtacaaggtgtcgaaccactgcccagctacaactagatttcacaaagatcaaacatcaagtttggtagtaccaagtatattgcccacaacaatattcaagattgtgtaaaagaaaaggcatacgtgcacactatttctttgtactgctcacccaactaatcatcctggtgtgtatctcaggagtaggagggcatttcaacctcgtcgtccatgcgagtcatgacacacaattgtccagttaaaaatgcttaactggtcatcaggatgcgtggcatgacacaccacaattgtccggttaaaaatgcttaacacacaaagatctacgccatgatttgcctgcttgggttggttgctgatgcactagtacgttgacctcatgttatgatgtcagcatcactagagggtgggctagctttgaactgggcttagtcatggcccatgggcttgtaaacatccaacgaaggtcataaaaacatgccgacgccgaacgtcactagtctctacaacatgcaactatgcaaggttggagagtaattcacggagcgaatatcgaataaccgccgaacaagcgcttaattttagcatttcgattaaaattcttggttgaattgcactatgaacaaaattacttctactacaagtctacaaatcaacaagttaaacgtaattaacctctacatgatcgatctcccaaattaaactaacctgtaggggcgatcagatcagaatcaaacagttcgtgaggcgccatttggtcagtattttttttttatccccgatcggcgtctcgccggagaaaccagagcacctcgtcgggcg

SEQ ID NO: 51394 - DNA, 6344 bp, Oryza sativa
ccctgtggccgagctcggcgaagccgtgcgccaccttgttcccgccgcggcgcacgtgggacacagccatgtcgtcgagctgcgggagcagcgcggcgatctccctgcacagcctcaggtcctcctccgactgcacgtcggcgcggtcgcacaccacgtcgaccaccgccttggagtcgccctccgcccagacgcgccgccacccgttccgcaccgccagctcgagccctcgccggagcgcggcgagctccgcgacggagctcgtcgccgtgccgatccgctccgcgtagccgagcaggaacgcgccgtcgtggtcgcggtacacgccgccgatgctcgcgatcccggtcgagtgcttcgacgacccgtcgaagttgagcttcatccacccctcctccggcttcctccagatcctcgccgacgccgacgagtaggcacgaagacgcaagatccgccgccctccgccgccgacgaggatgcaacccagaacggggttgcgccgccgcagcacacccagatcagcgcggtgcacgcgcagcatcaccgatcccctcgcagaaaaaatcgcaatctgttcgtgtatttagccccaagcggacccaccaatagggcaaggttgggaaatggctagacccaccggcgccggcgaatatccgccttccccggacttgttcctcttgagcgccgccgcggcgcaggcaaagctcgagcagcgctcaggcgcgccatggcggcgccggcggcgaaggagaggagaagggtttgcgttgcgtgtgttgctgtacttgataatgggctatagtcctatgggctacatgtggatcggcccatgatgacccatatttgtacccaggcccaggcgtcaattcattcatgggcttcattccaggccgtgtttgtgatcggtacgcagccatctcttccttggggcttttaactatttgccatttttagatttggcaaataactatttgccaccccctatctcaatgatatgtgggtccacatgtgtctatgacatgtgagttcagtggtaaaaaattaattacaacatctaaatgtggcaaatggtcaaatgcactgttctgactgcagaacatcacaaatcgtgatgaaacattgaaacacacacattaatcactggtgttggtagtcagcccactacacggtccatccatccttggacaaaagccgacgctgcggcccactacacggccccgtctcctgcgtactcaggtgactcggctacagcctacagagcagagctggttactctgcttcgtagcaaaagacgctttgcactttgcagcttggtgagcgtttacgacgtacgacaacgcgtcgcacgaagggaaactactaccgtgccgccgcgcgcattcctctgccaatttctaaaggcgacgaggaggctgtgtgttgcagtctcccggttaagtttccaggcctttttctgtgtcgtgtataacagctagatcaaggctgaggcagcctgcaattccaattcgccatagagagagaaaaggaggtttggctttggatagctaatatgctctctaagtaagcgattaactgatttgtttatgaacaagtgtggatcgtttcctgcgtatcagatgatcttggggataagaacaagccagcaacgctattttccaagcatatataacccagatcaatcgactggaatcagattccttcgatctcaatgcgtatgcatgcgtacgcattggaaggaacctttgctaacttcgaagagaagaagcacatcgtagcatctcgatctgcaactgtgtttgcaagcagacagagcagctagcacaggttgcgcaagcagcagtttgctgctaatcaggagacaccagactgaaaatgttgtgcccctttcaccggctcttaacccctggagattctgcatctccaatcccatattcatattcttcaacaacttgacactccataacactagttagtccagtatcgccactgattgatctagagcatggagagaccaacctagctgtgagatgagacatgcatgcattgcatgctccgttgctgacctaggcagctcgtgatccggtaccacacttaattaacaagctaattgattatttgattacagtactagcacttaattaaatcagccatggcgatgtaaccacgttgcagagaagaatcctagaagctagcagcagctagtagaaatgagcacagctgtgcctcctcgcagtggacagctcacctcaatctgtagcacacaaacactacgatccccaacaatccaatctacccaatttgcagcaaacaaaaccgttaaatcttttttctcagggagcaaggctcacgtgtgcatcgacagatcacagcgtgaagccgtggagaaaacaccaagcccagcgtgcagctgctttgaccgggcgtacgtgcatccgatcgatcgatcgatcgatccgagcagatgccgctgcggctgcgccctgtcgcgggggctccgcggcgcaacccgcgggcgctgccgccaccggcaaggggacatcgtgccgagaatctcaggcgcaggggagaggcagcacggcagcagccagtaggcaggttgcagttgggtttttttttctgaatttctgaactggccgtggatggaggttggggattcagaggggagaaaaaaccgagaaattgccaggcgtgaggtaggtgcacaggcagcacagctcagtgccactgccaatcatccgatgaattgataaaatatttatcatttgaaggcgtggcagatcagggcagtaatgaacgaaacattactacagctcatgacctggctacagttcacgatggacacctcatcagctaagaagcatctaccaagaatcttacttccatccacatcaatcagttcgatcaattctcaccggcaaaattcctggagatataactgatgaaccagttcaagtgcaacgcacacagatacatcatattaattcaccgcaccgtgcactaaacttcacgacggatctccgcccggttcgttgcaccttgcagacgtctgattttagtgattcgatctccaaagtctccgtcggcgctggaccaaaaatatcaccggagcagccacgatattgcaccaaatcaacacgctactagtgcccaaaaaaaaaacggagtacgagttggcagtagctgtgtcaaccgggggaaattccgtgaggtcacgaacgccgccgatgttggacaggcgagcgagacggcgacggcacggtgaattcaagaggacagtacgggtacagtggcatatggtgtactagtctgtcttgaaaaagggtaaaccctcgtaactaggattgattttttttatttttttctaagacgaaggggtacgtggtgatacttgagagaggcgaaggcagcaaacctggagatcgaaaaccgtcgctttcgagcccttttctcgtgcggatctccttgccgcttttgaagcttccggccacattttcggaagctcccggcccagcttactgctgaaaaaaaaaatcatcgcgtccccgtctcatcagttcgttggtcacggatgaggcaaacgcggatgaggggaaaaaaatcgggatgattttgatgggactcaaatcaacctgagaccgggtaaaacacacacgctatacgagtgtggctgtgtgggtgacgagactcgccagtaaaatttgacaatttgacatcgccttcgccgtgttgaattgggcaatctccagacggacggagggaggcaggccggcacgcacgtcggggtggctccgtgtgttttgacctcgccaccactcggagcaggcaaggaggctgctaattcttgactaatcatagtcatcaatcaagaagacaaaaatgaatagaacaagtattagctgatacagtaagtctttggagggcgatgacgtctgcgcccgtttgcaaaattgttcaagcgaacttcaattccttaatcgatcgactgattatgtatgaaaattgcaagaatttgggaggctgttcgtttccttttcagagaggaagaggcaatgtatggatgcacggacagtttgtgaaacgaagaagcttgctgatcaattaattcagattccagtttccacttggaacgaagaaacaagcagagtgtagtacatgagagtacaaatgcgattggaatccgcgaaccaatgagcagtgcccttgatgaatcctgatgctatgaacaacgagaagaaagaagaaagaaagaaaaaaagaagaagaatcctatccatgtcgaactttctaatgaaagaggaactgtgaggcctgggcgacggcgtcgtcgagccaccggcgaggctcgtccatgaggtcggggctgagcctgaccatgaggacgcagaactccatctcgctgagggcgccgtcgccgtcgaagtcgccctcggcgagcatcccccggaggtcgtcgtcggacatcccgccgaggccgagcagcggcgcgttgcggcggaggctgtcgaaggtgatgagcccggaggccgggtccatgagcaggcggaacccgcttgcgagctcctgcatcagcccttcctcccccagcctctccgccatcaccggcaggtagtcctcgaacccctcctgcatcatctgctgctgctgtctctgctccgccgccatgagaatgagtgaggttgactgatcgatcgatttgttgtgttcttgtttgcttcttgcgatctttgagaggaggagaagaggagagggatgatttgatgtggtggggaggaggcgggaataaataggggaggaggaggtggtgggcttcagagaagttgcgagagaggacggtggatgtgggggggtctcacgtgtgggtgcgtggtggattgtttggattggattcctggacgcgcggggacaggttggacgcgcgcgcgtaggggggaggatgggatgagttgggcgtgggctggagggaggaaaaccgcggcttcctgcgcgcttcggcttggacgtcgcgtcgggtcgggtcgggttgggtcgggtcggcgcgagcgcgtggctgcggccgcgtgggtgtgctgtgggtgcgtgtggctgggcaggtttcgggtcgtagcagcgccgacgcggtgacgtggtcggggcggcgggtggatggtgcgtgtcacgtcacgcttcggggtggtggacagacggacggacggtgtcggaggaatcgtgggaccatgccgatacgagatcagggatcatatttcttcgcccacgtataaatcaccagacaaaatttttcatcatatcacattgagatatcacattgaatgtttgacacgtgtataacgtattaaaaataaaaaaataactaattatacagattgcgtgtaaattatgtgacgagtcttttaagcctaattgctccttgatctgataatgttgtgctacagtaaatatttgctaataataaattaattaagcttaataaattcgtctcgcagtttacaagcggaatctataatttgtgttattattagtctacgtttaatacttcaattgtgtgtccgtatatccgatataacacaccaaaactttacgcccctatatctaaacacagtcgagaaaaatgctataggacggaatcttgttcgaacagaatgatacctctgagctattgttatctgatacctgatagatatcgactaataccccgttcggatggaataatatctttgaggtatcgcctgatacctggtagtggtaggtatcggctgatacccaggtatcaggtgatacctctaagatattatccggatcaaacgggataccgtctagtagcattcccctatttctaaacataacactaacatttcatgcttacgacacacgcatactcacatctatgaacatatatgcacaccttatctttatgaatatttttgaaagattaagtcggcatatattgagattgacgaagtcactacagatatctcgctgttgatgagtacataacctatcactgaaagaagctatgaatgtgagcattgtgtcgtagtatttttgattgaatggctccgatcaaacatgatttctacgaaattcatcacgaactcaaaaactttgatttggtcaagactcaggagagtgatttgagtttatctcgttgtgaaattcaggggttcctgacgttggacctcctctgctgcgtcgactcgacttgcttaggtctgatttagggtcacgattgagaagtttcgtgtcccgttttttggtcgcccatgttgggcacgtttagccgtaacaggacgaagtgtcacccatcctttacccaaagtttccatggaagcttcggtcagaaaccccaa

SEQ ID NO: 51395 - DNA, 9592 bp, Oryza sativa
  unsure (1)..(9592): unsure at all n locations
gccattagcaaatatttatagcaccacgttatcaaatcatggagtaattaggtttaaaagattcgtctcataatttacacgcaatctgtgtaattaatttttttatctatgtttaatactttatgtatgtatcaaacattcgataaacattggataagatacggtgaaactttttgcgtgggcagagtaggactagtattttactcgtaccagcagccgggcctatctcacttcgttgtctgcctttcacatctcgaattctcgactccaatctccatattttccatgtgcttttcctctctgactactaatatcactttatttctgctgatgatgctgtcactttcacactgaagctctcagctcaagggccaatgggccatgttggtgactactttagtgagcaactttctaaaggaaacatgaagatacaacaaactacacaaaagaagttaggcaggataatcaaatctgaaggtgaaattgcacttggagatggatggacagagtcacacagggcaacatcatgaggcacctcagcattttacttgcaggcacaaagtctggagctggaaatttcagggggaagggggaccattctgacctgaaactgaacctgctgggaagagcccaaaggctactacccaagttacctgtcctgaaaacagcgccttttaaggatctgtctcacctgagctgttgcccatcatgcgcagcaactaaagttcagtcgaagttgccacttgccagtaggctcttgcctagtcagagcatcttcgtttcaacaccgaggaaagatcaaagatgagagtttgtgacaacatgggctcaactttcctgttgaattctgtgacaagaacgtacaccaacggcagtcaacggcgtcgttgacggtcatatcagataatcttatgtttacatttttacttcaactcctaatgtatgtagctttatgcaaagggtggtaataatgtacacttcatggtcattcctgaatcctgaaccattgtgctctacctatatgatagctgttttctgggctaaaacctgactgaaccattggactgatgctttgggtatcctcgtcaggttgttcttgtagtcaatgtagtagagaccgaatcgcaccgtgtagcctgagttccattcccagttatcgagcagggaccatacaaagtaaccatggacgttgcaaccttctttcctgcagtaattcaagtcggagagttcttaagtagccgtgaaacatatggtcataactgtcaacagaagattgatgcagtcatgctaactgtagctatgtatgcaatcatgatggtgtgtaactagcttctcccgtgtcattctgggggtctgaatgcaacaattcggtgaagctttggtagaaggcagatgcagattatgtggacagtgccgttcctgcggttatctcaggaactagagagctatgtgtatgttttaccagatttattgtatctgctttgcacatatggatgcccattggtgcgataagctagcttgcactcaagaacaacaagagttgtgaacctactgccttcgttcccttacgctgtatctatgtgccaattatagctcccctatgatggaaagtaagcttttggcttcccctctcgaaagaagagaactgctgatgattttatatgttccaatgtatgtacacagaagtgaaacttcaccttatagcatccaggagattagacatataatcattgtggtactgtatccttttatcatcttgtaggacgtcttctaatctagaaaatgggtggttggcatcatccatacctgccataaacagctccctttgttaactattattatatgctttttaaggaaagaattcttatctactgtcaataatctccagccaacataccattttcagtaatgactacgggcgggtttccatacttttctttcacatgtttcatcagcttgaacataccccatggaactatgtgcagccaacttgatgctgcctgaaagttgatcaatacaaattttagtttcaaccaatcatttgactagaaatagcataaatgaaaggataggtataagtataacaagtcttagcaacggcaagaatggctttgcaaattgtaccgtttctcctattttcttcccatgtctataagctgccatagtgcatgcagagaagtcagtaatactgaaaacagaccaggaaatttagaatctctttatttatcaagactgaccagttggtatgacagcagaatcggttgaagcatcatccattacaagtttcctgatccgcaatctatcgtttctagcatatagtgtagtgtagtggtttatgccaacaaaatctagtgatccagataccaactttgatgcgtgagttgaaaactgaggcagcctatcacctgcaagtttctgcatagaaggaggatagtggccgaacattaagggatccaagaacctgtattcacactagaaaaatgtcataattaatatacgtccagttgctatttagtgtaattatataggaatttaaattaattgatgtatcaccatccaagctcaaagtccattgctcgcgctgctgcttctgtgtcttcatcggcatttgagaacggttcataccatctagaattaagcgcaatcccaatgaggcctccttgttcattctgcaattcatacaaaaaatgcatgcatactattgtcttaattgcttctatttttaagaaaaaaaacattactagaaaatttagtcacatggatcaccttgaaatgttgttcataagcacgaaaagcaccagcatgagctaaaagtatgttgtgagctacaatatatggttcagttgatgatttaccctctctacagaacacatgtgacagaatagaacatctcccaggtgcttggatgccaaggtcatagccgtcaatcgcaaagttgtaaggctcattaaaagtgatccagtgcttcactctatctccaaattccttgaagcaagtaaacgcgtactgaacaaaatcctcgctgcacaattaagatgtcataatcactacaaaaaagaatagaaagagaaattttgatgctacctaaccgtttaactgattatctcagctaaaggaagatgatgtgatagtcttccatacatgatttctgagttcaaccagcctccgtatctgtcttcgagtgcttggggaaggtcccagtggaagagagttacatatggttctatgcctgatccacaaatatagagaacaccaaagaaaaaaagttcatattaatggctgttggaaacagtttgcattatgcagacaccaaacaatagaatacactagacctttatctaacagggcatctatgaggctgttatagtaactcaatccttcttcattaggttcacctgttccatctggcaagatgcatggtggtattagtgaacaataacaaaaaaaaaaagatagattttgcacataatttacataattcatacttggaaagatccgtgaccatgagatagagaagcggtatgcatccatgccgatgtcattcattaactccacatcttcctgccagtttatccatttagttgatgtccttatttcattacaagctcaatcaaagaaatagaatcgactgaacaaataagacatgctctatccagaaagccttcttgatgctccaaaatggcatcttgtatttggaaaaacatcagaaatggtcttcctgttatcttagttttggaagcagcatgctagagaagtggatttgcacaattagtatactagtaattcgtaaattagcagtttagcatgcctacagtctctacacatttaaactgtaaatggcccagacaaaacttgcactgggataatttcctaacaatataatacgtcagacattgatgcttggagatacaaaagtgcgcaagcaattagttttcataaattactagaaattgttgaagcaaaggttggcaaacatttgacctaacttccaggatggcctggatttgcacattcctggttaaatgaccagttcagatttctttgaaaaataatcaattcaggttccatcagatcatccgtaaaactataattcaaatttaaaagaacaacgtaattggtcaaggcaaagttcacatttttaatcccaacataattagccaaaaggtaaacttcatgtcccagattacatatcaggaacaaatgaagtaaataacataaaggaggtacaggaattcatgaattatggataactcaccttgtagcgatggtagtgatcaacagcaacatctgcattgctgaaatcaatcacccgacctgaagaaagattacattgctcatattgcagtcatagtttgcacctcagattagagtacttctacaaataaatccccattactgaacctggtcttttcgtgagagtatcccatatggtaggtccacgttggccctcattcacggcaccttcatactggtaatatattgaccagaaatatccatcagacatccatctaaaagaactcaagtgaaattagagatcttttggtaacactagacctggtaagctgaagaagctgtgccaaagataaaaccgggagggaagtctgctctgcttatagcttcaacacaggcagaaaagctgacaaggatatgaacaagtgttaagagactcatggccttcccttcagtaggtagcactaactactaatgtccacagtctatagataagtagcagacaggattgtaagatatatataaaccttgttgagttggtggggtgtgggaagcaactgaaggctgatcatcacttgtcttggaatccaacgcgcgtctctgctaagtagctcttgtggaggtgacaggttgcaatatctctatcacactggacattttatcaaaaagggaaggaaactttgacatgtccaactctgaaagtgtcacgggtgtagcaaactaaagctttacttgagtgcaacaattccaggcgcattaaggatttcccaggattccagcatttaagaataaaaattgtgtaactgagccagtctttaggaagctacaccagtttgagaggagtgcaagcaacatggaagaaaggctgtgttaatatcacgataacacatttccttcctaaaataccatcctgcagtattgaccccccttttttttctcttatgcaatgatgctaagtgataatgacaataaggagcctaaaaaattatgattaggaaaatacagtggttaaccccaatataataggaatctttgttatccaactagtttggcagcacggcataccaacaaacaagtactactaattattgatcaccacatttgttgcattgatttaatgagtggataaaccaaaactgatagcaacgatttagtgatgaatttatcctgagattatagcacagtcacacacttatcccattggaaagaaaacggtttgcttgcacggcagagcctttcaagaattgaatagctccagtgatagccacacgaaagggacaggagcgatttgctgatggtgaccagtggaacaggcaagaatgtagtgcacgtgttatccatgaaatccctcacatgtacacctaaggtttatcactaaatacagtaacacacaaatacacaatgcatataaacgtagacttttgagtcaacagttttgtttatcacgaaatatagtaactaacactcaaatacacaatgcatagaaacgtagacttctgagtcaaccgtgttagaatagcttggccaaagatgctcgatgattcgaaatcttcggtcaaaaagcttggaattcatagtataacgaccactgtcactatgctatttggttttaggtagagaaaccaagagttcttcgattcgaaattaggttggttcctcaacctcctcacatggatcggaaggcttcgattcgaagtcgtccgattcacatcggtgccatctacctacccatccccattccccaccgcccacgcccaaccctatcaaatgaaacgcgagattgcaaccccccaaagagaagaaaacggcagcggaaatggcgacgtcccgatcccccacgcggcgtgatggggaagaactcctcaggcgtacgcgcatcggcagcgtcgtcaccgcgaaagcgccccccaaaagagagaggaaatgggtcccagaaaagcgcaaaagggacggaacttggggggttgcttgcctccgcaactgtcgcttggcttgcgcgcgtcgccggcgacgtcgaagccgccggaatccgggaggcgccacgcctgggcgcccccgccgaagcagcatctcgcggcgcgtggcgtggtgatgatgcgtgtggagacgaagccacgcaacgcaacgaggaagacgacgagcgtatgctgggctgggccttatccgaaaacgggtgtcggcccatatcaacccaggacgttcggcccacgttacttgaccacaaacgggattgcggacgacgagcggcccacgacatttgggccttaaccggattgctgacgtgcgtgatagtaagtctattttgcctccctcatgttctctgcgagtcagcctgccacgtcaacaggaaccaccctacaaaccatctaagggttgatctgctacggttttcgcttattcgaatcgtttattagcaaataaaaatttatttatgagtaaaatgtttatatatgtccataataacttaaagcaaatgttgtaaaatataagcattttaaaaaaacaaaaaagcaaattcaaaactaagttctcaaattcaaattttggctcataaatataagcataaccaaacaataagaccgattttcctccattttgcggttgagggaggtaattcaatcaggagcagagatgagaaatgtacaatagattttatctgtgtaggtgcgacctgttcttgttgggtcgagacgggattgcggcttacgtgaggcccgctatatttgagcctgaacgggatcgcggctgacttgggccgtaaggtccgttgtagttgggctggattacgataggcctttcattaggcctttatgagtcttacaagtgggccaatccattcggcctagaggcccatttgtcatgtagaaaagcgctcgccattatcctgtccgcgagcacacgaaggcgttcgttatcctctgctgcttctctgcggtttgagcgagcgagggaggaagaggaggggaggagacgaagatggccggggtggcggcgttgcagggcgcgatggcgtccctctccatctctgcgccgggggcggcgagcaccagcagcttctggggccacccgctctccaccttcgccgccgcgccggctggggtttgtgccgactcccaaccctgattctcatttttcgcattcctttatgtttgctctgctcttatgattcgctggaaaagtagaaatgccagcttgcactgagatttaggattttagagctcaccaacagcgtggcattgcaatggtgatgtctacatcgcctcactgtactgttgttgccttcaggagttcaggctcaggacctcaactagccaacaaccaacgttgtgtcaaaattttgtggtatattttttttagagaaaaggtctcaaggattttgtggtatagttgaacctagttggctagtataaggagggtttatatgaattaatgaatgcttgaaatctcaagtttgagtatatcaactgagtgaattcagaagttagaaattgtgttgtctaccatgggatgtggcctgttatgtttcagtttaaacttgaatattatttttttcctatggtggtataagcgatggatacccaatattcagcctttcaagcagaggattatttttctgaaagatgtgccctctagtgagacagaccatttcttgttctaacctgctgtatagatcacatttcgctggctagaaacaattttgcctttgaactttaaattactcaacagtagaaatttcacagaagacttccatgggaaaatgatggaaactcatttcactcggggatagcctgtagcaaatgattggcacactcggtatacttatcagactgaacttgttctatcttttgtatattctttttggcgttccttagctcttctagatagtctactgcacttcgtcctcagaatgagactcactcacgactaattacttacctggaaagtggtgatgagagaaaataaggccgaataattgctcttgaatggagtgactgagctatatatggcacttatatgatgaactgtactaaaatctgcacttatatgaagaaactcgtactaaaagatcatatgattatcctagatattcttgcctaagaaacatcgtgagcatgattcatgtcatatctcaaaagcagctgattattacattttatgtcattttcataagaaactctgacaagatatgcataaatttttatatgcaggttaaatttatgatcaagacatgcccaattcaaatgagggtaagtttcaattcttttttggtctgcagcttgctatttactcaaatgtctgaaatttccctttttccaatgcagcttaagcgatgggagaggaagaagtgtaaaccaaacagtcttcctgtcctgcacaagatgcatgttaggattggcgatacagtacaagtcattgcaggccgtgagaaaggtaaagttggagaagttacgcggctttttaagcacaacagcactgtaatagtgaaggacttgaacttgaagtccaagcacaagaaaggaacagaagatgaaccgggtgaaatcgtcatggtcagcattgtttctcttgaaacttctttctgtgctgcttctagctagtgtcgtatatatagtttcagatgcctgatcgttaacctatggttgttggtgttttctttgatcagattgaaggccccattcacagctcaaatgtgatgctctactcaaaggaaaagaatgtggcgagtagggttggacacaaattccttgaggatggaacgaaggttcggtacctggtcaagactggtgaaataattgacagtgctgagaattgggtcaaggtgttcaaggaaggaagttcggagtgatcatggtagcatgggagtcctgcacattttctgaactgcactttttgtatgcccaaatgagttgatgcttttctagattcagatttcagagtcttgtaaatttctatacagttgccaacatttttttgtatccaatgacatgcttggcttgttaaccagctactagaatggttcagctacattcgctcatacaaatgattttgtaatgttgttgctgtcccctgtcctgagctattattcgcaaccattgactaatttggtccatttccatatagaaatatagatgagatgtacatataaaacccatgaatgattgataagttcttttttttaaggagtagtaagataggagtatcataaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51396 - DNA, 3680 bp, Oryza sativa
  unsure (1)..(3680): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcactagtatcagcctgcaggcgagcagcatgcacaaccgtcgatgatgctcctctaatatagtcagagagagaagtgcgcctcttacatgtgagagtgcgcctcttacatgtgggtctatggagagatcttctgacgttaaatcagagaggcatggtggctgatatatgggtccataaatgatgagtctcatatatcagtgaccatgtgcgcgctgtacactaatgtgagaggatttggtttcgtttaagcagagcacacaacctctgaatttcttcactgttactagttgcatgtttcctctgtttctcctctgcgggcataaggcataagcgagcatacaagatgtaaaaatgtatagcaagttttttgaactaaaagtgtgaatcgatgaacaaaccaagttgtactattattcagagaattcaggggagcgtctctgcatccctccgagataatatgatcaagtacacactatcctggacttggagaaacaactctacggactgaaatcacgaagtcccacggaagatggaacccttttatttggtgtttgacactgacactaaactgcacgaacgcacaacagcatacagctttagtaagtaacacgacataaactcgataaattaagcggatgacagacacggcaccggcactgcatgcagtactctttgttgctcatggcagagtgtaatctgtgaaagagaattgagaaggaatcgatcatgttagattgttagcgccaaccaactgaaaatgatgaaataatcatagattgttcgtggcaagagttgacagtttgacatgttgattaggctgtcttcttcccttttttttttcaactctattcctccttttcaaattattaaatgatgtgattttttataaaaactgttactattttttaagtttttttaattaatacttaattaccatgcgttaatgactaacaccgttttctttgctgctcccgatctcagcttacctccgcacttgtagccgacggggcggtcggcgatgttgcagcgcttggggatggtgatggcgacctcgggcttgatcccggcgttcctggtcgtgctggacagcatgacggcgcagaggcacttggggctctgcttcccgatggtgtgcaccgccgtgcagcacccgctcgacggcgtcgacttggggtccttggccgccgacgcgcacggcgccagcttcagcgccatcttgtccggcggcgtcgccccgcactcccctgcaccgtccgccgccgccgccgccaccaccaccagcgcgagcaccaccaccacgacacccctgatcaccgccatgtcgatctcgatcaatcgatcggtcacacacacacacgcacgcactgggaataactagtaattaactaccccctgtgtcacgctgtcacgtagtttttcgttgatgggcttcatggctgctggtgctttatatatatacaggcgtagcaggtgaggtgacacccccatgatggtcggggagagtggtggagcgagcactatcgcctcaccggctcgcgtcggccaatggcgccgtgcaagctcggccacgcgcgcgcgcggcgatcgaccgagaccgagcggagagatagctcgctcggtgcgcgcgctagtgggtgggtggttgtctcggcctctcgtcgacgcgcgccgcgtttgtgacgacctacctgatcaagttcgcatacgtgccgtgctctcaagtctcaacaacgcaagcatccaagcatggctgcatgagcctgagaaaaagcatcgtaagatggttcaatcaaatgttgttgcgcagcggtagagaaaaagagatctcgactagtttagcgagtactagttttgaacgtccactccttacttccactccttacttgcatactactcaaatagttataaaaagcttttaaaaaatatattaacatgtgatatatcactctacaaacatacaacttaaaatttaacttctgtatatgacaacaaaaaataaattaaacttacaagtagaaattaaatgttaagttacgtgtttatgaagtgatatatcacatattaatatatcttctagtttttattaatttatttgtaactatttaaatgatatgcaaacaacagaaaaacatccatacaagagttttggtggtgtgtcggtggtgttggtcatcatttcgttcatcggctaagcacttagtactaattataacctactaggattgtcaaaagcacaaatgtaaacgtgtaagtattctgatgactgatgagaaaaaagagtgtaggcgtgttaggtgtagccgtgtaagcgcgcccggccggcacctgtgcacagcaacggtgcattgccatttgccacaatcccaaattcgatgctccgttcataagggagtgtctctagaaggagagtgccctcaaaattgaaaaagaaattcagatcgacgcttcatcctggccgtgttgggcagtattattacaaacttaaaaattaaaaaatagagttggacgaagattaagatagtctacctaaaataaaaaagccattaacatataattaaaatagagttggatatagattaagttagcatacgtaaaatgaaaaagtcacatgattaattaagttttaattgttacaaacttaaaaataaatttatttgatattttaaaattatttttatataattttttgaaaaacatattgtttagcggtttagaaaacatactaataaaatccttggtaaaatccacgtcttaataaaaaaaacaacataagatatgtaagcgagaatgctgggctaagtcatgtgcccatcagcccatgtgtgtctagtgcccctgtgcagcgggcggtaggcgattcgcgccgccgccggccgtggggcgtcgcgtcgcgtgatggtagtatcaggtgggtgggacaattgggatggaaaaatatactttgactccctcaactatagctccgagtatgattcatatcctttaaccacaaaaccaggtaaattgactcctccaactatcaaaaccggtgcaaattatatccctcggtgattttagctgacgtggcgcctacgtggcggtattgaccaagtctttgttctacgtggcgcttatgtggcattagaataaaaataaaaaaaaggtaggacctacatgtcactcacacaaaaaattatattgtgggatccattgatatgtgagacccacatgtcatcctccctctagctccttcccggcttcccttcttcctcctccctccttccctctctcccccagcgtttctcttcaccccggccggagcggcggtggggagtggcggcggtggcggtggggacagaggaaggg

SEQ ID NO: 51397 - DNA, 28385 bp, Oryza sativa
cggagagcacctcccctgcgcgcggacggccggggagccactcccccgcgcgcggacggccggtgagttcctcccccgtgcgctatcgttgtcgccgccgccacgacgcctcagcgcatctcccattacctcgcgcaccatccgagagcgacatgggaggcgctctccaccgccttccccactgccgaccaagtcgacgtcgtcctcctctcccttgccaagcaccgccactcctcctcctccccggagctcgttgctaggaatgcgctcaccttcttctactgggccgcctcctcgtcgccgtcgtcgtcgatcccccactccctccgcgcctactacctcctcgtccacctcctctcccgcgccgccctcgttcgccgccgctccccaccgcctctccacaccgtcgtcttcccgaggagagaaaggccggggaggagagagagacaagggagagaggggcaggaagagggaagaagagggaggatgacaggtgggtcccacatatcagtgggtcctataattgttttttaatgacatatggatcccacatattttttatttttgtttttattttaatgccacgtaagcgccacgtaggagaaagacttagtcaataccaccacatcagccaaacccacctccaaaactaccgagggatattgtttgcaccggttttaatagttagagaagtcgatataccggttttgtggttggaggaaataaatcatactcgggcgatagtggaagcagtcaaagactttttccactggggatcggtccgtcaaccgggagagattggattttatgtgcgtcgactgggctttgggccttgggccatgattcaatcgagttctcttgaagtacgtattttagttctttctttgagagaggttctgttcagagtctcaatactgcaaagccacctcatatttacgtcataggattttctataggcatagtcatatcagggattttcaaaaaaaaaaaatagtgctgtaatttgtagtcttgtatatggggttttcacatttggttcagttcatcaatcttcacgcataagtttacgaatagacaacatgataaacggttttaattttatgctttgctattctgaatccactaatggatgtcattggatcaaaatccatggcctgccaagaggtggaggcgtcaatgagggagatggcgaggacttcgatgagagcaggtttagagggatggaggaatagcaatgagtggcagagacggtgggccggtgagggaaagacagaagcgttagcaccagaggcttagggatgaacgagagtagtgcataggatcaaccgcggaaacaaagaaggtcatgttgttaggaagcaggcggcaatggcatgaaccatcggagacgaaggagaagggggattgtgtcgtacttggagacaattggagaagatgcatcaatagcgacatactcatcagagatggagaagggagcggtcggtggggctcttaagaatggtaaatgagaagcaagtttgcgaccaatacatagccaataatctgctcagttcaactaaaactgtagtattttttttttcaattgctaatctacaaactatatgaaaaaaatcaaattaattttttttcttgttccctttttgccactggggatgaaaacagtcacggaaattccgggtcgaccgagcaccatttccatatgagtggtattattttttaccgtttctggttctacctatttataaatttttaattttctatttaacatcatattgctatttttactaaatagctaaattgataaatatggtcctgacaatccgtcgtttcagaagagatgaaagatgctactgtttcttgtaagcatccctttttcatccctgctgccactgctaataggcctgataagcttttttttttaaccctctgtttcgtcccctttttttaataagaggttctggacgctcgatttttagatggtgttttttttcttctgaagataaaaataaaaataaaaattaagttttatatgcaaaataaggtggtattaacgtatgattgagttttaattattacaaacttgaaaactagatttatatgatattttaaaacaactttcatatataaaatttttgtacgaagtatacggtttaactttcatataaaaagcgtgccacgaaaatcttttcaacttttgcttagagaaaagaacgggacccaatgatcttgcaagattcttcctgctgcctttccaaatcttcgccaccacacagagtcagagagatgcacagcacaggtagttgccgctgccacagtgctacctccacacatgccacggtgccaccctgcaaggtcgttttcatattttcagacctccacatggttgatgcccggttgaatagaccttagcggtatttctttacatgatttttacatgaaagattaatgatccgaagcttcttttctgacccgaaaaacaatttgagcaagtttaatagtatagcacactactaactccaaatcatatatagtcaatataagagcaggtacaataacaaactattagccagctacaaacatattttaatgagataaaagatgagagagatgtagccagctgcagcacggactccaagacgcaatgtgtgtatgacaagtaggaccatatactaatagtatagtaagcaactattgtataaattagctattagattggctatagatgaatttgagctagtagttggctatactattaaccttgctctaatagccaatcatacaatagttgcttaccgaaagggccttgatgtcgcctagaggggaggtgaataggcgcacctaaaatttacttcaaatcgtagcggttaaaatcagggcccagaacttcttggcaaaaggtccggaacttcctggcagctttttctcacaagcagagaaagctgcccggaacttccggggttcttcctaggaacttccgggcagttgtaaattgctatttcaaacacctcacaacaagtaaattaaatcacaaggaagcctaaactatagagaggtacaacatgtctcaaacaagagtaatacacatgaagatacacaagatagcacaagtgatcatacaatgggagacatgatagaacaactaggcaaataaagagataagcatcacaatcacaaagataaagagagtgagaggagacaaacgatttgtttcccgaagttcggattctccaccgagaatcctatatctccgttgaggagctccaaagagccgggtcttgattaacaccttgcctcaccaaataatgttgggtccatggaagttagtcacaagagatttcggcacccaaatggcctttgtgctagcatgtagcgaactaatcaccctagtggcacaagtgccatttttggccttcctaagcaaattgtgatgaaatgagaggtttggcttaggaatgttaccaatgggacaatttttaccaatatgtctctttacccggcaattgtaggaaagttgagttttgcttttatcttgcttcttgacttgcttgttaccggtttgcctcttgcttgattgattgcaatgatcatccttcttgtgcggacaaaatccgatttcatgccccttctcattgcaaccgtagcacttccttttgttgattcttgatgtctttcttggaagtgtggcttcatcatcaatcttgcaaggacaacttgaggcaaagtgtccctctttggtggatttgaagaacttatgagcaagatcctcattcttgctcaacttcctctctttcttccaaggaacttccgggcagttgtgaattgctatttcaagcacctcacaacaagtaaattaaatcacaaggaagcctaaaccatagagaggtacaacatgtctcaaacaagagtaatacacatgaaaatacacaagatatcacaagtgatcatacaatgggagacatgatagcacaactaggcaaataaggagataagcatcacaatcacaaagataaagagagtgagaggagacaaatgatttgtttcccgaagttcggattctccaccgagaatcctatgtctctgttgaggagctccaaagagccgggtcttgattaacaccttgcctcgccaagaaaaggcctaggaagaggtctccggtcttcaagccaacacccctaggtacttctctttggtttcaagtgaccactaagatccccaacttaaacaccaaaagaacaccacaagtgaggcttgctctaccaagacgacctcctaaacctcacctctgttttctttcggaggtggaataacgctctcacaaacttgcccgggtcaatccacaaccttgttggaaacttgcgggcgacacctaaccgtctaggaggtcaccctccaagagtaacaagcttcaagtgatagcccaacgagatacaccaagtgctcaagtcatcctagccttcaaaaccttctccaatcctcaccaccaccctcaaattcactctctcactcaataagtgcacaagatttgggtggaggaagcaaaatcacattgggagaggctagaacaagctagggaacacaagaactaaagtggaatggccaaagaatgagctggggtcgagttggctatatataacggttaggtgacgtcatctagccgttactcacatatttgaactggagggttgccaggaggttccggacctgggtgccaggaacttccgggcaacacttaggaaaattttcaacctcacctcggcgccaggaagttccggacagaacctccgggtgggactctctgtcccgagtagagtcattttcaaaaacagctcctaaaaatatttcaacacttggacaccactaagagcacttgtgttatcttagaaccatacttggaaccccttttaatagtacggtttttcctaaactcaaagcgaaaaagtaaactagtctaactcggctccgagtcttctcgccactttgattttgatgttttgggggatctccaagcatcctagcccactcctaagcaacctgggactaatacaccactaggaacatcttcttgcttcaccttgagggttgtctatgtcaacaccatttcactattgggactattctcacctacactcattaagcatattagtcccaaatcaattatacctttgccttgatcaatgcccactttggattttgacttgatgttcatcgaagaaccacatcctcttgatcctcggcattccatcttgcggtcttcttataattgatacggattactcatagcttcaaatggcctcatacggtccatcatgaccatcatgacaaagccttcactcgcccttcaccaccggattcagtccatcggcgccaagcctcttgcttgcccttcaccccccacatggtccattgtagccgagccttgcttgcccttcaccgttttgccataaatagccacttcataccccgcatcatcaatgtcttcacttgctcctcatcaaggtataatgtccatcttctagccgagccttgctttctcttcaccggtttgccatagatagccatttcataccccgcatcatcaatgccttcacttgctcctcatcaaggtataatgtccatcttctagcttcaatcttttaacttgatgctgaaacttaacctaatctcaccaactcatggaaatagttagttccaacaatgggttgtcattaatcaccaaaacaatcaccgcgctcttaggatcatagatattccaatctccccttacaaggcaattctagtgcatagatctttcaatctccccctttttggtgattgatgacaacactatcacaaaataggaatttaaaaagaataccctagtatatgttaccatgagcatgaaacatatactagagggttggtttcatcaacatatgaaacgaatataagacacagctacatttaatcgaaagaacaaaaacaattattatcatctttatcactctaataaatacaatatatgcacccaatacaattagaaatcttaagggtgaaggatttaaataataataatttaagtggagataaggtgtaacaaagatcaattagtgtatgcatgtacgcagccaatgaatattaagatgactcatcgggttccgattaatcatttaatttatctattcatttaagttttaaatacatgaaaactacaaatgtagctaattcaaaatatgaaataaatctaatatttttggaaggattccatttaaaaaaaggatatttttggaaggagagtactaacaaatcattggttcatctaaagttagcatagtagagaactcacatcaatactagctagtagtagtatcattccatcttgaaacataggagtacaaacgaaaaacgactagagaagactgcacgggaacagatatcaagcaagtcgacaaaatacaattattttagcgagatatccaaggtaaattttcacattggatccgatacagtgcatagtgtctactggctaaggcgcttggacatactcgtttaacggaatcgatggggactaagtcttggatccatccgcgggagggaggccaccgtgctcacaggccacgccgccgccgccgtcacgggcggccggccgcaccctgctccgcgcgaggaggaacccgagggcgtggccggcgacagcggcgaggagcaccccgacgttgaacgacatgacggccagcatcaccaggtacgccatccccatcctggccgcgtgcaccgcggtcagcagcgccgcggacgacgccggcgccggcgccgggcggccgccatccgaggaggcggcgccgccgccgcggcgggcgaggcggcgcgagagcacggagagcccctcggtgagcgcggcgagcgcgagcacgaagaggaggcagagggcgtacatcccggcgccgcgctccccgggccagccccggatcaggaccaccgcgcggtcgctccagaagaaggtcatgtgcatcatcatcgccatcttgtgctgcggcggcggcggtgccgccgccgtggcgtggccggaacgcggcggcgccatcgccatcggccccatcccgtcgtcgcccatccccctcatctctgctgctggggtgtgtgtgcgcgcgcgcgcgcaaggtggcgtggcgtggcgtggcgcggggcgcggcgaaatatattgcagcggcaggtgggcgcgcgcgggtgaaacgttaatgggatcagggggatcgcggtgggcgcgcgcgcacacagcgtggcgagttttttgggggcgtccgcgctcgtgactgcactgaacctgaagcgaaaacaaccgagcaggaggggaggatggatggggaccccatcgcgtcgtggctatggctatcagggagtatcagcatctgaggacagttgctaccgcagcacagctaggattccagatagacagtcgtgtcaacttctaatccccgttgctggtgtgtgtgtgtcgtgtgcccccgttgctggtgtgtgtgtcgtgtgcagtgtgctagtataaatctaaatatatatctttgttcatatttattgtacagaatgtgtcacatcccgttttagatttatttttttaacggagaaagtatcttctttcacatatcatcaataaaaaactaaaatacctttgttttatcaatgtcaatgcaactatttctcatttatctattttcaatataattattttctactttcatcaattttgatacaattattacttttaaaataaatttattttggaataaataaaaaaaataaaaaaaaattaacttactgagacgaaggaagtactgatacatatgcacacagccaggatttgcaaggaagctttctcgctttggccctatttagattctaacttttttcttcgaatttttaactttttcgtcacatcgaacttttctacacacaaacttccaacttttctgtcacatcgttctaattttttcaaacttttaattttgacatggaactaaatacagccttcgttgaaaacttagaatctcgcggttacggagggggtatttaattggtttgtccgttgcaagcaagctacaaacgctatcgtctatggtggtggttcagtggttcacagtttccactagaagctatgctatgttgggaatattttgataggaatgccaaacaaaaaaattgtcttgttgcgcgtgtgctccgctggcttattctcgtctcggtccgttttactctgtttatggttttgcaaaagttttcttttatttattttgggatggatggaagagtgcagatatgctaggacaacttgtaattcttacaatttctccgtttcaaaatataattgttcgattggatggaacacatcctattgtatataggttgtgttctatctcataaaaaaaatttgaacgtacggaggggagtacaagtaagcaaaaatacattatatctagcgagcatctaggcttagtgagagcaatacaacaatactaacaaaacatagataaacatgtagagggagaaaatgtcaatttatttttaaaaaaatgattaaaaacctatcctctacatccaaactatacgtacatagccaaacatacattgtcaatagtacttagcatcacaccttgcataagaacaacaccaccgaccaaataaaacaagggtacttagactacaacacctcacaacgaagtcgtctcgtgaatagaagccaactaacaaaagatgacaaaagtggatactaggtctccaaccgcttactcaagttccacgcaaatctggaaaagaaatcccaaactctagcctccggtaacttgtgcatgtgtttaaccacatcgctattctcctcgttaagcaacaatgaccactagcgcagtgggttcacctgaaaattacctacaaagaggggagttagtacttaagccattgaagattatatcattactacaaagtcttaccgtccaacacaaagctacggcacctataaaaagttaacatttattctacgttgtaaaccaccaagccaactatggaagatattagcaagggacgagtgtaaacccaccataacataagtaaaagtatttgacaaattaaatcctaaggtatattactaccagtttctaccgaacagagtaaaaatccaaaattcaccgtaaattgatccattacaccgaatctaaatactagtattgttatgcttggctttatttttcttttaaatccagttttaggtgttggccacttcgcccagtagcctgttcggcgcggtttccaggccgcaaacgaaccgaagcggaagcgcctccgctagctgctcagcccacaggttggttcggcctgcagcccatgtatctctcagccccaaagcccataacaattcattagttagatccggccatccgggctctccagccagcctctcaaactcccaatcctagcgcgacctcgtcaaccgcggcagcagcaaactgagcacctggacggctcgacggcggcgagctccgcacgagtcctcgatggagatcgatgcttcctcaaaccgtccgcggatgattggtgaaacctagctatttcgatttgacatctatttacaatcatcttttgggttgagttgagtgagttcaatcgattttgagtttcaatcttctctggacggcgcgcggcaaaccgggtgcgtataactgtatacactatttctacggcccctttaccgaatacgtttctacgcccccttcaccgaatacgagttgggtgtgatgctctctcataatcaaaccctaataccgccctccatcttttaaccactttctttcttataatctctccctcgatcggctactcgtaagtctcgtacgtcgccccagttttctccatgcgcgcatcctactcgcagcccctcctctcccaccactccaccagcgccgccgccaccagcgacagcaatggcagcgacaacttctcctcctccggggccgcgccggcgggggcggaggcgcggttgccgcccatctcgcggcggctgcactcctacgacgacctggtgcacgccgccgccgccgccgcgcacgacgcctacttcaagcggtgccacacgacgcccggctacgtgagcttcgaggacgtgatcggctcgcaggagttcgaggagagctcccgccggccgccgaaggccggcatcagcgacccgctcctgcgcgcgacgtcgcggctgtacgcgaggccccaccccgcgctccaccgccggcgatcgccggggccgctcgggacccggcgcggcggcgcggtataccgcttcgtcaagaggtacgtctgcccttgcctagggttcgtggccggcatcatcggcgtgaaacaggttgatcaggtcgaggaggaatatccagcgttaacttattaattagttagtcaaatattcctatgagttcttgcatagattcgcatgcgaaatctataaatagcactagttagttactgattctcataattcttgaatagatttgcatgcgaaatctattattcccataattctttcaaatagatttgcatgcgtattcttgatgaatagatttgcatgcgaaatctataaatagcagctggttgctccaactagttgtatgacctgtcactcgtggagagtcttattggatggcttgccacttgtgtggagtctcatgaaaaaaaaatcccctttttttatccatcgtcaagtatggtattgatttttttatccatcatcaacagtataatattctttggtttgtttccattatgtattcatcacaatgatcaaaaggtttgttagtgggggttgcatcgcatgaatcatgtagtctagtttgttagtggggtcctccgcgtcgctctcgcgcgtgcggctcgggggcaaaaccctagccgcccgcgccgccacccccgcccaccctaaccacctcgccgccaccggagctcgccgccggaaagccgtgcggccagtcgggaaggcggcggcggggccaagagaactggcaaagctcttcctcagcgcgggaggacggagcggcgcgcgacggtggggggctccggcggccggcgacggcaagggcgcggcggatccgacgcccctggaagcggatccggcgaggggacgcggcgatgcataggcggcggtggaggatggccgcgggagggaggtggtggcgacggtggcgatggggcggcgcgtcgtcttcggctaggacgcggcggcggcgactcatcccggcgtggaggcggcggatccggcgctgcccccgccggatccggccggagacggcagtcggaggggagaggagcggatgcggcgcgcgcaaggagcgcggaggggcggccggcggctgtggacgccggcgctcgcagaggcgcggccgcggcggtggaggccagcgctcgcggaggcacggctggcagcgggggaggccgcgttcccggaggtgtggccggcgacggcggaggctggctcgcgcgcgaggggcagccggcgacggcggagagcggtgcagcgcaacgaggagcagcggaggacaacactggtgaggtggcggctggcggcagggagaagtcggcgacggggctcgagatggcgacaggcaggggcggcgtcgcggtgggcgggcagcggcggctcgctcgcgcctgtcgcggcgttggcctcggcgtcgtccgcgcggggccacggcgctagcgctgcgcaggcagaggctgtggcggcgtggtggtcgcaacgacaacggtgctgcggcggcgcttacgtcgagccggcttgcgctgtcctagctggatctggccgtccgcggctggatccgtcccctccgcgtcggatgggcggcgatgtgcggatgtggagttggcgggacgatggcttatgctggcgtgaagcaggaattgggcttgacgtccgcggtggcgacttcctcgttgccgaccgagtcttctccctcatttcggtttccctcccttctttggccggaccttgttctggtcgtggggaacgctagggggagggcggaggcttcggcttgctgtaggagttggtggccaagggtccgtctttgccgttggttacggttgaggtatgggtgcttgtgagacgtcatggactattctgtggccgtcaatgtgggggtgcttgtgtgggtgatgtgaagatgctggcgaaagccttgccgtgcctttggccggttcgacgacggcggcgctcgtgggcgtcatttcccttcttggaggcattgtcatggcattctttcatatcccccacaatctccagatgaaaaccttgttccggctttcagacgagcgacggcggcgttacacgtcgtgtcctccttgggggcgtcgcttcggagaagttccaatgcatcgacgaccgttgatggtctttttcggttcaaaagctttcataccttgtgctcggtgaggcctttgtcttcttgggtccacttcgttccttctggtggggtgctggccgcgtgaaggaagtggcttctcgatggcttggctgatgtctattgttggatgtcggagctgcttttcgctttggcgactttcgtgtcttcagtgtcgctgcagttgtgaagtcggcgctgttgggtcgcttgggcggctagctcggcaacgataacacctcttctgcgatgtgggagctgttatatcgcttttgtgtttagcttggcggtgacatcctgcttttgggctccgccgtcgttgtcagttgtgtagcggtgggtttcagccggttttcctataattaaccgtgcaattgtgtggtttttgggcccggttttccttataaactgggttaattctcttcttctaaatataaaagtggaacaaagtttcgccttaggtttcaaaaaatgaatcatgtagtctatcgaagacgggtgcacaaatcacaacaggaaaaccaacaaactagccaacctgcaacgccaaattgtgaggagctatatataccagagtatggatcagtgatcacctgtctatatatatatacacatcatgtttttgagaagttttgctttgggccttttaaattttgtcactcctaatcaactagtttccaatcctgtgcacctctctctactgaatccctatggcgccggtccagcccgttagtaatcgtcgcggggtcgccggtgcctcgccgtgctcctccgatcgccaccgccggcgacataatcatcaacgtagctcgacctctctgcccggtcgcctccgaacgagaaccaccgctgcacagcagaaacaaaccattgccaacatagttacacacctgcactgttacatatcctgaattctttgactgcactgttacatttccggaatcctgtgatgaccatggttcccaacatgtgtactactacttcctctgttttcatattgtaaggtgttttacttttgtgctaggtaaacttttctaactttaccaagattgtaaaagaaaaagtgctaacatctacaatatcatattagtttcattaaaatacactatgaaatatgtcttgatagtgttctttggtagagtagatgttaatatattttcttatagatttgatcaaagttagagaattttaacttagaacaaaactaaaacaccttacgatatgggacagagagtaactggtaacataccctcgttcttgagcctcgtgacgtctgggaccggatgtactccatcccccggaggaagagatcgtagcccctatcggtgaagttcttgaggtagaagatgagaatgtcgccggcattggcacgcaggtagcgcagccgctcctcgatgttgggctggtactgcatcaccagcggccgcaggaaggtgtcgtacacgatgtcagttccctggttcagagtgacaaagcaaaatcttatttaattcagacgtggtcaggagatgcactttttgtgcagctgcagatttgttgctggactcagtgttgcaaattagattaaatctcgtttttagttcagaatttcagatatgattaggagatgcagttatgtgcagctgcagttttgtggcaaatcttgtttagttcagacaatgatcaggacatgcagttagctgcagctttgttgctggaccaagcgttgcagacatagcattacatacccttgtctgggggtaccacaggtagacgaggaaggcgagtctgagttcagagtacattggtatcctgtcattcaatgaaggggattgccaggttacagggagcagattacaggaacagctgatgagttgtggttgtgtgattattacttacttggaggtgaggacaccagcgatatcatcgaatatgacgaggattactagtatgatcctgcaagatttgctgaaattggtcaactcttgcaaggtgtttcagatctccaaacagtagatacggtgtttcagatccccaatattcaaagcacttcagaaaggtgaaagtgaggatttggtactgaattccacagcaatgcagtaacatattagcaccaattctaatgctctaatccagctaactgtacccagatagcagaaattaatccccgtatggtttacccaattcactcaattacgacgaattctaagcatcagcctatcacccagagatcaaattgaacacaccaaatgaactaattactccaagctaaggggtttctgagtcagtagtcagtaccaatattggcaccaaaaccggagatggtccgtccgaccaggccgctgctcgatcgccttgaagcactccaacgccggcatagcatacccgaacagcgccctgcacccacccaacaatcaagcagatgaatcaataatctccatagcacatgggccatggcgccggcgaggcggcaccggaaatccccaccagaattgggagaattggcgagcgggaagagggggggcacactcacgtgagcgctttcgtcaggaattccaccgacatcctgaaccagagcgtcgaattcttggagacgaagctggccaggatcttaatctcctgcccaatctactcgagttcttggagagaagaaggtaatggcgtgaagtgaccttgctctgttcggtggctttctgacttgctcgcttacttgcccaaggtggttagctgaggacaaggcaaatcaggtggttagggcaatcccaacccatagtatatataagtagtgtctatggtgccatgtcaataagacatcacaatagaaactacatctacaacccatggtttcttaaagtggaccattaataaatacatcatttctcttctctaccaatcatatttattcttcatctattatgaagacactattctcttctaatacaaaaattgatagtgtctagtgcatatattctcgtgttgaagctgtgtcttgcatgagacccagtttcttccttccttcactctctctcttaattaatatagtgccaaataagttaaaagtgacaatatagctaatgccatagacatcatcttcggtggagggttcagactgctatgctcggctgcttctccgccgctctctggcggtaggtatctcgcgtggcggttttgggagggggtaattacggctttgcccttgtccggttgcgtttgatggtcaatgacgagtggggcccaccgaattaaggactcgtgatgaactggatcgagcaagcgatttgcgaatatactagtagcaataaagcctaaaaaaaagtgagctttgttaggatcaataatttagggttagtttggttttatctgggaggagatgtgacactaaacctgctaaaaggtgacggtgagatgataattattgggctgatactccgaatgtcctctgttttggcttgttggttgtgcatctcaataattctacctagcttggattcaacaaaatactagtatcggaataagtttccaaaggaaaaaaaaagctagcataggatattttatttaaatagaagatgcataaactaatatacacaaatataaatatgcttacacctaaggtaataaatatagaatagcaaatggtcacggattaatgtatgagtagatggttgctgataaagggtgctattgtagccttctaggcgctaagttccaatagcggaattttaaaaattactatacatttagattatatattaatactagtgtcaaaattcacttaaaatttaaaaatttagcatatctagttacctatacatttcatagcataaaatttataaataacatattaatgaatatgataaaaaggcacatggcgttaaattctcttatccatagatagagaacgtagtttaagtacagtaacaacccaacaaagctaatagtttactgctataacagtcactaagctatagcgaccgctaagatctaatagactatctttgatcccctaccttatagtggtagtggtagaagtccgctatagctacaacaaacaattaatgctatttattttttttcgcttagatatcatttccctagattaatgccgttgcaaattacttgttcatcatctctaaaaatatgttttcttaaaacacaatcttctactgtattacttagatgatatgttctaagctatatatattaaatttatttttcaacatatttaatttattttataaccagaaaaaatgcttgtgcgttgcaatgggtaaagtctattttaatcttattattattatatggtttagttaagatgaaatttactgtgggagttcgcttggatatatatatatatatatatatataaaatcatgaactacagttaggagtccgataatgtcaagttagcatatgagttttttttaaacaaaattcttatgtgattccctctgtattaccgaaagtgaacgatcttaaaaaccggctgaaatacatatatgtatttccaaaagcaaacaaacttaaaaatcaattcatacacggatgacgtaccaaaataccggcaaaaatatcttcaatttttataatagtaaagaatagataaataaaataatccacagtaataatccggagacagagagcagcactaaaactgtcaaaaaaaaatctacggagttatcgatttgttgtagatttaaggagaaccggagtataatgcattgttttttctttcctcagatctctaacgattgcagagtttgcaagtatgtgctgcatcaggcgactaaattagcaaatccaaactactacttgctcctatcttcttaacttaaccctgtcaaagttgcagcaggaaccactagatatcttttagctctaaaaatcctgatgagagtttcaactatgctgtaacatcttgtgactcgtgtgttgcaatattgcagcttgcattgtgcattgggtttggcaagtctgaccgtctctgctaaggaagcaggggaaattaactagttagtcaatttgatctcggcgctgggctcgggaggcttagataattgccccctgtcactgaaacttccgtcaggttcgtgagaagcgaggctaatgaacaacgtgacaaatccggcacaattttcgttgatctgaaaataaaaacggtcaaaacattgttggaacgagcatgccttggcaatttggcctgaaatcgatgatgcactccttactccttagagcgatcttcagaaacctccgtcagaaatgcactacatgtttcagctccatctgtatatttactattagcacttcatatttaaggattgaattttactatggatagagaagaaggagcaagttcattttatctctccagctagtgaagaaatgatttattttcagtgttgaagatcgcactataggcaaaccaagaaagaacaaaccggtgagtcttcagttaaaaaagaaggtttgtcttcagtcaaacaaaaggaaagaaagaaagaaagaaagaaaacggtgagtcttaactttctttcactctgactctcttaaacaaaatctaaaagagaaataccagggagatcaactttccaataacaacacaactttcaaacaaaacacaaagcatatgattccacaagacaagactgatcatacaaatccacaacagagaagttccaatttatgccgtccacaaccacatgtatgtacatcacgcatcaccaacctgcaaatctgcaattcatagtcaaagatgttgtgcatcacaatcatcatccactccactagcgcaaaacatgcccggatctcttgaacaggaacacggcacatcctgtttactgtgcttatcatctctgaactacagaaaaaacggcacccactgaagatgctgcgaaaaaacagtcgaagcctgtgatcccaaagatacgcgaaccatgtaaatcatcagtgatcagatggattggcatgcatgcgatgcttgtagttgccggttggttgggctacgcctgatgtgtttgcatctgcatgttggcgagatgtgatgcatcagccgcatgcatgatcgatcgatcgatcgctgtcccggacgtaggagtagcagtgaagaggatgcagaattgcagaagtaattaataccctgttcgatcttaaatctgtctggactctggagtagtacgtctcatcgatcaagtgctctgcattgcacaatgtgttcctgtttggtggtatccatgcgttgcatgatccagcgttggatgtcaatctgacctaagaatagagacgcaaagatcgctcgttgtgagcctacagtttactgggattgaacgaacatgtctcagcgagcagtctaaaagctgcaaacttgcagtgttgcagggtaaaagaacaacttggaatgcttgaacctttaagcatcataaattaagtttcacaaggtggttagggacaaagcttaagctagccttaggagctactactacgagtgttgtctaagctaagataagatatggcactcagttccactatgtttctgcttgatctaacctacaaatggcacaaatggcttctgaattctgcaaggttcataacccagttactactccattttacataaactttaccgaccaaatttgcagtctctactccaggcagtgaaaaactcttgtcccttgattagactgtcctggtaactcctgaagactgctgaacatgaggcttgattagagtaagtagtcatttagtagtagatttaaaaggactctgccggggcctagctgatattactagtctgtcctgttccgtaagagttaagcttcatgataagcactgataaattcatggacccactgtgttattactcgacgcattcaagtcgaaaacactgaaagggacttatgatcgtggaggactgtgggtaaggcttattcatggacaaaacttaaacagtcctagtagtgtttgtactgactatgctcgcgaaaatggaagtatcatgcttgcaatatgtgcgtggattaatgtgtggatatcctagataagaatccaaggccaaacatttctcatgaaacagacattttcttgtagaatttcgaggcaaatttcaacatgtttttactcaaactgaacagaaatccaactttcatcaactggtatttggaaggaacttccaactaaacaccaataatttcagccaaaataccagaatctttgaagcggtttctactatagcattttactaccagtataatcaccaataaaattatctcagtcgttgatatatgagttctagtagcagtaaaaaaaattctacatagagatggtagtataaatatatatgatctgttgaattagaaaaaaaataaacggtctaacttaattctactttcattaaaaaccattgtaaaacatctcgaaaattaaatgtggtttaacagctttttaggtttgaccatagtatataaaccgtgtctagcttggctgcacgacaatagcattcctacattcgttataaaattatgtagtgtgcgttttttaaaatctgatatttatcaacatattatgttattatgtagaaaatgggaattagtggtcaaatagtgccttcttgaccctagccgtgtttagttccctgtccaaatttttttaaaatatatagacacacatttgaagtattaaacgtagactaataacaaaataaattacagattccgtctgtaaactgcgagacaaatttattaagcctaattaattcgtcattagcaaatatttactgtaacatcacattgtcaaattatggcgtaattagactcaaaagattcgtctcgcaatttacatataaactgtgtaattggtttttttcgtttgcatttaatgttctatgcatgtgtccaaagacataaacatttgatgtaacagaatttttggaagtttgaaaagaactaaacacacagccccctgtcaatgtgaccaaaataattactaatacttgccgcagggtagagtacgtgacagcttgataacattgcaatctcttggattaaaatcatctggtaccgcattactccaaagaaaccaatggcatgaaggccacatatttatgagctgttggtgactcattaatatatcccagataacctgcattgccttcatggacctgcagaccaaggaacagggtttgacccatcattcctctgaatcttgtcatcaaaatcttcacaaaattgtgataaaaattgtcagccattgaaaatttgacatcttgacccacactacgctaggaagagagatcacagcagagcaaagtgatcaattagccatctcagcattaattaattaattaatctacactaatgatcagcatcaattagtttttagcaactgtacaataattccctcacttgccattccttcgtggaaacacaaaagaattagcacccaaaaaaagagaaaaagagattgtcatctcttgatgaggctaaagaaaaacaaaacgtggtcgtcgtcttcctcgagaacagcttaattagctctcctcctccatggtcgccgacgagtagtcctcgaaggtgatgcacgacgacgagggcgactgcgacgggatcggcgaggacgcgaggctcacgagcatgtcgatgaaggcccccacgatgacgccatggacgcccttggcgttcagcttgaggtaccacgccaggagctcctccaggccctcccagtcccgcagcccgtgcgccgccaccatgtccgccatcgacgacctgaagtcgccgtaggggtcctccgactccaccgtcagcaccaccgcgccgcccttcagcgcggcggcctccgccgcttccgcttcgttcttgccggtctgcggcgtggtcatcggcgtcgcctcgtcgacgtcgtcgttcttgcgagcgacgacgtccatggctgtcgcctcgtcgtcgttcttgcctcgcgccatttcctgaaatcctctctcgtgttataacaagatcgattgctctcgcgtcgtcgcgcgtcttaatcgtagtgcgcgacgtgcgccgcattacctgcttgggcaagaactccgcgccggcgggctcgaaaaagagccgctccgagcggacgccgcgcacgacggccgtctcacgcagctgcagctccttctccttctccttctcctcctccacctccacctccgactccacggcgaagaagctccggtcagcaatgcaggacgacgcctcgtccagggaggagcgccgcgggttgaagtgctccagcgacgacgtgtcgtagacagtgttcacggtgcggtacacggagccggcggcggcggcggcgtcgtcgtccgcctgcccctgctgcggcgccgtcggccacctgaacgagctggtgcgcgggtgccggcacgacggccacggccacgacgacggcgccggcgggtagcagagctgatgccggccgtggcagtgcggggacgacgacgacgagggcgacgtcggcgtcggcggcgcgcgatggtgcacgtcgcggagcttgtacaggataccaacgagccccttcttggccatggcagcagccggctggcgtccgccgccggcggccacggcgcgcgcccgcttcctgagctttccaaagtggaggtggggagggttcaggggaggcattgcgccgccgtgtttgacggaggcggtggcgtggcgtggcgtttattttcgcttgtgttttatagagagggagaagagaaagaggaggttgcagcacatttacgagagggttggagagggtttcagtagaggaattgaataccgccattgaatggtctattggccaatgactagcacaagatttgatgtggtgtgtctttgggtgtgtttagttcacgttaaaattagaagtttagttgaaattaaaacgatgtgacagaaaagttaaaagtttgtgtgtgtagaaaagtttggatacgatgaaaaagttgaaagtttgaagaaaaattttggaactaaacttggcctttcactcccccatccactatttgcttcattttctcagcatcaattttagttcttttttatttgactgaggagtgatggtccctgtacctgcttactgcaccttctgtgaaagttactttctccatccataaaagttacacatattttacatttaagtttttctaaataaattgttcctatttatagtctttatatattcaagatttaaatgaagagataaattacatgcttcattaaaactcaaggagtcatctaaatacttattagttgcatgtttatattcgctctttgattaacatccaatgtgatttaatttcttattggtcttggtgtcaaaagtaatatgtgtaacttttgtggatagagagagtagaaaaaaaatggtattatcatgaccattaaaaggctaaaaaatagtactgtaatatttacttgaaaggagtgtttctactcatcatcactgatgatactccttccatctacaaatataaggagtagactctagattggttagcaaagttaagtgttgaggtgaaattactttcgaagtaatttccatgtgagtttaattgaatggaaaggtcatgcctagtagcaataaatgcaatggttggatgaaatgggaaaatagtactccacttcaaaatgaaaccccgcgagttgctgtgggagttatatatgataatagtataaataacatgcatatagctacacgacatcactttatatactttatataattttcatctgtgatcaaccatggaagaaaaaaagttataaacaattaaaatgatatggtttataacaatgtaaatcatatataaatagattattcaaaagcaaaactaaggtgatatacctcaatgacggaatgaaaagaagggaaatgatatagaataatcatccaaagacaaaagaaagatgatatgatttcctagaagaaggaaaggagggacataatttgaaccatagatcaatcattcaagggttagaaataattaagatgatgtggctcaatgagaaaaaaatagcattaactacacttggtgaggatgaactttatagaaatataggatttgcagataaaattgaatccataattccttatatttgtagacgaaaggagtattaactacgtacacatcattgggatataagttaggaattttgtggccgctgctaaaaaaaaaagagatcagaacaccttgaactaatggtttttgaaacaagattttgatctagaaacatacccctcattccattaattgccgttgaaaataaaataggcgttttaggtactcctctcggatatttaggataaaattcaaaactttaaaaactgtaatcactacttttgttataataggtttacaaaatctaataatttattatattgagtgtacaaaatataaagaatttttgtcattatgatagtcgtacatttcaaatatacgtataccttttttttttcaaattaagcatttgggaagtcgttgatggtcaaagttccgtaaattgaactaaatcttatctatgaatgttaaatatttattatctgcagtgtccatttatgaagaaaacaaaatcgagttcagaaaacaacacatatgccgtctctgttcaaagtttgcatactgttatgcactgtaatactgtatcataaccttaaacagaagaaaattagagtttggtgctaacaacctgtgaaccaccgcaacatttgtatgctataacttgccaaaagcatggcttccacctaacgttgcaatttaatcttcagttatatatagaagattttaaaatttagaagtccttggaggaaagcttattaacaactgacattttttagatagccatgtctgctgcgaggattgtggtatgctcatcatgttccttgctctctggctggatcaacagctttcctgattattttttatgtcttgcaaagccactttctgatattttatctgatagctgtttctggctttgtgctataagcaaatacttgaaaagaaaacagcatcaaatctaatagctgtgcactgtgctggtgcagtgttgttatcataagtctaatgcacattgggttcattgtttatttttggattgcactccgtttcttattggagcacttacatttatatctcttccgaattttgctcgcagtatcctctcttttttttttaattggaaactgatcaaatcactttctgaacctcactttcattctgaacagtcactgttccctgccggatttttgaaaatagagataaaaaaaaagaaaatctatactagtagatgtgcctggcacaatctgcaagctattgaatgcgaggtagcaggttgtaagatgtcacatttatgtttttctgctctgctctgggagactgcaaagaccctggtatggccaagacttgcagccagaaaaacattcatctgaagaaagaagacgagctggaagtgcagcatggatgtatctttctgttgatcaaaactggatgggtttcaaatcacctggtgagtgagggaggagtgagaagggatcacagacaatcatgggttgggcaatgtgacaaatttgaaacatgtcatatgaaaaaacaagaatctctctctctctctctctctctctctgctgatttaaataaacaacgcatagttgccacactccctgtcctgtactatcattcgcaaataaccatgcgagtttcttgggttgctgcagtttttggtggcttaagcttagctcccctcgagacgagcttaacctccacgcgcgcgagcgtgtcaccgttctcaagaccgaacgcttaagcttgattgcttaattaagcatcgaccgttgcatcttttgagaaggaaaagcctttgtctgttcgtgccttggttagaacttaaaatacatggaagagtatttgttttcgattcggagtaagtttcgtgtcgtgtgaaagatggagaactgcacgtggagaagctagcttcatggggcgtagacgaccgtcagatcgtgcattcgatggtctagattgagagtccaacgtactacaatgaagcgcatatgttggcattattgttctaccattcggttgatctggatcatcctttttttctatcattgaatagtagattataaataaaacttgtagtttgccagttatccaacgcccacatgtggcaatgttaggttatgcaaatttaagattatcctttgacaagagaacaaaactttgagagataacttgtgtccaaacagaaacaaaatagaggggccaatggctatgaattccccctaatgtgacatgatgtcccctatcaggttctcctgtaccttaggacaagaaaaggttggaatatgcatcaacttgtttcaacaaaaagtggatcctaaaggctaataaaggttgacctaaagtgttagtgcttaaagggaggcagtgcctgcacttttcagggcctaatgatctgtccccttaaaaaaaagggggaaagaaaggctgaggcaaattataaaccgacaataaaaatggcctacatggccatcttgctttaatccttaatttcttccaggttcttggttgtgtttggaagccatcttcttgttctcttgtagcgactgctcttcttcttgattgtgtagttcttgttcatgttatggagggtcaggagcaaagagccttataatgcgtgtgttgttggatcgatggcatcttattaaaagagtaaaaaaaacagagctaataattgagacttttgttggcattttgatcattaacctctcatgtcgaagaagatgcatcaggcatcagcagaatgcctgaatttacttaacgcaaaaggacaaagagcaggtggttcccttttatgctgcacatagttatgggaagcagatttggagcatggggagcagaagattcagacatctcttgacatatgtaacagcaacttttggttctataccaaattaccatttctccactgcagctagaatttctacggaagaacagagtaaattagcaactgattcagtaattctccatcagcacatgcgaagttgactccttgcttgtttcttgcgtggacacttgacagcatactaattctagtagcatcaatgtatcaccctgggattcccattgatcatcaccttcgagaaatgtttaatcgctcaagacagtggctggaatttagagccaatccatgatcgaaacaggaggcatgcgtgcatgatcaccatcaaataactgcctaattatctactctttggcctggatgaacactgaacttgtcatacatatacatagggagctgcgtgattgatcaccgtgagaaatgtacacgaagaacttaacccgacaggtgtgacttaaacaaatcaacggtggttgtagctgtaggtttgtgagcgattgttttttttctctttcctgtcttttgcatgtcaatgatagcttgattgttttttcatggcgaaccttcacatgttgcagggagagtgagacgacctgcttgccctgtagctaactgatcctgtcgagaatcattttcttcactgtgagatattgtctatgattacattttgttattttccgggaacgatggtattgctgcgaagttgacgtgtcatttgatctgccacgtgtgaatgtgctacgagttgacaggtcgctgataggtgtgtggattggccggaagaggacaatactgccatacacactctctcctttcgactcctatatactccttcagtccctgtgactcctgcatatgcttcttttgaatataggctttcacacaaaaattagaagtttggttaaaattgaaatgatgtgacggaaaagttagaagtttgtgtgtgtagaaaagttttgatgtgatgaaaaagttggaagtttaaagaacaactttgaaacctaaacacggcgatagtacaaatatagaggaatggcagaggatttggtgattgttcaaaggattcaacagaaggccttgctgtacaagtgcaaggcgttttagcattctcaactctttcaagaatataagttagtttataacttcggtgcattttgatctttcgtttcgtttttcttaaaaaaacttcagtttatgtttgtccttggaaaataaatgaatatttgacatttaagacatgatctgatcaattttttttaaaaaataaccatcagttttatatcatagtaagtttctaaaatcttataagtttatatagtacttttcaagataaatctaaacaattttttgccttttcttttaaactaataatttgagaagttactaatggtcaaagtttaaaatgtaaccaagtttcatcctaaacttaaatatttatgaccagtgggaatatcgttcatataaaaatatttttgttcggacgtcatgttttggaatcacacgttcaacttaaaaatcttgaatcaccaatatatataggagcaataagattttatatgtgcaagcagcatcaatagacttgctaagaaaaatatttctacctagttatgttcagactacttttttttctcttaaaaaatttaacttgtttccaccgtccgtcaatataaaaaaaacagcgaaaaaacaacctaaaaaatccgattccctggcaaaaaatatagatccgattcccacctaaaacgggaaaaagcaaaaaaaaatccgataactggcgaaaaaaaagaaatgtagattaaaaaaacagatccgattcccacctaaaacaggaaaaacaaaaaaaaggtccatttcctggcaaaaaaaaacaaaaaagaaacgtagatccgattcccacaacagggaaaaaagtctgattcctgtaaagtgaaaaacaaaaaaaaatcggtaaaaaataaaaaaaaacccaaaaaaacatctagaaaggtccgactctataagaaagtagcgaaaaaaacagttcgtaaaaaaacgcacgagaaaaaaaaaggacggaaaaagcgcggccaaaaagtctaatttctattcgtcgttttagttttcc

SEQ ID NO: 51398 - DNA, 38936 bp, Oryza sativa
  unsure (1)..(38936): unsure at all n locations
ttagagaagagtgcacggtgactctattttgtgtagacttgaccatgtgaggcagtatatgattttgattatttgcaataatgaaattaaaaaaatattttagattatatgaatgttgtcatatgaataatccaattatttttggtaaagcaaatatcgtaaagttgccatcatcgaggttgggctattatatttatgatattccaattttctaatattttgattgtcatcaacatggttatgcatgaaaaatgtatattatcattacattttttcacccgttgcaacgcacgggcatatttgctagtcataaaaaaatatggctatatgttcttagcagcgacaaaaagcaaaattaaacgcaggatcatttatcatattgacatagtacatattgcggaaaaacgtgatttattagctctattagttgggctattgctcacaaggcccggcccaatcaaaagcccatgatgagctctgcaaaacctgaaaggaaagccctagggcggaaaccgtaaaatcgactttattcctggggttttcgcttcgaaaatcaaaagacgaatcgaagcggaagtgctcgtcttctcggcttcttctaactaggtaattcgagcaagcaactccatctagtagccattcttctgcggatgggcttgctccaggagtcccgggcgattccggattagcgccgtgttatttggtctccgatccgaggcggtaatttagggcaggttttttttttcacctaaaattttgatttgggggtcaatgctgagttgcttttagttttagctttaggtagtagaaaagagggtgcccggtaatatctgggggttttgttggattcgacgttttggagtcgctttcgtatgcccgtttaaccaattttgatgcgttataccatagatcctgctggatggatggtggattgctgcaggtttcttcggtcatctgaaagattcattcttatccaaccaggaactgtaagttgtgaaacttgattttgttgtgtctagctttgagatgtttggagatggaatgtttatgctgtattgcatacagcgacacaacttcaatcattgatattcggactcttcatattcgtaatgtggtaatgttgagtctattcattcatccaattcaatgtatgggccttacgaatattcatgggcactcataatgtttttccccactttttcggttgtgtgcattgcacaagttgagcacaattggtggtgatgtcataactcacttttgctagctccatgattcagaagaattttccgccaatttacagtgttgaaggtgttgtcctgatgatgtcccacaataggaagctaataaagtttattagaacagagcaacagaatgaatgctcattggttcatttctggtcttctctatgcttatgtagcagtcatgctcatccctgttactggtattaggatggaatctatattctgcttgttcttccttttataagaatgcaccgaaagacaaaagtgcatcagcatgaaagaaaaaaaaagactttgttgagcttcgtaatttgcactcgatttagcatttttggatcaatataccagttcttgcgttttctgcatactgaatgctgattttctatggagttcaggagatccatgaactcaacacaagtgtacaaatgcagtttatctctgtttttagtgaccccctcaagcctcatttgtcttcgatctcatgtttctcttgcctactctatttttggaccatgaacttagttccacaaaagtggagaaccatgggtaatgctttctttgtctgttttgcattgttgggttcctgactggtattgcaattctttgcaattagctatgtccttatgttgcaggagtatttatgtttaaatgatgtgtcctctagttgttcaggacaaggcgagtgcaagtaatctcacaaatatatcaattatatcggttagccacattttttttaggctaagtcataatatattcggcctgcaatttagttctagttaccttttcttaatctttttgccattcagttttgtattttattggctgggccattccttttcagttgtcttgtcattaaaatactagaatacagctagagacactgttgttttcgttgattgatgaataaaattgacaagtttgccgttaccagtcaacagggaccaagggacatctaatttttcatgcacattttttttccatctttatttgttattgctctctgcccttctgatatgatttgaatcaacttgtagaatggctggtctctatgtgtgattatgaagatctggacttaatctgagatgtctttatcaagtgaacataaatatatcagcttggcaaagttgactagagaagcaattaaggtaggttgctgcgtcacacagcacgtatttcagatggatgtatattatgaagagataagaatgacggatgccaaaattaatcgctattcattgcatggcatcatcaacagcgtttttttcaacaatttcaaatactatatctcgtcctaatttgaaaattgcatacctttttcaattacataatgtctttttcagagatagtagagtgtccatggaaggcgacctcattatgttgcaacgtgggagcagcagtaccaattggttagttcagctaacctgtgatgacagactcgtaaacatcccatttatgtgattgactgttcttgctgtgattttttccccattttctatgctcgactagattaccttgtctaatgaaacagcacagcgagtcagaattcatgagcttgatagaaagccatcatgtgattcagaacaataatcatctcaacattttcagggtaaatgttttcttttcatctcggaaaggaaacaaaaacaaaacaaagatgagaagtctggtcctatgtctaagcaaaacttcttcatttagaaccactaaagaaggaagccaggagagggggatggatatagtccccagtgtatccatgatgtatcaaaattatgccaccagcacatggattttcatgctagtctcacaattttagtaaggaatatatcatggttacactgggggaataggcaaaacaaaagagaattactggacctaggacttcatatagacgcttttctttttcttgattgatgttgatcttctgccaaacggagaattgcccccccttttgtttaacttcaccctctcctggtcttcctgctgctattgctgttggcgttgttgttgccgttgtcctgctgcaggaagtcaaggatcacggggctcttgcactgcgggcaccgcggatcatcctgcgggagcatgacgtagatgaagcagcgagggcaggcggcgagcaccatggacgtcgcctccgggctgttggaccactgcaggccgtgctcgttctccgacgacaggcacgagctcggcgacgactcctcgtcggcggccatcgccctcctggacgacgagtcccctctcgccggcagcgagaggttcagcttcaggtcgatgcccctagagctcttcttgttgctgcggctcatcccgatcgagaggtaacccacttgcctacacccccataaaaacgttcgttagccggttggtcaaatggaaacttttgcacgactgtcatatgaagcttagaggtaggagaagacatggcgatggcgaaggaacttactgttgcgtagggccggtgagacgtgcagatgatggtgattggagacgatgaaaggggaggagctccgagcgggtagaattgctcggggtcttcttgctgggtggtgtggttggacggagaagagatggcaagtatttatagggggatgagatgggtgagggtgagggggaggtcaattggttttctttaatgcagcattaagagtatagcagtactactactacttcatgtactagaggctaaggaaggacgcattttattaccaaggtattcatggctggagagtggcatggtaggggttgaataatctgtgttgggtgggagagaagtgcgaggtgagaggctttatggttggtcatatacacaaggcaaagaaatgtttttttttcatttatctgaaagaagaaaatttccagtgatgaatcttctctttttttttcttacttcggcggtagttttctttagccacatgctagatgactgtggcaatctcccaacagtgagcctggttgaaaattgtaacccatgataggcatgtctagtttaattgtgccaaaagtttgctagtgacttaattacctccagtagattttacaactttgtagtggccatgtaagcaagttagctggacttattgggtaattatgacaattatttattatttttaggtgtggagttgaaagttgaaactcatcaactatttgtcctttttgattgcttctaaagattatagaaatttgactgacctccaattcatttcactacttcaatgtggccttgaatggaatttattgggcacaccatctcaaatgcccagcattgctgtcaaaaaaaaaaggagagaagagagaacttgaatgttgagccatggttatgttaatcgaataaataggtttcttgaatagatatgctgctagtgcaccttatgcaattaggtctttaaatggtgcaacgcaacacctatgttcttgcacgcaccgatgcgttgcttctggtgcgcatcttgatacaatgacgacgagataagtaatacattaatgccactttgtttgatgcacataagagcagcactttgaaatctcagctccgttggggtttttcttgtttccagcttgcagtgtttaaatgccgagagcagatattaaattcgttagttgacttgttagtgttatggagatgttgcatcctgattgtgtgacttaatcaccttacaattaagaaaagggttaaactttgtaaagtcatactagtatcaacccactaatgtaatccccgagattgcttacatatcccaccttgattaatgatgatgacatacaactcacttaaagttgttttggtttgtgtgttgcattgggtttggtcaatgctgctactcatcaaggttaagagatagccacctgtagagaaaataatttgcctcagttaggactaattctagcattaatgctcccgttttgggcaaatagaagcagtaatggatggttttgggatccagagccaacgctatcggcctcgggatcaaaggtttgagttcagtttacctgattttataatatttcaccaccattcatcatgattcatcgatgatgcgtctaaaattgcaggtaaagtctcggagttgaaggcaactatgaaggcaaggttgacccaaatgcgagctcataactgtgccactaggttattgcttagtacaggatatggtatataaatgtatctttgcacgtatatattgccattagtcggtgtatgggggccaaacccatgtgctcttctttaattccatggtggcatctaaggagcttaattagagattatgagtgaaaaataatctccactgagttttctcgcgccttcttgttgtggttgcaaaggcaatgagctccaatgcaaaatagttggatatattgcgatttcgcataaggtaccaagttattggcaaaattcacaatttaattactttttaaactccagctgctgttctagtggactctcttgttgcttgtcttattttgaggtatgtattgatgaatactatgatagctcttttggaacgcatgaattttataggaatttcgtgggagttagttgaatttcagtgaacgtcctgaaggaggccctgatatttgtgctactgatatagtatttgtggtgctgatgatcagatgatgctgatatgccactcgcttagtgaagacttgcgaggtgtcgcgcttagatgtttgaattggatagaggtgatgggagtatgtcggatgctaatggcttaattaggccgtattattaagtggatcttatatggctagtccatgtcacttgtcagcgtgactacctattccatcagtttccaaatataagcactttttacattgcttattgtaccctctgtccaatatatgatgtcatcgattttttttataatgtttgttatttgccttatttaaaaatttagtataaatatgtaaatgtataagttaatattatagtttcttttatgataaaacacacaacaaaataaatgatatttatattttttttaataagatgacttgttaaacgttatgtgaaaagtctacatcttgggacagagaaagtacatattaagattggagataaaaactatagtgtctgtaaataaagcaatggatagttggaacttggaagtgggatgatggttgaagataaaattgggagatattagactgagtagtgagagtaggactctaagaaatgcttatatttgtacacaaaatttgaattctaaaagatagttatattcagaaacacacagggagtacacttttgataagtaagtttgtacactttacaatattcgtttgacaacatcgtccagtcaggggcggatccagcataggggtggcggggtctcgagcccccacgaagaccccactaaaattttttaccatatatagataggaggggggactgtaacattatctagtttgctcagaccctactactattttttttctggatccaccactgcgtacagtatattacatgtgcagttgaggatgtggtgcggtgtagtagtgtgcagttgaggatgtggtgcggtgtagtagtgggttgtagtagcgggttgggtatatgaatctatcttaggtttaaattctagtgtctataaatattacatgtggagacgcagtcgaaaatgggtgaggttaaacatccatagtcaaagtatatacacttgtgtaattaatgtgcaggaatactagcaaaataccagtgcgttgttacagaatatagaaaatcacatcggcgcattgaaaaaagaaagctattttgaatttagagtttaattctggaatgaaattagatgttttatatagctgtaaaaaattttaaactgactcaattgacttatcattacttatatttggttttgagaatggacatatgtgtttcacatgtcatagttttaggagttggtgatggacttatggtaaacccaacaccaccactactctcttttaaataattataaatttagaaggatatatgaaaatggtatgttcaaatctgtcttaaaatacattttcataatactataacggtgttatgtttcacaatatcaatcatagttgaaatcagtagttaaattcgcatttcagagtctattccaaatcatttatttgtgatggattacttgtaaaatccaccataaggaacagctgctttcgaaaatgatgtcaccagcagcagttttagtaaacaacttcattgttctgtaggttgtgcaatggataaacatggacaaaatgcaagaatcaaagggtagacagaattttgagatgttaggatacttcctgaaaaaaaaaaggaagttttatttcaactgcggtttcattcatacaaataaacttcaacagctagacatccatgaacaagtttcattgataattacacctcaaatttaagctaagttcaaatatttgaaacagacgatcgcaacttccaacggacacataccctacaggttttatgaacgatagaaaacacagaatgaaagatcttcacagttcttaaataaaaaggaaaaaaaatcttcacaatcctagttggccgtcggcagttatttttccatgccttcattgcttgcatcgagagaatagacaatagatcatcccgcccacgaagggaacatctcctcaatattttaaccacacagcgccgtgggggttaagtgccacacggcctcctgtaacacccacttttatataagtttaggccaaatatcatattctaatcctaattaaaaagatcctgcgcattaacgctgcagcagtgagtcaaacacctaatctccgctcacacgcacgggcgtgtgcaactaaccatgcattaagcaataggatttgtttaactttggttaaaagatagtggattcaaagtgcagggcatcgcattaatcttcgcttaagtgaagggattactccattttaatgatggtacgaacttgtgactaaactattgcaagaagctgacacattgtaagaaaaaccataactactaacccaaatggtttgaaatacaaccattagcttcatagatgtcttcaataaagaaaaactaaaatctaataataccaccataattatcatgacaacaaagtccagacctaatgtcaactctaaggacaagtctaaatcttatttatttccatttaattgttcgtacaattctagctttatcttatatactcactatttatctctatgcaatatcttctgagtttgaaagtttagaagatatactgagaagtatccatgcaatatacaaatgcaaaaaagttgacatttgatgaaaacattaagcaaagcaatgttggtttgctctagcacaaaacaattggtcatatgatttaatcaaccagaagggtgaacttgtatgaacactcaccagtatgttgattctttgagatccaacctaaacaaccgctgataactcgaatcttactcgcagcacagcgggtacttgctcaaataacctctttgttatccctgacaaagaagaagcaggacaaaattagcttcccctctccaattgctgataacttcaacgggacaacgttccaggattcagttcgtgcaccgtggtgttagacatgtgatacgacatgcacatacactcgtgcgcatgcccacacggagacatagtgctgcaattcacacatcccactaagaatctaacatggaccaaccagatagcccgagaatttaatggcattgtttatatattgcccaaactgtcgttactccctagtgctactaatacaaatgctatagggagatgtttgaatcaacgcatgatttcattaataacaagctcattgacctggaagagcactggtgcagcagaatgcgtgggcaagttattaataattaaatcgacatgaagataagtttgtctgccataaacggagcctaatagattcacacaccaaaataataaggatcgtgcaatacctatggtagaggttctccaacaggctaggtgattagatgaggtctatatacctaggagagcacatgcaaacaccaaaccttcgagcacaggtattatcatgtatctatgggtgtactgatatcctttttataatcagaaaatactaaacatcatgacttgccaatgatcccactacatcaccatgcacagatcttagataaatctggctatatttgatttgaagattcaggaagaaagatgatatagtgcaacatagtggcggtagtgcctgtccgagactgcaagctgataactaccagcctaccatcgacattgcattttatagaagacacttcgtgcagtatcgttagcgaattcattgtctgatacatgtgtatatttagcatagcgttgtacagtcagaaaactttcagctcaaacatttctcagtgatatgacgctgggccacaaaaacacacacagccacacaggtgacaggcactatgcagatgaaacagcaacaaggcctgcagaaggtggtccacttgacgccactcaacaacaagtctaatcacttttgtttaagactaggatgaggggacacaatttaataggagcacatgttactaccttaccagttaccacatttgcaaaccaaattccaaatggaggaatctgaaagcatcgcgcctcttaacccagaggtgacacgctacacgtgggccttaatggaaactgcctgaaatattactgtaagcatagcttactcattagacttcatcaagccataattgacttttccaggtttatatttctgtgagcatatgccctcgagttgataggtcattggtatcattaatggctgataacaacaccaaaaggggtatgcaggtgcaacagaattttgaaacatgattggaattgaaatgaattatgttattactgaagtaattccaagaaaagaagagctcttgtaatgtttcgtaaactcaatcaactaaaaccttgatccttactgtgatcacatgacctaatggttttcaaagcataaatgtgacaataaggctgtttggtttatcgcccaaatcaaccctaacgaattcttgtcatgcaaaattttggcattgctaatatttggtaaggtagagacacacagtagtatgtttggtttgatgcaaaataacatccatggtttttcacatttcctgcaaataacacacttattgcatgcatgaaggcaatataagcaaacattctatgtgctactttcagttagcaagtctaattgaaccctgtagttctcaccttcaggaagtatagccgaggcacgatgctcaaaactccaaaattttgcactccacaacttctggatatacagttgttatttgcctcttctatatcaatgaattaaggcagagcttctgcctttgtttcaaaatgaaacttctggatacaattatctgagtatttgaacatacttagtgagggcattgaagctcaagccacacatggaaaccaagatataataggaatcctaaggacatacctgaagagctatatacttgttttttctgattaatgacaaccaatatcaggataccacatcacatactgatcctgccaaggcaaataatcagcaaccttttcccccatgtaaccatcctagtttgcatgatgggtagtagttcagtagaaatcacattataaaaaagctcgaattgatgaacaataactaagataggtagtaaagaagattaggaatgaccaagcgagcactcaccgggagtcgtctcatcaacaattgaaaaagtggatgagactcagcaacagaagtggatggtatcaaaccagtgtcacggaatcctctggttctcataaggtatcaacggcagaaagaattcaaagcactccgaagagaacagtctacttaagatggtcccgttcctcttattaactcccatacagcttgttaacaagcacatcatttatgtcatgaagccagatttattgtaggcattctcaggttgagtgtaaactcttggtttctattgatctcataaccatcatgagtcaacatgcacagcattacagcacacatggtttttcctctcattcagaaagatgttcactgaactttccagtagggccagtaaacatatggcaaaataaatccctcactcatctcaaccatgctactgcaaaaccaaggtacagcctgcaattttcgttatccctcttcctgtcatctcagctctagtttcagaaacatttccccatcggtcaatgttagcataaatgtttgacaacgagacataatttccagcattttccggttcaatttcaaagagcttctttgcagcaatttttccaagctcaatgtcacaatgaaacttgcatccccccagcaatgcaccccatgctcctggatgaggttctccaggcattgacttgataagctcatatgcatctctcagcatcccaaaacgtccgagaagactgacaaggcaagcatagtggtcaccagatggtacaatcatatactcattcttcatcatatcaaagtaccttttcccttcttcaactaggccagcatgactgcaagctgtcaaaacaactgtgaacgcggcgttatctggggtgatgccctccaagagcatctgagaaaaaagctctacagccttgctagctgaaccatggaggcaatgaccttgcatcattgaacaatatgaaaaaacatctcgaactgacatagattcaaacaaaagagtagctctctccatgttgccacactttgcattcatgttaatgagacccgccatcacatggacattgttcatgtctattggataaatcatgatgtaaccttcaatccatcttgccaatgtgatgttaccaagttgggagcatgctgacatcaaaccaacaataacaagctcatctggacatatttcttgcttttggaactcgttaaaaatcctcaaagcctctccagggtaaccgttctgtgcacaccctgatatcattgttgaccatgcgaacaaatcacggtcctctagcttatcaaacaatgttctcgcagctcccatgttccctgcatttaaatacccgccaatcaatgatgtgtacgctgcaggagttctctcaggcatttcatcaaacagcttccttgcaccctccaagtcaccgcacttcacatacccatcaaccatggcattccaatgcaccacatttcggtgtggaatttggtcgaacaactccctggcagtcaaaatatcaccagagttgacataggcagtgacaatggccgtccaagagacctcgctggggtttgtcagtgaatcgaacagagcccgggcggcggcagcggcgccgcacctcccatagaactggatgagcgccgtgcggacgaagaggtcggcgtcgactccgaggcggatggccgcggcgtgcaaggaagcgccggtggggagggaggaggcgcgcgcgcaggcgcagaggaggggagggaaggagaaggcgtccgggcgggacgcgcccccgcggaggaggttgaactgcgcgagcgcgtcccgcagcggggcgtggcgggcgagggaggcgagcacggcgttccgcaggcgtaccgggacggcgacggagaggagggaggcggcgacggaggggcaggagagggcgtcgcaggcggcggcgaagcgggcgaggagcgcgtggtggttgtggaggccgaggcggacgatgcgggcgtggagctgggcgaggcagcgcgcggtgcggcagcggccgaggagggtggcgaccggtggggatggccggaggacggcggtggtcatgcggcggcggcggcggcgagcggggaggccggccagcgggtggtcgcatttggattcgcctcgcctgggttaccgagtttcgatcgctcgaacccaaagtcgagtcgactatggatgactggatcacgagttgggcttgggcctagccatgttggtgtggtgctagactgctagctagcccagtagcaaacgagcaactaatgtaaaaattcagaatttttttgtacatgtttacgatttttttaaaagaaaatctacacatggttttcatatatccaattgaaatatttgaagattgatggtttgattgagttttggaaattcaacttataaattatgtagaatcaaaacaatatgttgtatcctgaattacgttcgttcaagaatagctcaccggttatgtttcttgtatttgacccaggccagcctgatttagggctattcagattgatgtcattttcaaccatactatttttgagtaaagttgccaaagaaatgtctatgtttagtttgttgttaaatttggtaaatacataaaaaatcctgccaaaattttgacaatattgccaaaatttttgaataagtctatgtctaggtttattttggctataatctgaacagaccttaagtcctactcactccgtccctaaatatttgacgtcgttgacctttttaaatatgtttgaccgttcgttcttattaaaaaatttaagcaattattaattattttcttatcatttgattcattcttaaatatacttttatatatacatatagttttgcatatttcataaaagtttttgaataagatgaacggtcaaacatgttttaaaaagtcaacggcgtcaaatatttaggaaataagagagtatatcacaggtgtttgtaattatggctaattattctttcagtggtagacgagatacctatcgacagcaagatgttcgtgttgacttcatcaatcttaagatatgtcggtccagtcttttgaaaatgctagaaaatcttataatataaaacggaggaagtagtagatatgaggtatcccatacactcatacttactttacggggaatgtagttatctactccctccgtcccaaaaaaaaaaggcaaacctgggttcccgtgccaacgtttgactgtctatcttatatgaattttttttataattagtattttcattgtagttagatgatacaatatgattaatattttatgcgtgacttatctttttaatttttttcataattttttcaaataagatgaacggtcaaacattagacacggaaaccagggtttgtctttttttttagacggagggagtaattgtacacaaaaagatatctatgaataggggtatactaggagtgaatacgcgtcacacaaggaaagattgcatagttcaagtcatagacgttatggcttcatggacaagatctagtgtcctacttgggatcaagatctacttgaaccagggtcgtattccggtataaagacacaccacgtcctaggagaatagggcgtcaaatctcaagccacagccttcatgccaaatccatttaggggaagcccagagctagccgccaattgcattgttgccgcatctttagagttgtaatagtatagcccactactagctctaaattatctatagccaatgtaataaccaattcatacaatagttgcttactatactattaatatctgatcctatatatcatacacacattatgttttggagtccgtgctgcaactggctacagatctgtagcccactgctattctctctatttctttatctttttaaaatatgtttatagttggcttatagcctgctattgtacctgctcttagtcaaggttagttgagtatgctagattagagatcccacctcagacatcatactcagtgtgatactttcggtcaatagatataaacatgaatagaactattactcacattgagggttcgaacttgtaaaaatctaattgcatttcttcttatgacatctacgtgcatatccttataccgatcttatacgctacatccacaaatactatagccaggatcttactcctcaataatgctatttaacaaattctaaaatatttgacaattgtataatcaatgaattatgtaaagagaaaggttatattacaaaccaatcaattttgtgttcttaaatatttgttaaatggcaaaatttgctacatgatatcagatattatggtatttattggtcgataccgttaaacatgggttggttttgtgatactacaaaattttggtggtccagtaattttggtggtctgtgcgagtgtgtaattgtgtacaactgtacatgcagtgtcgtttgtgcgtgcgtctgtgtctaattgcgaaaaagatttagccacaacacatatatttgtcctttaaagttttaaggagttgaggagaattacaacagcgtacatccgcaagaggatcaaatcagagccctatacaaaaggaaggatatgcagcgcacacatccgtccgtacagtcaagctaaccaaaagccactgtggattcattcacttgtcgaagtagccctcggtcctgcccttgaacccgatctggccgaaggtgagcgccaggaacagcccaaggtgccacgtcaccaaccacagcctgcaaattaatcacaaaacccacatgaacaattagacacgtagccactgaacgcttttgctactaattatataggagtactatactgcgtgcctgaagaagatagaggtactgaccagaacggcgagtcgagcgccggcggcgaggggaagtgggagagctcctggccgatgctggagaagaagagccccgtgaggctgttgccgttgatcgccgggacgctcgacggcgcgatccacccgatcagcccgaacccgatcacgttcaggtccctcctaagccagtcctgcggaaacctgcaggcccaacacacaacaccacgtacgcaccgtcagaatctcacgccacgtacgcttgctgctctcagaattcttcttgcaggtgatcctactactgctacttacgtcatgcaggtgatcctgccgttcctctccaggttcctcgtcagcagcgggttcctcgccgacacccgggcgcccgtcgtgaagcctgcacaaaaaaatcgagcattccaagatcaaattaaacacacggttatagcgcgtgagaagatgattgtgactgtgacgcacgcaccggtggagaaggccggccggcgggcgagggtggcgccggcgaggccggagacggtggaggcggccatggcagctaagctagcagatggtctctctctgtctctggtcggcgagctgcgtgtgttgtctccgtggtttgtggcagcgtaggttaggccttattttgtggtggtggctgcggttgcggacgtggcgggaggggatgagcgggcgcggatcgttgtgggggctcgcgtgatgtggatcacttgcagcggatgaaatagattcgtcgcccgtgcagcggcctattgggagactccacttggatatgagtggataaggccagtgccacggctgtttctgccgtccagtatgctgagtactcagctagtagttcctaccgaggcaaacttaatttcgtcagtagaagactatggcagttttgtggagattatggataccccatatttacacggcatgtatatccgactggatatggaatgccatatataggtagaatatctttaagggactcgggttacattccttaacttgtatatcaaggaaatactcgggattctagtcggttacgactgtattttatctttatttgcctattccgttaggaatataggctataccttgtaatacggactcctctccctatataaagaggggtccgagtatctcttgggacataacttttctcccagatcatacgatcaataatatactcggtggattaatccccggacaggagtagggtattacttctcattgagatggcctgaacctgtgtctctaaacccatccacttttctagcttgatagccaccctttttcgtattaccgaaatctttgtttcgacaagtttaactgcacgtagtagtgtacccgcaaatcatactttggtaggcgatggccggcactatgtttttccagatcaggtactctgttttcgtgctactaccttggaatgtgatcgaggtctagactctagactatgcaattggtgaactggagctgtttaacgaggtaaagtggtgaacaggtagataacttgtgtggatgtgatgagccaccggcccgcctagttcgttcacctcacaaggcatgataccgggcttcgctgcagacagcagactttaccaattcaccgttgcacacgatcagaaacagcggctcgtcgtaagttcttaacccagcgggcgggagacgcaaatccgtaaggaataagttcacttcaggtcccctatttgtcgctcagtccgatttttgtcctgaaccacaaaaccgggtacgacccgtcccccaactttcaaaaaccggacaaatgagatccctcggcggtatggagagcggttttggccgacgtgacgcctatgtggctaatttgactcagtcttcatctgacgtggcaattcgatctggaaaaatattaaacactatgggacccacatgtcagtttcacacacaaattaataaaaaatggtggagcccacgtgggccactgggccccacatgtcattctcaccccacctcttctttctccccatctcaccccacatagcagcggcgccggggacaacgacggagcggagtggggggcggcggcaggcggacggcggcgcaaagccgacggggcggagtggggcagcggcgggcggacgcgcgggcgcagtggcggcgcccgaagccggcggggcggtggagccaagcgaacggcgggaacctcgtcgttggcggggtgcggcgctaagttcccgcccgtgtgcggctgcaactcggcggcaacctgctcgccggcctcctcttccccctctcccactggcacagccggccgccgtggtctcctcctcctcctcctcctccacggcagcggcgcggaccccgcgcgggggctcgtggaggagttcggggccacggcgccgcccgactccgacgaactggagctcacgcgggcgaggtgccggaagctgcacgactgtgtcgtcgtcacttgctcatgttccttctcattttgcagcctcatcacctgctacttgcctcgtgccgtctcgctcttcttcacatccatccaacgcagctcagtccaattatactctctaccaatgtagttgaccgaagtactacacatgtgttcaagctggcttcaacccccaaccataaacaccatgaaccataagcatgcagagtggcagacatgcagttgagctcttcctctagctagctatccattgattagtggtgtcgtttaggagtttgaggagctgcagctcgacggcaacgaggcagaggagggaccgcagcgcgggctgccgcagcagggaaggggacgcggacgccacgactcggtcgtgcagctcccggcaccgcgcccacatgcgcggccctgaactcctccacgagaggggagggagagggagagggagagggagggaggaggaagaagagaagggtgagaatgatatgtggggctcacgtgggccccactattttttattaatttgtgtgtcaaactgacatgtgggtgccacggggtttaatatttttctggatcgaattgccacgtcagcgccatgtcaatatcacgtcagatgaagatcaagtcaaattagccacatagacgccacgtcggccaaaactgccctccatactgccgagggaccttgtttgtccggtttttgtaagttgggggatgggttgtacccggttttacagttcaaggacgaaaatcggactgagcgacgaatagagagacctaaagtgcacttattccaatccgtaaagatcccgaactcccgaaggccagcccattccgcggctaccatacacactagcgtggttacttttcataatatactccctccgtcccaaaataaataatgttttgcattgttcattcaatgtttgactatttgttttatttaatattttttatgattagtatttttattgttattagatgataatacatgaatagtactttatgtgtgactaattttttttatttttctaaataagacgaatggtcaaacgttggacacagatatccacggatgtacatattttgagatggatatagtatatagcaacctaagacaaaatttattgtagtataaaatatcacatcttatcttaaatcactatattatgatgagacggacggagtattactgaatggttcatcgcgatgtctttgctccctgattgcaatcagcttgcacttgcttcctaacaaatttcgcattaagtacaccaactgttcatttataactatgcgtcaagcgactaatgagatactcactccatcttaaaaaaagcaacttagtactgaattggtcttattataatactataaatctgaatatgaatagatatctatctaattcatgatactaggggtgtgtttagtttacgctaaaattgaaagtttggttaaaattagaacgatgcgacggaaaagttgaaagtttgtgtgtaagaaagttttgatgtgatgataaagttggaagtttgaaaaaaaagtttggaactaaactcggcttaggatacatccttatccatattcatggtatttgaatgtgtccaatcgtgtgcaaaattgctactccctcagttccaaaataagcgcaactatgaatttctgtgtctaattttaatcgttgtcttatttaattttttttaaaaaaactaaaaacataattcacgcataaagtattactcatgttttataatttaacaacaatagaaatactaatcataaaaaaaattaaataagacggacgattaaagttggacacaaaaattgatgcgcttattttgggatcgaggaagtatattttagaatgtataataaaaaacaatctagaggatctaagataacgatatccagattattatcctaggttatatcctattattatttatattggtttattttgaagcggggaaagaagctagcattctagcaaaggagtagacgagtagctcggttcattggccgtcgtaccatgggaaggtcgctgaagcacggagccacagagcaagagggtgtggaagtgtttaactggaactttggggcgtaccgacatccaaccaaaattttctccgtcgattccacgcgccaccgatcgcggcgtccgatctgtcctgaacttctgatcgactgatcctgatacatcagcgatcagttcagttttcccatcccgtacacagcttctggcggagagtgtcttacaggataaccgatcatcgcccgttgtcagtcaaacgaagccatgagatgaactgctctgcatcgtactacgtacagtgagcccgtgagatcgagagcgacgccgaccaaacagccttcgtcgacgggattccttcctaacaagacacgtccagagtccaggactcttatcagatccgatcgcaccaaagagcacgtacgcacgcgcggccgctgattcgagccaagtttttccctgggtaacatgctggattagatggatcaatcgatgcaataccgctagaaacgaaaagatggtgacaaaagcaagcaaaccttccaggacagcagcaggtcaacagatatatactacacaagaggaagagccgaatggtttgagtttaggtcatggaattaactcagaatacgggatcacaagcttgaggctggaggtgctgccaaagcactcttctaactcttcacctgtacgccctattcaatgaaaagacactctagtgctgttttcagtttttttttaaaaaaactcttcacctgtactgaatcagaattatagtataattcagtactgcacaacgtgcaaatagaggatcgatgaaggcggcttgaccgctgaagacacggcgacatgcaaaggagaggcttgcgagcgcgcatgagacaacatggggaatcttaacttggatgtcaaatgtggcatttggtccagatgaagttcctacattcattttctttacctaatcgaagctttccacgattccacttctagacttgtcctagttcaatgactaattgtccacaaggaatatgcgcgagtcataaacaagctgcgcagaaaacagcttctctctccgttttacaccctccattttatagggtaagtcattttaacatttttcatatttatattgatgttaataaatctagatagatatatatgtctagattcattaacatcaatataaatgtgaaatggtagaatgatttacattaagaaacggaggaagtatataataatgcagttaaaccgggagacgatgagaaaatggagatgtttctctagagagaaaaaatgttgtaactcgagataatgattaattggattaaccaaaataattatctcagtctagaacacaacagaaggttctctgtgagactaaaatgctgagatgcacttgacagtgcagtggagcggtaaggggtatgtaatttcaactccaagattttgtgtttgatcctaacatgctcataattttttcttaaaaaaatgtttgaagggacatttctccctccaaatatcttcttattttttagactgaaaatgttgaatttctgtctgtatgaagttatttttttgaagaatctgtttttactccgaaacatgccttgtgccgagatcactgccacatgttcctgagctgcattctttagctctaattagggcttatatggttctttaccatttgtgatcttaccatttttcttttttacaatggtaattactaattttttggggaaaattgactaggcttttgattggtaagggcttgtttacttttgtgtcacttttaaccctactaattttggtattatcaaatttttgtaaggcaacaaattatacatattcttattaatgttaccctaccaacctttggtagggcctgttcactttgatgctattttcaactttaccaaattttggtaaagttaacaaaaaagtggctacatttagtttgctgctaaattttagtaactatataagaaatcctaccaaaattttggcaagttgtcaaaattttgacaacattgccaaaatttggtaaggttttttttcggcatcaaagggtctattcactttgatgccattttcaaccttaccaaattttggtaaagttgccaaaaaaagtggctacatttagtttactgtcaaattttggtaactatataagaaatcctaccaaaattttggcaatgccaaagtgaacaggcccaaagttaacaggcccgtagttttataagtttccactcgtaaaaattccatcaaaacttgataaggcttcaaacaaaacatatctagcactaaaaatttggtaatgtaaaaatgtgttaaaatttagtataaccaaattttggtaaggttaaaagtgactataaagtgaacaagccctaagccaaataatttggcaatatcaacatttattttttgattggttaattttggtctcaaacaaaagaagcctgaagcctgaaatctgcaatctgaaatctttagacagttcccgtgtactatctccatcactaagacttcatttttagcccatttctacccatgccaatacaaaggaaaaaaaaagaatgttcttactttagcaaactccaatataattattctccactttagcaaatctcaatacgtttgtctcccaatactctaatgcaatgatcgctgaaaaagatggcgtctctgtaagacaaatagatggaaaacaaacttattctgagatgaaggaagtaataccatagtagcatccaaatctttggtaaaactatcttttctcttaaaaacatggtaactcaaaacattatactaatgtaaaatcggataacttagtaccatcttaaagatactcgagttgtaacataacatcgtaacatgataatgacatataaaggctggatctctggatctacatactaatgacgtactccctccatcctataatataagacgcacacgtatttaaagatttagcatttaaaatatttcactaacacttagtataatactcccttcatctctaaatgtttgacgtcattggtttttttaaacatggttggtcattcgtcttatttaaaaattttaagtaattattaattcttttcctatcatttgattcattgttaaatatacttttatgtatacatatagttttacatatttcagaaaagtttttgaataagacgaacagtcaaacatgtttaaaaaagtcaacgacatcaaatatttagggacgaatggagtataaaataaattttatttgttaaaaattatatcagattgatatttaaatttactttcatatggttatagttttgtggctaggaaccttatagtacatggaaaattataggttaaagattagttttggagaccgtgtcaattttgaccgcgtcttatattatgggataaagggagtagcatgtattttttagctcgtgatttttacagcggtaataaacaaatttacccatgtaaaatagatccttgccatacatattgcaacgtcatgcagttatatatgaccatatgaggatttgggccccgaaaccctgatgctagttcaggcaacccatgacggccggccgagccaaggcttcagaaaccattatgagaaaagaaatcaaaggatatatatgattatcttattgcggggccaatctgaatctactccaatatgactttatttaatcttcagtttaattgctctggcaatcatgaccgcgactctaccgacatgctcagactgatcgcccaggctttgaaagctgaggaacttcaaaaatggagcgcgagaaaattgcattatgcatataaacagttctaaactctgaatactattgctctgctttccccagctgaagcacaatcacagaacaacagcgtagcattgctgtgcatctaaactactcattccgtctcaaaatacaataacttctctttgaatttgttctaaaatataacaacttcttcaccagcattctctttccaaccaatcacaaacctccatcattcactttttccatctacctccatcttaataactgtgcataactctaaaatttcttatattatgagatggatagagtagtaagcagaaagttaccacatttgtttctcattttgattgcttcaccgaacaccgaacgagagatcatgcagaaaatcgcaagatcaggagaaagctcgtgtgctaaaaagaattattaggagaggcttatcgtgtcaccgcgagaggataggaacgacacacacggacgtacatatccctgtatcaatgcgcctttcttgacgagaaatctgcaagagcaacagcgcagcagcacacggtagctgtacgtacgcaggccaagccgtcgtacacgtaacacgtccagtagccctcgatctcactctcccaggacattaatgccggtgagccgcccccatcgtcagcatctcagcggtatgcagatgccgtgccgatcgttcgacggccttctcccccccgcgaggaaaacgatatccttctaaacgcaattaagaatcagatacacggacacacggtacaccggtgcacaacagatttgctttgccatcaagccagaaaaaccggtcgccgtgaaaggcacagggaaacaaaacctgtttttcttttggttctctgtcacgtcaagtgcaacgaacggcacgtctcgcttgcgtttgcggttgcgcccgaccaaccagccgatcgcacgacgcgtaccgactcaagagtcaggtagacgcgccgcggcgtggcacggaggagacacggcgcgccacgcgttcgcggcctgagatgatacgccgaggcgagccgcgtcgcgccgtaccacgggcgccagcgcggccctggcacgcgccaccgaccccttctcgtcggctgccacgccggcgccctgcactgcaagccgcgcccacacggccacaccggcatgcgggttaaaacgaaagaaaattgtgaaacacaccaacgcactgtacaggtactggaccacgtcgcagccaggacggctgtggttttgaccagagttcaccgcgcttactactagtagggcacacaaggaggagtgctatataaaagccggaccacggcggaggcgcagtagttatcaccggttcatcgtacaaaagaggagagagagggtgatggcgccagggagagaagaagagaaaatggtggcgactactacgatagaggacctgcacgccgacgtgctggcgcgcgcgctgcggcggctggacgggcggtcgctggcggcggcgagctgcgccacggcggggctccgggcgctcgccgcggacccggagacgtggcgcgcgctctgcctcgcggagtggccgtccatggcggggcacccgcggctgctgtccgtggtcccgccgcgccggctcttcgccgacgcgttcccgttcccgcgcccggacgccggggagctcggcggcggcggcggaggtcccctcccgtcggagctcgtctcggcggtggacgtctactacaggggggcgcccctgctctcccgtgtcgtggagacgcccgcgtcgtcgccgtggttcctcggctcgccgttccgggtggaggccgtggagtgcaagaagccggcggcggaggcggcgctgtctccggcggagctggagctgagctgggtggtcgtcgaccctgcccgcggccgagcggtgaacgtgtccagccggcgcgccgtggcggtggaccggcactggtacaccggcgagacgctggtgaggttcgcggtggtgctgggcgggtgcaagttcgagaccaccgtgacctgctccgagggggccggcaacatcagcgaggtcagcctcgccgtgcaggacgccgacggcgccgcggcgagcggcgagcgaagcctccgcctcctcgctgcggcaatggaggaacagaggataggcggggggagagaacgggacgaggcgaagaggaggtatgacgagttcgtgaagagcaggaaggggaggaaggagagcaaggcgcgacgcgaggcgctcatcgacctgtgctgctccgccgccagcgccatggccgtgctgagcttcgtcgccgccgtggtgctccggtgatcggcggctgcggttaggaaaaagagaggacaaaatgtggccttctcttcatcagtgtacaaatcgagcagagaactcgcgtgtatttttcttccaccgtagttacattattcttaaactataaaaattggccaggtgcttatcatccatttaaaataggagataaaacacctgagctgatcctaggatgtgacattaagcctagtagaattgacattgttcgcatgttccaatctcatgtagtagtgcttttttacgtttcaatttgaaaaagaaagagtaatgttttcccttcaaataatacaagaatgcagaaaaaaatgtgccgtctgtccatcgcattacaattcatgttttccgtataatcaaggtactgttccacagttttagggaaatcaaatgaagtttaagttaggagtacttgaaaacaccaattcattattagttccatacagaacactggacagacatggaggaaggacactgttctaccacagcttcatcaagagcatatgcaactatatgaacagcacttttcagatcatttcatggcgacagcattatagatactgtccatgacaaagaaggaaagggcacagtatttgatcggcaagagcatgtgatgttatatcataatctgagctgttgatcgggcacatcttcttttattgcaaaactggaaatccagtattattacgcatgaacttctcaataataataggaagaagtcccaataacctccccataaactttggatgaaaatccattagcacctgaactttaaaactggacattcaacattctaagctttgtaatatcgttcatattactctctatggttttaggtactcccaatctaacaatagactactcgtgcagcagataaaaaggaaagtatgaagatgacacgcatgctatcaacagcggtcaggtggcttaggaggacctgtcgctcttggactggaatctgtagtacgattcattttggccttcgcaatgtcgacatagataactcggccgttcaatacctgttgcaagtttgcgttaatcaaatcaagtaggaaaaacagagtgtgcttctaacttctaaggccttgtttgcaagactgatattctacatgaacttgctaggaaagaaacaaccaacccttaaactggattttggggtttcctgtgaagttcatgtggtaatccaacattccaaacaaggcctaggctgaactaaaaatacactgtttcaaaaagcttgccttgccgttcatctcttcctttgctttattggcggcttcttcggaggcaaatttcacaaagccgaatccttttggtctgttggtcatcttatcggtgacaattgttgctgcatttgaacaagaacagtttccaacttactagtaatgacaagaagtataaaccaaagtgtgctctaggctcggctctggtaagttacaagtaaatgtaccttctagtacctggccatactgagagaaagcttctgccaggctatcctcggtcgcgaattgggacagccctgtaaaaggatagaaactcagggtgaatgcgtctctcgggcatttcgtcgaacactatgcatgcacaggcttgccgacttgccgagccgccaatcacacagatctgcacgcacgagagacggcgagcgagcaaagatctgcagcgctgtgatgacgccatggtggagatgttacacaagcggcatgcgcgagtcaggaaacgggaggagacggagacggggggtgaggtttacctccgatgaagagcctgtaggtgatgccccgggagtgcgtgaggaggaaggggcgcgcgtaggccgccggggactccctcctggagaccagacggcgggaggcctcacgcagcgccgccatcgccatggtcgcgccgggaataagctcttccagaagagagtgagcgcaggaagcacgcgatgagagtgtggaggggacactaggaaagttcggttttttcctcgacgcggtccacgcggaattcgtggttttgggggatttggacctgagcagaagacatactacaatttaaatgtgactttcactctgtgagtgattgtgttatgtgatgcattattctgcacttcctattgtgattgccacaatgagagatcaagatatgcacctcactttgtggcagtaagtacaaactttactcggttttgtgacgaagtgatctgggatgttagttgctaaaattttggattttatctattgttttagaaaaaaaaacacttggaagctcacttagagggatttttatattccgatatatttccgttcccatatccgcgtcattttgtattagctctgtttccgtatccgataatattcgattccatttttgaattcaggattttttttattgtgattcttaaaaagatttgaaaacgaaagcggtaaaggtggtttccatccatttctgagtcgttttcgccccttgaaaaacaacatattaccccaatctacgtagttctactggtaaataattcatacttgagtcatattaagtaaaaaccatcaaataaaacctatgaaaatcaaacataaaagttttttaaaaaaatattagatataggtatagtcataaaatacattatgtctaaatatcaagtctaaatttaacttcgtttgagtgtaaaaaaaaggatgaatagtatcagggtaatattcacatggaatttgtccctttttttcctcttggagatcggatttaagattttgtgtaaaataatttcaaaactataaccatctctgcatttttttttcatgaacttagagaaatttagatatagttttcatgggttttcaattaattggtggtttttattgcacgttttttcttggtaccaccagtcacccaactcaccacgcgaagctccatggccgcctttcctccccaactcgccgccgccgcggcgatcgcccccgactccgtcgacagaattggttggtgacctggtgcaccgtccctttgtaagtatctatctcgtcatggccttcgcatgctcctcccccccaccccggtgccttcggcgggaatagtcaataggtagggtttaacagtggcgccgattgacccgatcggagtttttttgctgccgattgtttgtttaagcctataatccaacttgctacgaagcttagtagctagcagtgctgctctaggttcaattaggagcgcttcgccggcagccacctctagcgccgtcctcgccacgcctcaatccgaccagggaatcccctgcaggctgacatgaccgcctagtgatgcgtttgatttgaggtatcgatgcaaacccctcccgacacaagcgtcccaacttcctaggaagtcaagaccggtgaggcggtgacatggtttttccatcattatggtcatattatgccagtttcagtttaaaaagaagttatattatgccaatccatttacccatattgaagcatacgatctgtgctattaagttgttccaaatatctttgaaatatgttgccatattgaaaatttgatcacttaaatgcagatagcatctgaggtatggagaaggattggctagaaagacatgggattcattacaataagcaagaggatgctatgtatgtcgacagcacaagaatgacccttgtgttgtttttgtccgtaaggcgttctatctgatgctcttcctcgtgtttttttaggggtaaaatcaggagctctgcctatttcatattaggagaagagagaaaaaaaacccagagtttttacaaactaggttacaaaatgatcccatgggatcccccttgaggagctcttcctcgtgttcgttgttgttgttctggctttcgggactccataggcagcaagttccctaataagagcacgtgctgcacctacatatagtatactgttactgattcttacgttaagtttttcattctttttgtctaatctagaagtaacttacatttgtgattctaaatattggcagtgatgcccacctctccagatcccaaagatgttcccttctgctataccattggcaagccagtattctttaccttcactgttgatggaacatggaacccctctcctgtttatgcttgtgtgggggtgtttagatggtgctaaaaattttttagcccatgtcacatcggatgtttggacgttaatttagagtattaaacatagactaataaaaaaactaatttcataaatgagagctaatccgcgagacgaattttttaagcctaattaatccataattatcaaaagtttactgtagcatcacactgtcaaaattatggcgtaattagactcaaaagattcgtctcgcgaattagtccaatattatgaaatggattttataattagtgtatatttaatactctaaattagtgttcaaacattcgatgtgacaggaccttaaaataagtctcgaaaaccacacagccccttagctcttcatatagcagtggggcttgcctgtcacatcttgagtgaggcattggtattatgcgcgcttccccacctctgctggtgctaagaacggtctatttggcgtttgagagtggtatattatcccagcgatatttgaacatctgctttgttttactaattttatctttttgctagcatggtcttatgaacatggggcttcgaccggagcttctggttgaaatcacctagtgagcaactggaaaattggtcctctctttaatggtaccaacgaatcttctctgaatcttatttcaaccaaaacagcaaatgcaggttaggccgagtttacttccaaactttttttttcaaacttccaacttttccatcacatcaaaactttcctacacatataaacttccaactttttcgtcacatcgttccaatttaaaccaaacttacaattttgacgtgaactaaacacacatataaatgcatcgttgattcctaacttctggtcagctaaggtagtactagcagcgaacagaagcctttgtatatgtacaggacaatgaagtgggttaccaaatttcaaatgcccggcaggtatcttagtatgcagcaagtcttaggcaaaatcttcaaatgaattaaccaaaaagacctgtgtgacacatggccagccagccagcctgaaataggtgcacaggtaccaggggtccaaatggactcaacaacaacagaaaccaattcaattttaccaagactagaccaaaagatacataggtcaagccagtttttacttagtagtttatccaatctatgggattactactgaattagagcctgattctagttagtttcgccctgttaggcacccccagaaaatgggttgaccaatgtgacgccgaattggtgcacattggagccatgctgctgatgtcaattactatagttctagcctgcacaagttaccttgttcctgaactcatgctagtagcagctccagtattggctcccaggactgtaaacacaccaaactagttataatattttcagaattgccttagaaatcattgacagttggttggtcattgacatcatccatcccgtcatattttccatgtgtaattggctgctaacagttggttggtcttgcagctgcaggcattgctgttgtagatcagggcatccaggatctaatggtgcgggcacctcaattgcagaatcagggcatcccctgctccaggcattaatcagcacagagtaaagacttcgcacgctaaaggcaagctttgacgtgcctacgaaactaccgatcactgatgatgaagaaagaaaagctgtttcttcctagttcttgatgataaggaccgtgtttttgttcatggtgatgcttgagactgttccaacagatgtgaacagaagttggcagctgctgtacgttttttgtcttaagcttttatccttggatttgtgcactgaagctgaatgcttctttttgttgggtgaatatgatgggttcaattttcatactgtaacaacgaaagaacccaaggatcagtgttggatagttgccgttcagttttgaggcatgataatgagtataaattgtggatacgttaatagtgctgatacactgtcagaccgtgatcttaaccttcttgtttttgtcgtgctgaagttttgttcaatggtatattttgttgggtgctcctattgaactcatttttttagtgtcattacctatgtatgacaagtgtatgacataagataaggctttacatgatgtatattacatattgatccatcttgtctttttttttaataaccatttaattggcatgtaataaacgggtggatatttgcccaaatgattagaatccatctcctcgagcatgaggtcattacagttcgtcggctgaaagagagaagagaggggaaggaagaagaaaaataaaggggtaatttggtcctaaaatgttagaaatacagtgaggggtacgtagtagcatatctcttatacctgtgaaattggaatagtataataccaaatagatgaacattaatgacatttttccaaacaatgaaatttataatgacatggttccaattaaccctattaattatcaatagatgttgcaagcaacaataagaaaacatttatcatcgattgctcgattgaatatatcctctatgtgtgattcttaagtacgtgaacaaactaaaaatagtttcaattttttcctaaaaaataattaaatatcttcataagcgggtcacgtgtcagcaagcaactggtaaagtgcatttttgctggcgggccatgtagcttaagtgcgccagcgaagatcattttcactggtgactgttataaggcaaccgccaacgataactatctttgttggcggctccattatgttatccgccagtgaaaatgtatcttcgctcatggtttgccaccgctagcgaaaatggtgcatcttcactggccttctcgttcagccgtcgcggcggccgaatcgacctcccatgacgactttcccgcagcacgcaatcttcgtggcattactattacaatcttttttttttttaaaaaaaagggaaaaaataatgtggctcacatgtcagccatttcttccttcttccctcctcccctctcttcctcctccaagcagcagcagttggttccacaattgtgaggaggtagggtgctgcagtagtgcgagctcgcgaaggccagtacggtgcttgtcaagcggaaatgctaatgggcgatcgctcgcctggtgatgggggtagcgatcaattcgccccccctccccctctttccctccacctggtttccttttttgacaccgcattactttcttattttagtaaatttatgcacctaaagtttatacacctcaagtttacacatctaaagtttagagacctaagtcaaaagtttatatatccgattcaaatttgaatttgaattcaaatatttttttacatatagtatttatatacacctaaagtttatagacataaagtttataagtcaaaagtttatatacccgtttcaaatttgaatttgaattatatctgattcaaatttgaatttgaattcaaatattttctgtatatagtatttctatacatctaaagtttatacacctaaagtttatagacccaaagtttataagtcaaaagtttatatacccgtttcaaatttgaatttgaattcaaatattaatttatagacccaaagtttataagtaaaaagtttacatacctgtttcaaatttgaatttaaattcaaatattagtttatagacccaaagtttataggtcaaaagtttacatacccgtttcaaatttgaatttgaattcaaatattagtttatagacccaaagtttataagcaaaaagtttacatacccgtttcaaatttgaatttgaattcaaatatttatggtgtagtaggaagagaagaaggggaggaggaaggggtagttaagggaagggcgggtggttgntggaagggaagggagngatcacncgcccaataggaataccccctggccaggggaagggttggggcagtttcctttggcggtagccagcaacggccaacacacactcctgctttgcagtgcagcctcgtggagttcgaaaataaggaccgcagagaagcacgtggcacatttttaatagctcacttatgtctaggatcctatatttatttcaattaataggagtatttgttatatatattgttccatctctaatcgattgtacctttgtattattttccaagtagttttttttacctttcttaatggaaggagctcgaaaacaagaaccgcggtgaagcacgtggcaaatttttaatagctcacttgcctctaggatcctatatttatttcaataaataggagtatttattatatatattgctccatcttctaatcgactgtacctttgttttattttccaagtagtttttttaccttttttagatggaaggaatactttagagctttgttgtactatatgtgattgtcttttcccattataatcatcgtggaagaattgtggagttatatatagttgttccgttattgaacaatgataaggctaagtacttttggtttactttctcattcatctatttcgtttttttgcgcgcacgttttcaaactactgaacaatattctttttacaaaaagatttatacgaaaattgcattaaaaattatattgatctatttttcaaaaaaagcttacacttaattaatcatatttgttaatgcatatatcattttatgtaagaggagggattttcaaagcatatcctaagaaatcaacgaagagatataactcaatattttttaaaacaataaattaatatttctattttttatcaatttataataatacaactagttgtacattttattttattagaaaaaaaagaactatattaatctataactatagttataagtagtatggcgtgtcctaataaaaataaaaatattcattaggaaaaaaattaaaaagtacttgactaaaataatacatctatttagttaagtaactcaatacatagtataaatctaaatatttagaataaagaaggttgaagctaattatttgtatatgagaaatactctttttttcgattacgagaaaaaaaaactaaattcgtttataaaaagttttcaaatttgttttcttaaagttttcgacggatagaagccttatcatatccgtttatgtttataaaagtttcccgacaaaaatcctaccgacacttctcatttctcaaaacatgtccggaattcatgaacttttcaaacttttttttgaactaggactaagagcccacatttctattatcagaaatgacatagtagaaaaaaaaagagaaaatgggaaactaaaagggtaggacaaaatagcaacgatggcctaagtaaacacaacaaacaaactacaccctaaaaatgcttttcttcatacctccagccttattgtgtagacccttcagccatgtcttaaactgaacaacaacatccttctttgatttgcttccattctatgcaaaaatagcccaacactcaatccagttatatgctagatatatcatctcaattggatcatttagtaaaatatgctcaaaacatgttttatttctggtattccaattggcctaaatgactgtagccacacccaccatcatcaaatatttatgtttttattgaaaccagaaagccagctcccaaacaactgattttttgctaagttaggtttcaaactcaaagcacaacaaaacacattgcaaataaatctagccaaataacagaagaaagtgttgcactgattgctcattgtaacagaattgacaccatttatctccttttttccaccctcttttgaataaactgtccttagtaaaaattttctttttaataacaagattatgaaacactctagtctttaaaggaattttgaatttccaaataaatttaaaggggaaatgtgtttgttgaatctgatctttagaggattttgaatttccaaataaattaaaaggggaaatgtgtttgttgaatcttaagagttttatataaagacttaactatgaaagactcatcaacgtaagattccacaagaccctaatagagctgccaacctgcagctgcatctgctcacacatagattttatcttatttattacaatctctcaacttctctccaagcaaagtatttctgaatttgattataccccaaccttcctttttaaccatggctactgaaactttttctttttgaaaattttgttatacaatgaaggaaattgtatattcagaggacggccaccaatccaactgtcttccaaaaaagggtgttttccccatttcctactttcaagtgcaaatttaaagaagacattttttatttccatcaagccctgcaaaaaataagagtctccaggtttaactgatactcctgagagggttttgtttttagctacttggctttaataagatcttgccaccaccattttcattttctaatttccataaccatttgcacaacaaagctatgttcgttgtttgcaaaattcagcaatcccagaccccttgatctttttgggaacaaacaacaagccattgcactaaataatttctacatccttgttcatcttgccataggaatctttttctaaaatagtatattttttctctagcccatgtgtcaatcggtaagaggagagcatatataaagggacattgctaaggcttgaattgataagaaattaagaatcaatcttcctccaattgattggagtctgtcttgctgtgttccattttattttcagcaacattccggtcactattaagcaatctttttttgatcaattggcactcccaagtatttcataagcaaatcacctactccctccgtcccataatataagggattttgaatttttgcttgcaatgtttgaccactcgtcttattcaaatttttttgaattcctatccattttatttgtgacttactttattatccatagtactttaagcacaacttttcgttttttatatntgcaaaaaaaatttgaataagangagtggtcaaacgttgcaatcaaaaactcaaaatcccttatactgtgggacggagtgagtactttacaagtgaaaatctagatgtaaagctcctgtttctcaactgcttctcctaggcagaaaacctcacttttattaaaatttattttcaaaccagagagctgctcaaacagacaaagaatgaattttagattttttttgcataattcaaattatcagacagcatgaaaatagtgtcatttgcatattgcaagatggccaccttttcattaccactgacagtcagaccttcagtcagattgttgtttttagctctctgtattaacgtagtgagtgcttcagctgccaaattgaatagcagaggggagagagggtcaccctgtctcagcccattatgattattaaagtaaggacctatctcatcattgactctcactgctacttttcctcctttaattactctcatgatccaatcacacaacatatcaggaaagccttttgcttcaagcattctatatataaacacccagtcctctttgtcataggccttctcaaaatctaccttaaaaatgatcccactttgctttttttgtgtgaagtattcaacacctcatgtagaatcacaatcccttccatgataaacctatttttgagaaaagcattctggttctttgaaatgatagaagccataaccctatccaatctattcatcaacacttttgtaatgattttgaaactaacattcagcaaacatattggtctaaatttttgtatttgagcagcgtctttagtaattatgacataatttagtctctcaatgtctagcacacctctatggaagtcattaaccagatccagtaaatcaccttttattaaatcccaaaatttaatataaaaatcaccaaggaaaccatcaggaccaggagccttattctgttttagctcaaaaactacctgtttcacttcttccagagtgaaacgttttattaacatttctgcatcttcttacctttgtgatcccctctaggtttaaaaacaagttattctgtttgggattaccaaagagctcattgtaaaagtgagtaatgtatgtcaaaagctcggcttgcccagtaatgataccttcctattgagataaagagtgaatcagaattttcctcttcctacattagctttggcatggtaatattaggtattacaatctccctccatgatttccctttctttgctcctctggaaccacttcgttttttcctccctaatagtgaatttcagctgcaattccaggctcttctatcttctctatctctacaactcaagccaacattttcagcttttaagtcaattgcatcaattttgttcaaaatttcagtttttctcctcctatattctccttaccaattcttattcaaaccttttaatttcctccttagatagctaagtctcttttgccatttttcaatgctattacctgaaaaggatttgttccaagcttcctgcaccaaagtccctagatcctctctcataaaccaactaaattcaaatctgagcatactctttcttttaa

SEQ ID NO: 51399 - DNA, 15426 bp, Oryza sativa
  unsure (1)..(15426): unsure at all n locations
cctccttgtccttcggtcttttgttcctcctcatctcctattcttgacttcctgtcacatcttcagtcaagtctatatctaatctcttggccaaaacttccttctgattcctgagaatccatataatcttcactgtctttcaaagaaactttctccttatcctcctcatccatctccaattctaggatcccctctgcaacttttctagatatgctgtctatctgatcatttatctgccctcctccaaataactgttcctgagaagactgtatcttgtccacctgaccaagcacctccccttcttcacttgaggatttctttgattcacaaacattcagctgtatcatagttgaatcttcatactgtaacttaaaagccaattctttgtctcttaatatttgtgaacactttatcttgtcttccaccaccatcatgtcaggcatcaatagacccccccttaggaacctctgtgcttggttcaccactgtacttgagatcaacatttccaatctgtcccccctcaatgactatctgctttccctccctctgattactcttttctggaaaatctgattgcatctatgttttcccctgtagatcatccaaaacctgatcactaaaccaaccttgttcagtgtaacgccctgattttcgttcgggaataaaaatcaattaataatacattttctagaaattaaataaaagttaaatcaacttaatcaagtgaattatagaggaaattaaaatttcctttaaaaattattggccgggaatattttgtaatattctttgtgccctaatgtactctccggaattttccgtgaattttcggagcttgagaaatagttttaatagcacaaagatcattgcatcaattaaaataaaaagaaaacaaataaaatcctccttcctctctttgggcccttttcggcccaagtcttccttccctcccacggcctgcgcgccccttttctctccctctcgggccagcctcctccctcggcccgctcggctctctctctccctcaagtctgctttacctccctcgcccgttttcccttctctctctccccgacaggtgggacccgaggccccacctgtcatcttcttccccaacctcccgtcgccccaaccgccgccatggccaccccgtgctccccacgtcgccgccttcctcgcgtggttccctctcccgcgcatgcgtggacgcggtcgccgcccacgtccgcgccgtttcccccacgccctgcgaaaaccgttgccatcccgagctccacttcgccaccccacgtcgccagccgatcccgcctctcccgggcacgatctccatccccgagccctatataaagcaccctcgtgctcccctctttcgtttcccactccatcccgagctccctgcgcttttccccgctctccccacgccggtccccattgccgccgctcgccagcgttctccagccgcgtgcctcagccaccaccgccgtctccgcgctgcgccgccgccaccgccagctttgccgccgcccgggcaagctcggccaccgctccatttcccctctccacctccgtagcgccgtagccacgcgaaccacctctctccgccgccgccgccgactccagccgcgtcgcgccgccgcttcggtcgacgctgacccgcgccgttgcctccctcagctccgcaaggacgaggaggacctcggtcgccgcccctctttgccggaaatccgccggagctcctccttcctcggtcgtcggtgagatccttctcatattgtcgcggtcggccgtcgttaccggtcaccccgcatcggtcctcccctcccgaactccctcttctccttctgaaggtcaagggcgaccccgtccgccctccgtcctcgcaagccgccatcgggcaatcgtcgtcgccgtcatcttcctccgcgccggccgccgcttccggtgaggacctctcctcccttcctttttttttcccgtccccctttcttgccgatctccgcctcttggggtgcgtcgccgtccccgtgcgcgccgctgtcctccggccgcccgccgccgttccacgtcgccggctgctgccgccggtggccgcatgccgccgccgccgcgccttggctcggccgggccggcttcgtgccgcgcctgtgcccctggctgccgctcccctcggccgcccgatcggctcaggtcgatctgggccgtccacgtggtggaggcgcacccgaggccacgtgtggaccatgtccaccgtgcgccctccccctttgactcgctgacgtgtggggcccgcatgtcggcgccggccgccccttgctgacgtcagcgaggtccttttcctttgtaaaaataaataataattgcgcaataattcgtgaataattctagaaattcatataaatggctcaaaacttctaaaattcatatctaattcattcgaactccgaattgagccattcaacttgcaaaattcatctaaaattgagctctacatgtttgtttactttttatatactgtttccttggtttttattagattttttcctcgttttgcgtgcctacgtgtagaatccgtcgtttcggaagatcacggtcgcaaggataggagttcggaagattgtttgaagaagcaaggcaagtcacacattccctttgagcatgttgatcccaatttacaaatgttttactgtttgcaaataaatatgcatgttttgctaatcacatggggtcagggttttacctatctgctcgcttgtgccatgtttacttgatatctgtcctttgtcaaccatgggtaataaatcgcctagcttgtgttactttgatgacttagctagaactatatgcttagccatgcttaattaccactagctcagttgatgggataattacagtattagacctttttagtatcagagtgagctgcgtgctcgagacatctggccatgcttcatggtcgtaattattcaactaaaatgcgactgaatggtgggctatgggtgcatggttttgctggtcgcacccatggcagttaaggaccggttcgcgagatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgagggtgaaacctgaggtgtggtgtgcttggctagagggggttatgcgaagggtcctgtcacggcctctttccggtatgtcgtggtggcatgtcggcgtacggaaacgtgtcgtggggctgtgtctcgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccacaaacccctccttgtatccccttgcacatctgcatcgttggagtaagagtaagagtccggtcaaaaaaaaaaagtaagaaagcgaggcaagcaatattttcatggatcctgcaccgcctacttatgtggttctcattcttcgccaccatcttcagcaagctcttcgtctacgtatgtaaaatgaagtagtgacttagattttatgtgttaataatattggtggtttgtgatattatatgtgtgaaagattagtttcttgttatgagatttcggagtataatagatgattggttttgtgaaataacggttgttgtttaccggccgggtgtggctggttagactgtgggttatgtggcagtcagaccggccagcgatgtaggatctcttattatgatcgagttttttgttgcaagatttaatttcatcctcatgtgaattcacgcgtgttttatggttttggtgcagcgaatctgatcattcatgtacttcacacgattctctagctagatatttgcattcactgaattagttgtatgtgcagaggaattcatggcaaccttatcttctgctgcttgcaaattaatccatgaacacttctaacgccaaaccgttgagaattctttagaattgtgcgctgggttagttcatcgatttcgctatgatgaagtggacgaatagggaaataggcacgatcagaaagtttgattttctgtttcatgttattctgacgaaatgtttttgaatctagctaaatgtttgcttagctttattgagcacaatgcattggattaacggggacgctactgagccttgattaagaatagtctgagttttggatcacgttaggagtttatttaggatcatcaatttttgacagtatagcttctgtaaccacaccttagaacataccgtatgagtatgtgatttgaaaccaattgtttcagcacataaacttgtagtatccattagaattatgacatgttgtcatgctgatcaacttgtttgatcatcaaaatagttctttttttttgttcatatctgtactgattatgctgtagctcacaatctttagtacttttccaagactgatcgttcgcacgtgcaatataagttcgtgtaccaaaacgagcattttacatgttcatgtactagattacattcacctaacaagttcgtgtaccaccgatgcaatttactctattatatacttaagcttaacagttccgacaaaagaaaactgtgaccaataattcatcatagtaatccattccggtggatgtaaaaataaattcatatcattccctgaactctgaatttctccgagatgtttcttttgtgcgcttgattgctttcatcttgttaaaccgcactgaaattcatgcacagtaacaatggtgttcaatgttcattgacaggctgatcccgtgcaacgtgtccgcggtgtacgaggaggacgagatctacaacgtcgaggaccagccgccggctatgaacgagtcgagcgtgcatgagtgggggaggagagccgcgacgccgaggcgacccgcatggccgagccgagcagttggagaagcaggtgctgaccttcaacaccgccgcccgcgcggaggggagcgcctcgtgctcgcgcacggcttgcggctgcggtccgacctcaccctcgccccacgcgcggcgcgcctcgatctgccgcgtccctttcgacctcgccgacttccgcaaccgctcgtcgtcgccggccaggacaagacgtcgggatcggattctccgccttcgtgcgcgcctactcgcacttcctgggcatccgcttcctcttcgccgcacaggacatggaggccgtcgcgatctagcaatggcagcggcggaggtcacgaaccgagcaaggagcaacgacatcgacaggacttcgccacgacgcgtagacacggagggcgcggggttctccagtatcttcagcgatgggtgaatccgtggatcccaggtagatgacgatgagcagcgcatccagggccaaatcgttcagcggccaaactcggcgcgcgacgcgagtcctaaacagaaccgaaccgaacctaagctacttccgatgctgactcccgtttcttcgattaatctactataagtatcgcacctgagaaccacctcctgcaatcagcaaccagtgaaaaatatcatacaatcgcttatttgtttatttttttgaaaagaatacaatcgtttataattattcgcttatccctttcacagcattgagagatttcaggaaaaataactcatggagcactccaagcaatccatccatgagctccaggaggacggtggtgcagattccggctccggctccaaggctgaagcgaagacagatttggtggcaggcgggaataagattcaagaagaaaacaatgatagcactgcgttttgccgggggtgtcgtcgccgcctcatccggttcgccatcttgaccatccggttcgttctcctagcggggttgcaccgcgaatatttagggatggtggccaagtatcgtggaactggttttggcctgtttttcacatgtcatgagtatgctctcattgctttcattattgtagttagctatatgggttactagtcgtcttgatccaattatgccgtttgtgtaagttctactttttttaacacagctcccttgtctctagaatcaaatatttacttcaataaatatccgtcgtatatattgttctatctgctaaaactgtcgatgtacttcctccgtcccaaaataagtgcagtcatagttttccgcgcccaactttgaccgttcgtcttatttgaaaattttttgaaaaaatttaaaaacataagtcacaagtaaagtactattcatgttttatcatctcataacaacaaaaatgctgattataaaaaaaatttaaataagacggacgatcaaagttagacgcggaaactcatggctacacttattatgggacggagatagtacaatcgtattgtttttcaagtagtatttctttcaactttttttcattggaaggtctatttataattacgttatattgtacgcggttgtcttttccaattatgataatcatggaagaattgcagagttgcacatgttgttccgttattggtgggtaggaacaattgcttaggaatttctcaaattgcgtgtatgcacttctatttccaaaataaaatttctaaggaaacaatttctcacaacatgttgagtcatcatgatacggagaaaagctcattcgaatccaaatactccatggaatccgaatccaaatgtgatactcgttgtcattgtttctattagcagcactcgtccatgatcgacctttgagaccgcacatcgatccggagctgactagggcaatcatctagtccctgatcactatacactgaatctcgggcctaccttctcctcttcatcatcggtgggagtgccgttgtgtctatcatcgtgctatcttgtccaattcaaccacattttagtgtgtatctctgtaaatagcaacttacacatgtattatgacgtcgcataatcccattgtcacttttcatatgagaaatgttgctcttgttacacgttatgacattacattgtcacttttcatatgagaaatgttgctcttgtcacacgtgcattataacgttacattgtcgcttacaaatgcatctcctcctccatgtgtggattgggtattttggtctataccaaaatatggtagaaaaaaagattcaaagtatatctgtggcatataaaatgacatgatccatacggttacaaatagataaatagtaataatattttttcgatacaaaaagacatgatcaaacgatgtctggctttggttctagtgattgtgtttttatcagtttcagtgtttcaaccaccatttcctcgatattgcattctaattcagaaactgttgttttcttcttgatgggattactcgttggctgaaatgttggatctttcttgcaagaaagatgtgtgctgccaaaaggctgccgattttgcaaagtgtgtcagaaaattttgtctgaatttattgtggtgtttgtttgtagcaacggtaatggtaaaagaaatgtacttgtattttatagtgtaaccggtgtgaattcattcggttcagattcagtagtgttgattggcactgctgcgttcaatttatttatttatttatttatttatttatttattttttggaaaagcgctgctgcgttcaaattcaggctcaggctcgaggaatgtgttcactgtatagaatacaaatggaaaatgctaaaaatggcaaatggttttgtgattcagtagatcaagcaaaactatttatatcggtattacatcacgcacaacattgagagaacttatgaaccactatattgagaaatcttatgaggcattcagaaacacgagcattatattgagaaacttgaattgagaagttttaatagatgatctcatgacttagaattacttcgttcaaatgaaatctcatggatggcttgacaaaaatacctacaaaacttctgctgtcaagtgcaaataaatttggttattagaattacgccactctccgtgcgtaaaactacaaatatactgttaagtgcaaataaatctggttattagaattacgccactctccgtgcgtacaactttgagatacacttaatagtgcaatgacaatgggtgtgtggttttattctgtattcaatctccaacatgttcataatttatttttaaaaaatgtttgaagtgacatctctccctctaaatctacaaaacccagtgttaattaactataaatactttcagttatgacgtccggctgtttagagggacatctctccctccaaatcttgtgttatttagctataataaatactttcagttatggcatctagctgagaccggagcctgcaggtaatactggcatactgctagaactcatgcgttaatccctcaacgtccacaacttccttcgcaacctttggttgcattatacaatgtttggtaatactggcatactgccagaactcatgcttgaatccctcgacgtcaacaacttccttcgcaacctttggttgcattatactccctccgttccataataggtgacgtttttgattttttatttgcaacgtttaaccattcgttttatttgaaaaattagtgcaaatataaaaaaagataagtcatatgtaaagtatttttgataataaagcaaatgacaaacaaaataaataataattctaaaaaattttgaataagacgaatgatcaaatattgacaaacataaactcgttttatttgaaaaattagtgcaaatataaaaaaaaataagtcatatgtaaagtaattttgataataaagcaaatgacaaacaaaataaataataattccaaaaaaaattgaataagacgaatgattaaacattgacaaacaaaaactcattttatttgaaaaattagtgtaaatataaaaaaagataagtcatatgtaaagtacttttgataataaagcaaatgacaaacaaaataaataataattccaaaaaaatttgaataagacgaatgatcaaacattgacaaacaaaaacttaaaaaactcaaaaaagcaagtaatataggacggaggtagtacaatgttttagggttttccgtgtagacatctgtggacaagtgccgacagccatgaaaacgccaggccacatatggaagaagtgaattttattttgttatcactccatacagtggaaagtatattgacatttcagctcatttaatccacgagtcttgccatccctctcctgtggcttatgcataactatttttatttcgattcgtcatagccggtgaaaggtacacagatcactcagcagcttttcctttcctgcgattgctaccacctgcagaggctccggtgcctcccatctccacaaggtagtagatcattgagtcgacgtcctcgccaaatatgctataggcttccatgacctggatgtagttgaagcccattgccaggaggagctgcatgctgcgggttagcacggtgtccgggagaacgaagcactcctcgccaactctatcggcagtcccagctgaccgagaagacccactaactgcagaataggaaatcatgatggtttcagcaaacctatcaaagtttctgtatgtggtctaccaggtagtccaatgccaagaatggtgggcttactcgcagcagaagaagatggctctgcccctgatgttgatgactctctgaagttaagttgttgttgctgctgctttagatactctgctcgtgaggcctccatcaccatccgctctatttccttctctgtcaactccaaatcagagtatagtcgtccttcagccagaagtgcctgatgttgccggcaagaaaagaattaagtatatttcggtttatactctaacaattcaaggtaaacctgattaatttgtgcagatgttgagatggcaagtaccccttgaaaacaattaccagtacttacattctcaatctgctgatcttgctgtgcttttattgcagccttcacctgatccctgtcaacgttatttgtctgtacagaaaggaaatgaagttcatttattaacaaagaataccagttggcaaacactcaactgtagaataggctataagggcaatgataaccatggaccaagacatacccctctaagggaactaaatcccaggcctgcccctactgtcagcccacgaggatcaaccaccgaattgtaatgattaccatgatggtaacttagcctaattggagggacatctgtattgtagcttccttgaaaaatgttaatgggctctgcagtaagagcaaacaatatgagactatgaaagagtttatgcaactacagagaagggttaaaatcctatagcaacatatgtgttacagttacctgtactataggaatatatgtgaatcggacgattgtacatctcagcaaatgcctggatctccatattgttcccatataccttgagaatcaagcatgtcaacataaattatttgcagtggaagaaggtaaggttctaaatttttccttgtcctaagtcctaattttattttgaagttgaaaaacaagcgctcagtatctacatgatagcattatttttaataaaaaaaagaaattctgaaagtcagggaaaatgcacagctgttgtgtggaagcataaatggttaaaaaaattaaatgcagacgttcattaagatctgcaaaacaagattcaaacagctgaaaaacatgctttccaggggcgcacatgctctatagtagattaaaataaaagacaagtcagctgactgaaaaacattagtttcataacattttcaaaaaaaaaatacgaggatgttcacaagcacagcacaacggttcgaagacactcagtgtaaggaaaagcagcaagcagttggaatatatcctaaacagccaggatctattgaatagcataccttatctcttctttttctcctacaatatgatgtaaaaccttccgtcatgaactgcgagaaatgatcacgttccctttcctggaagaattgataacaataatgagcatatcagccacttggtcaaaggggaagtcactgttacctcatagtctaaaatagatcaggtattcaggtttcaggaaactggggattacttcgggctttcgaggcaatatattccagaatacagaatgcccctttcaggaacagtgatttattgtggatgagatgtgtatacaatcaaaatcacatcagaaatttgaattatactccttgttctatgcacatggtgctaatgtgtcaagtaactcagacgacagggagtaattacgatttcaatgcatgcctaataccatgctgcaaactcaaattggtatgttcttccaaatgctttcaacttcttaaagaaaactcccaaatgcgtgaaatatacagaaaaagacactagaaaagcaatgtcctggtgattgcatagtagacaggagatgcattaaaaaaaatacagaaaccaaaacagaacactaggaaagaaaaaggtcctgctggcataaagacaggagcatccctcaaaacttctctctttttttccatgtgaaactgtgaaagtagatgactgggcaaaagacggtgaagaaaatcatgctgcaaacaaatagatccttgccaagaagtttatcagttcaacgataaacgatacagttgagtctggacttgaacttgaatcaaatgcttcattaacaatgaactaggcatggcttcacatttgttgcacacgatataattgtttaatatgtcatttcacaaaatatgtaagtcaaaaggtagaacagacagcacttttcccttggtaagttcattattaaattttaattcctgtataactagctgagtgctacctctaaggaaacagaacagcagaaaccaatatctaccctgaccagcaaaggagaagcaagttgcaactatgtttcaaccctaactaacagtagacgaaactgcaggctgtctcaaactagtaatgttccaccatctacccatattgcttccccaaacttatccaagatcttacagagccaataacttagtataaaatagtgagataaattatgcgacagggtagagaatgagaaatattaaccaaatattaatgttggcttatgaattgaacctagggacggaatacatataatatacggtgttactactcagatgcaacgacccaacataccatataatcaacacgcatctgcctagccctgccaatagtgaacaaataaggggcaaggttgaatgcaacagattaacatgttagaacactgcctccaagcttgtgaatctagtttatggattaatggcaaaggatatagatgtaacaataaacataccatgtaatcaacacacatctgcctagccatgtcataagcttctggatcaccataaacttgatctgcaactgctctaaacagacaattcccatcttcagccatcttattgatttcaaatcctctcactcgtcttaggtcatgttcaaacatgcgctccctttcctgaggaaatataaactacattagttgttgtcaaaaacaaaaaggtgcctgtttgcgaatgtgacaaacctaccattaacgataaaaggaataatgttattgtatcatgcaactacaaaggatccaaacttccaaaggatctatgacattatctccacatcctagacatcatcttcatgccatgcaatcattgacaaatggcaaagctgatataggaaatacgatattaaagttttcatataaaatagaagcagacaagagatcataccgaatcataataattagaggcgtaacaggggccctgctcatctgcactattatacccttcactatcagcaagtgatctaggtgaagaaggtcgggaacccgaagcagatgaccgaactgccactggtggccaagcaactggccttcttgaagatccaatccgtgcattgtttgagcttccagaccccattctccttaacccattattaccagacgatggtttcggtggtggggctggtggagctggtggaggtggtgggtgtgatgctgcaccagcaatctgtgatggaccaatacctgactgcactagattttcctgctcaaactgatcagaaaactggaggcctgttaattcctccaccaagaaagcaggatcgatcacactggagtcgtctttgggaggtttctccataacagccctctcctctgcagagcttgaactctctgatgtgggatcatctagccccaatggcttattactattactgctgttatcagcatcctccactagatggtcagttatattgtctgaagccgtgagctccgatggatgctgatgaggctgcggcggcagctcctcctcccgggcaaccgctgatgtcgcctgcagttgctgctgctgctgcagtgtctgtgaccccgagcggctggagctggacgaggagccggcagccccgcgctgcacgaagatcctcgtcatctcccactctcctcagagaaggctccacgtctacgcaccagcaaccctcctcgaatcagagggccacgagcgcgcccttatcgcgcgtgcggaccttgggggcggtgaatctggcgcctcctccgccgccgctgccaagggagctgctcctctcgtcgtcgccggcagccaatctgagcattccactgccaattctcatcagaaccagggcgacaccagtccctcctcgcactcggatcacaaaaccctagctccccgcgagatcgagacgcgcaggctagtccccttcggagagggcggcgagccacccttcccaaaaccctaaatcgcccgccaacccgatcgattcagcagaaaacaacaccgatttctctcccaggctctctctctctcgagggggtcgagcggattacctcgtcttgggggaatcgactggtaggcgcccttcgattcagcgagcgatgggggggcgcacgggttcggggccgacgcggcgatggggagattggagctagggtttatgtccaaatcgaaatcaacaaaaaattttggcttcgccgcgtgaattttttttctctcgctgttgttttggggattctgcttcgggtggatggagagagagagagaaagcagctgtatggtgaggtgaggtatcggaagaggacgaagacgatggagatggaagaaggggcgaagagaggttgggtgtgcaaaactttttatacgtggagggggagcgctaccaggcgatgacaagtggggcccacatggcagcgtccgttgggatggacggtacgtcgcgatgctgttggttttgcgtcgatggaaatccagtggcccgcgtttgtggcatttgcacgggatggttcgtcagctattgtctcgcagtttcatggcagtgattaattccagagaataatcggcgaagcttctttaatatttcttataaacacgaaacaaatgcagacgttcataatatgcgtacactcatagttataaaaacacaaacacatcttacccctatagaaacctctagaatattagactatcatatcttgattaattggcatgtgggataattgatttttttttgcaccggtcagaccggggggaccagggcatgtataccagtcagataggagtgatgatgaataatgttatcaagtgatgaacatggacatgtctgatggttgcggttagaccggctagggtaggccgatcagaccggagtatggcgagcggttgtaggataaggaggctgactagaggggggtgaataggcggtttttcaaacttttggctaaaaccgagtttcgtatgtggaagcgtaaatcaaaatggttttgcacaattcaaaacctaaatcaactagtctcaagtaaatgcacaaagaaactagcctatgttgaggtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51400 - DNA, 1058 bp, Oryza sativa
gccatgagagagagagagaaagagagaatgtgactgtgttgtagagagagaaggagaggaatcttcttgaggtctcgtctttggattccagcggcatgagcgtccaaaagcgccggctttggctcccatgggcccaacggtatcctgtgttcttctgctctctgttcatcctgtgagtacacactcacttaattactgctgcttaattactttgtctgctcaagctaatcctattcacttaattaatgccagtgtatattgcccacattctctgttggtgatcagtgtaggtgttttgttactgtcagacaaaagctttttttcattcactggggttaacaggtaacagccagctgtttttaacttgcaaaactgtggttagcttttctattgacaggcttcgtgctatttggcagctcatgataaatgtcaatcatttgtgtcactgtgttaattgcatgcattgtcagcatgctgtactgtttgttttcctgcacagctaattcctgattggcaattgcctgcctgccctagagggcatggcgatgaacattttcagagtttaatgttgctactgtttactgaaacccttcttgtactaccttgagatcttcttctcctttcatccatgcatgcttgccaagtgtctatcttatcttgtttgatcatctctagaaataaaaacaaaagagcaatatcaaattactacctatctctccaggaaagatgagagaaccccaaaaaatgcaggtgtcttttgtgtctgcatgaatatactagctagctgctgattggaagatgacagattcagattcctccaacgaccagcatgctcaacttacatagaaagatgtagtatcatccttaacaagcctaccagtagtagctatttcatttatggggctcgctgaacttcttgacattttcagtactgtctggcatctatgtcgatctcatactaatgctaatttccaagttgctgtcaggctaaaagcagctgatcatctcgaccttgttgccaagtgtttggacatcaaaattaaggcactgaaactttt

SEQ ID NO: 51401 - DNA, 1178 bp, Oryza sativa
ttttattaaaacataaaacatagtgcgaacaataatgtttatatatacatgtgcacgctttaatgctttatctctataatcatgtctgagagattaagtcgacgacacatagattatcacatgtgtttcattattgacgggtagttgcctactatttaaaaaataattagccgtaaatatgagcatatgtttaagtctggtacttgaacttgggttccactagaatctaactagagctacgccagtttgcaaactaaatcatgttatcacttgatcattagagtatcagactataatgatttcctgtgtggttgatcttagcctctagtaaacaggaccgatttgtttacagaagtcacaatatacagtttgaatgctttgtatcgtcgtcatcatcagtgaaggctacacgcctccaaacacaaaaacatggccacacacagagagacagagtgagacctcgcactcacactcacactcacactcacgacgaggcaggcagaaacagacgatgacctgagctagtgagagtgatgggtggggcccacacgggggagaaaaagaataggaatctagtcagccgtggggcccacgagaacgatggccacccattagagcacccacaatggtaaagtaaagtgctctctataaaacatgtacatctcagcaatatactagattaatagtaaaccatctcaatagtatgtctacatgggtatgtatagctctctaatggattgcctcgtttttctctagactatttccaggttagtgttagatcttatcatatcttatcattctctgtatggatatgcacggatgcatgttggttcggatagatagaggataggactctaatcccttgtaattaggatcaccgaaccaacacatctgcacgcatatatatctgtaaactcagcgcgtttttgcatatagtgaatcaacacgaaaccctgcgtccaccgtgacgctttcctgcatacacctgagttttatatggtatcagagcctcaaagtccggcgtgatggcaggttcctcgtcaagcactgcctccaccaatcctctctttggcgttcaagtttcagagaaactgaccaaaggaaactatgcgctctggtcggcgcaagtcctggccgcgatacgcggcgcccgtcttgatggccacatcaccggcgcc

SEQ ID NO: 51402 - DNA, 1004 bp, Oryza sativa
ctacaattcttaacatagtaaaggcatataaaaatatattgctgtaaatatatactattattgtatgccattctcataaatttattgtataatgcgctcccagagcggaacgttgataaccaaatattgaatcatactcatgcatttatatttttataaatccacccatataaccattgatcacatttatcaatggacgtgtctctcgtcaactctagttggaagtactcattatagtcatagtttcggcatcataaaaaacgacaccatcgtagccacagtgccatcatggccgtgtcacttttgttggaagtaccctttatggtcatatagtctcgatatcatagcaaatgacaacgccgtagccatagtgttgtcacgagttgtgtcaataagattgatataacctacaacgtggctatcttgttaactacacgcggcactactcatgttatcgtggcaagcatatgtaccacgtgttgccatcacgagtttctaaaatccgccgagagtccaccgcaaaattataaaatccacgctatctctagcagcacttactattatgataatgcagtgacagggttaattaattaatcattttatcatttgtgtggatgtgatgtagcattagtttcattcattcatctaaggggaaaaagttcacctccatgggtcagatcaacgtggttatttgtcaatgtgctagctagtgtatcaccacctaccaagcccataaacctatagcaagtgaaaatttcagtttaattgatttagttccctctttctgatgacaattaatcgtggccttatcatgttagcaatcatcatcagggatccaccatatatatagttgatgcttccattatggctagaaagtatgtttaattaaggccatgacttggagaatgacatcatgtttgaggcacccgcgctcgcttattgtcgtagctattaacatattagattatcacttcgtcatccagcgatttgccctaaatcaagtc

SEQ ID NO: 51403 - DNA, 1345 bp, Oryza sativa
tccaaaactaaaaaggatgaatagaaatgatgtcatgtcattcaagtactgagtagtgttggtgctatttagtgacatggtttaaaaatgattctttttatgctacattaaagtatattcggactcggacatacactctccatactaaaataagtttaattttatatataaatctagaagaacatgttaaaatatatccaaaatcatatcaacaatcattttatgtatatattaatgcaaacgatcgacaaataactacaaaattcaaagtataatcatacgaggggcgactacgcatattagagtgaacaaaaggcgatttggtgaggccaatctgccactctgcaggatctgagcccagccgtgcttaccatatatatgcaggctgggtgggcgtccgatatagtttaatgcggagtcatctccagatgtaagctaggagttgaaatagttgactacgtgaatttaccgttagtttcttttcaggaatgactatattacaccttccttgtacatctcatagaaaaagatgctcactgtagagtattgaattaaacaattttgtttttcattaattgattttatatactccatttgttcactagttcatgttgtttgggaatacatatacagcctgccgcatagtttgatcttggctcaatcttttccatcctcttaattagggttttgctttaattattccttttatgctcttagttttctacttttgaataaacattgaacaaaagcgttaagccgcatgaattaaatggatatatcaagtatagtcttgcgagtatatatatgcaagggagcatctttaatttagtacaccgttttcaacaaattattttaggcgtctagatatttcaaattttagaatgaaacaaagtactttggttcctcctataaaagaaatactttggttggaaggcacataccgagagcaatttgtgcaggtagagggaacttttggctgcactcgtctatcttgggaccgcctcctctaggctggtaacctgtgcgacatttgcagtgataatctcctacggtgtttctgcagtccccgtggcagggatattcatccgagcgagcgcactcatcaatatctgcatatatactgttcgattcaatggcgggtgtacaaataacttaatttgaatttttttaaaaaaaattgtattggtaaacagacatagatggcatgactagcgtgggatgcacaatagtgcaaactcaatactccctctatttcataatataacacattttgatttggtattataaatgttgctattttttttaaactaattttgtcaaacgtaagaaaagtttgactttgaaa

SEQ ID NO: 51404 - DNA, 945 bp, Oryza sativa
gaacatgaaagctgaggatgctttcaagagtacgtaacaatttatctggaattcactgagctgatcagctatacaccatcaggatcagaaagatatagctaattacaagtgattgacaatattatttggaattcttttattcagacctccaggtggcgatcaagtgcaagaacggcaatggtgagtacgagagcaaggccaccggaaagctcgacggtaccggcgtcttcagcatccccctcgacgccgacctccacagctccgactgcgtcgcacagctccatggcgcgaccaacgagccatgccccggacaagagccatccaagatcgtgccaatgtcagagggcacctttatcgccgtcgccggccagacccactacccatcagcgttgtgcgcatcggcgaccatctgcggtcccatcaagaagaagatcatagaccacttccacaagaagccggtgccacccaagccagagccaaaaccggagccacccaagcccaagcctgagccggagcacccattcctcgaccacatccacaagaaggagaagcacttcttcgatcacttccacaagaagcccgtgccgcccaagccagagcccaagccggagcccaagccagagcccaagccgagcctgcgcctgagtaccacaacccgagccctccggcgaagaattgatgaatatgatctgcattggatggacacagcatgtttgatcatgccgcagatgatgatcctgctcagcacaggagtgtaatttgtacttgattatcgggcatcagcagggatgtttgtactatttgcatatttttctctcccaaatgaaattatatatggtaaaataatttatttacatttagccagatttggtgggacgactgattattcaccatttagcattcaccttagcttgattcaagctactgggctcggccgaaagaaac

SEQ ID NO: 51405 - DNA, 1264 bp, Oryza sativa
aggtggacgttcactcgggtgattaaaatccttctccttgtatttgggccactccaacagaaattaggagtgtggtctcaaagaagccacactttttcgaattagggcggggggtggaggggggcggcgccagccaccctggcgccgcggcgccaggggcgggcccaggtttttcaacttgggtattcgaaattgtaagagaaaaaattttctaacccaaggtctaatagttgtataatatgtaacggtataagcatgattttataaagtcataaatagatagaattgaccataaattgaatgcgttaagcatattagagtacattactaaactattattgacaaaacaaatcaaatttatagagcacataaaatggcaaaatgataaaaaaaatcttacaatttagagagaacttttcgtttcttgatattttgaaaatgattgatcatgtcttcattcttaacttgcaagaagaaatctctttcaatgaatgtaaccaagcaatcattcaaatattctggccccatcttgcttcttgcaatcattcaaataatcaatacacttcagttcagtctgaagaagcattcaaacaataatatcctcattagtcattcaagcattgaagcaatatcctcattcaagcattcaagcaatatcctcaatcctcataattcattaatcgatatcctagtatttcctcaccggctcaccgactcaccgttgctcggttgctgtcttgctgactgctgtcgaggatgggaggagacaagttgggcagctccgcagctgggcaagagccaggaggcgtcgaggcggcgtcggcgggcgggcggtgggccgcgccgccgcgggcgacggccgaagccgggctggcgccgtggcgcggcgacggtgcgtgcgtcggcctagcgagctggcggcggctggcgtggcggctgggaatgggaaggggatgggaagggaggtgaggagaagagatagggttagaaaggaagtgggcttttctttgctattgggccaatgggcctgaaatgctgggtggtgggagggttcagtttgggcttcttttgatttttgaatgggtataagtattttttttcttttttcctatatatacatatggaatatatacttcatatatgtattttttgtgcaaaaattttgggtattcatttgaatacccatgaattgaagtgggcccgccactgtgcggcgccagccgtcggccggaggaagaaggtgggggggagaagggtgtggagg

SEQ ID NO: 51406 - DNA, 739 bp, Oryza sativa
ccagtgtacttttggaagacgattactcgaaggagtagggtcataactgctgtcaaggatgtccgcggagtggagtccccacgctgcgagcatcaagttatatagtttagctcactttaattttccgctacatatataagacttttaataatacttgtaagacgtgaatctgtgtatcaactttgtcatttgtgtaccttggccggtcatggacagggtttttatgcacattccgctttgggaattctggttcgtgaatttctaggcgtgacagtaggaaggctgctatttctgaaattttgatgaacaatgtgattcgacttgaattctatattgtttcatcaaattctgtggctccaagttgacgctttgttttgatgcatgttcatactcatctgttggatcagcaatgaaccttacttattcttctcccaaacagttcgactgtaggggaatatatatttcactggtacttttggataactcaaatttactggtgcattacagtcaagtttgtcaagcagactgaaataagggaggaaaaggttatactccatctgtttcaaaatatagtaacgggatacttgattagacaccagctagtactaggctactatattttgatgcctaatcgtatgaatgtgtatatacaaatgcgaactaaaattcgaaatgattttttattttgtttgcacctaaaaatcaaaaactggagattcatttttattggcaactctaa

SEQ ID NO: 51407 - DNA, 2284 bp, Oryza sativa
tcgtcgggttcgcaagcccgcgggccacgcggtccaccccttccccatccaattccgccgtaggagtccgctttccaccgcgcgccggtgagctcgccatggccgcggccttcggccggcgattttgcccgcctcgctctccctcactaatctctctcggttgtttccctaggttgccccggagcccgtccaactgtcgctgtcgttttccatcactcgccgtcgtcgatcgtcatcagtgagacccctccccttttcccctctctcctgcgccgcctagccacgtcgccaccgtcggccgctcgccgccggtcgcggcctcgcgccgccgccgctagcgccgcgccgccgctcgccaggaccgctgggctggcttaagccgctcgcgcatgctctcggccatgcgccgccttcgccgtcagatctactcgtgttctttttatagtaaaaacatagtgaatcttctaaatatcatagaaaattcatccgtgctccgtttaagcccattcaagtctcagtaaatcaagaaaatgcaaagaatccattaaaaatggttttgttctctgtttcagtagtgttatagcctatttgcattgtttgctttgtatgtcgcatagattccggctctcccgacgctctggtgtacttcgaaatagtgtcgaggttcctccagccgcagagcaaggcaagtcatgcttgtcacttgaacatattgatcccatattgcaaatgctctattattttcctttaaatattgcatcgttttataatgttacaatgggatgattacctactgtctcagccatatcatttgttatcctgttgctttgctagtttgggttgtaacatgactagatgttggattagggaatgcttagccattcttagttcaactagtacacaatgggggaattacgttaatgcatagactccagatgttggattagtgccactgctgtggtgttggttaattaaaatatattaaatggtgggctgtgggtgcatggttttgatggtagcgcccatagcaattaaggaccggttcgcgggaaaccctggaagaattcctcgtacttaccacaagccagcataggcaacggctgggcttgtagtgtagcttccctctagctgacgcatccaggcaagggtgggcgtgatggagttcggatgggccctgcgacggcctatgccgctttcggattcacttaggcacgagaagggactgcccgctgccttgcgaggactgggggtgaaacctgaggtgtggtgtgcttgattagatggggttatgcgaagggtcctatcacggcctccttccggtatgtcgtggtggcatgtcgacgcacgggaacgtgtcgtggggctgtgtcttgtgggtacagttgcacacctctgatcagagtaaaactattcgaatagccgtgcccgcggttatgggcggtcaaccagattcaccgtgattagtctcaccctagattagtttaatggaactgattagttcaggtggtggtttgggcatgtctcaacgtggtgtagcgttgagcagtggttggtttaatattggctaattattacaactgttttactgctttcaattactgtttataaatgctagctttatacaaatgaactcttttagctgtcctttggttataccttgcatcataccctccattccggtaggacttgctgagtacagtgggtagttcttgctctatctcccaaccctcagagttcaagtatgcgtccgatggtggtttctccgaggagtagacttcgtccgtgccgtcgaggatgcctgtggagtggtgttcccgctgcaaaccaagtcaaggcttagctccagttatcttttattttccgctgcatttatgtaagacttttataatgtttgtaaaacgtggatctgtatatcaactttgtcgtttgtgtaccctggccggtcctgaacagggttttaatgtacattctgcttgaaattctattcgggaatttctgggcgtgacacgccgcctccatgcatcttcatgtgtgatttcctttgccttccacggagggagggcggcccgaggggtgcagactcggcggcggtgtgttaaccttcggctgcttgcctttgatgagatggcgacaggaagaggctgacggcaaaggccgccgtggagcaccggtggttggttcacggggaggcgcctcgccgacttcagattcacaattttttcacattcttttgaaaaaaatcaaaaccaactttaaatgtcaaacgagacgatgtaaatgtttg

SEQ ID NO: 51408 - DNA, 878 bp, Oryza sativa
acattctgctgtctttgccgattatcaggtgttctcaacccagttggtatcagctgcaccatctgctgctgaatcggctgaaccgtttgttgttgaatcggcgaaaccgtctactgttgaatcggctgaactgtctgctgttgagtcggcgtcgacaacactggtccggcagttggctgagttggtaggaacattgaggcaatctagtcttgggacagccgactaatattctgaccagcatgttgcggttgctctctagaaaagagacgaggattaattgtctgcctttgcaccgatgatggcgcagctggtgccggagtcgaagctgctgccgtcgactgaactggtggtgcattggaagtactctgttggttacctatcaccaagttcctgtaatttgggaagacaccacttggcaagtagactggccctgtgttctgatgttcagctatcgtgccaaccatcacagatttgaacatatttgttagtgtattgacgatctctccagattggttgatcaaggcatgttgcaccgcataatcaacttggtcatggaaattggtgcacctaggaggttcttcttgcacttcagcaccatcttcgccaagatcttcaaccacaccatcctgaagcccgtcacctttgtcacccaaggcatctacaacacatttaccaccttgagatgagcttgagccaacttcatcagcagcaaccactttcagcttgtatttctgaacaattatcccttggcgggtttccttgaatgagttcatgaacttgtcctttacgctactcatcatctgttcaagctcatgcctctgttcggacgtcagtttgtctagtgtgattggaataatgtttgtctcattgacctcaga

SEQ ID NO: 51409 - DNA, 6926 bp, Oryza sativa
tatttaaaaaagtcaatgtcgttaaatatttaaaagcggatggagtatatatcttcccgaattaattgctagctagcacaagtagtactatgtattaattaagtcaacttgaattatttgctaattatgtttattgctgtacatgagttgtctacagtataattcttagtgataatgacgtggaaatatagagacaatatctaactttacaacatgatatagtagtaaactgtttaaaactgtacatctctacttctgtcaatgtttaagcatagtcctcctcctatcctctcccctatcatgcgtgtgggcatggtctcgctccttcgcgtttacctaaccatcttaggatccatttttctcaattcattaaaataacaaatttctaatgatattatatggtccgatcagttggaaagcacgaacgtgttagtatttggaagagagcgcccgacagatgtatccatgcaaccaataatccacttctgcatgaaccaaccaagaattgctgcgtattggcagcttgcaatgaatggcattgaagcaggagaaggagttgctatcaaaatttgcattgtgttgccttaatcagattgtcgcctttcaccatgaatttaatagccatatatatatatatatatatatatatatatatatatatatatatataggtccagattatatatgcagaaaagcaaaagcacatgcagcctcgtgttaggtgaatatatatataaggccccgaacagattgatgaaacagcaaaaccaagtcaggatcaactaattataaatgtttttagggggctgtttatctttaattgagcaatgaaccgatatgtataattatatagagaatggtcccatggattggctgtgacaagcgaattgatggagcagatgcatcatatcgttgccattaattaaaggagccatctggattctgaacaaacacaatattgttaaaaaaaaaattggttgatttgtttatggtttgtagtttgatttcatttgttttagggtgtctttagatcagattttatgccctttttttacagaactaaatctgatttttcctaaaagtccttatatacttcttaattgctccacatgcccttgttgttcaatggacccaaatgactttgtcatgtcagagtgcatgcaagtctaatttgatcagtttagatccattaaagaaaacacagaacgaatacgatttagtaaaaatcatatctgaatcatgctgaatcttaccaaaagctccctgcaacaatgacgtcgatctcctgtttgtgtacgaggtgatctacaaaaccaaactgggatcagtagcctctcataaattaggccaaaacaggttctgcctcccaaatccatggtaacaaaatgtattaaacagaacagaagatcaggaaataccaagataagacagaagccattatgtcactatccaccagtgtgtcatcacatttgaggtaaatagataaaaagaaataaagaaacaaacagacaaggggaaagaacaaagtccaggtatactagacacaaaataactgatgaataaactcagatgacatagactgggttcgacttaataccataaaacaaattgaggcaacgtagtacttaaaatcctggaagtacttaaaatcctggaaccaggacaattggaaaatattagcaggttaataccataaaaaaactgaagcaaataacaaccatgtagtacatctggaaccaaatcaattggaaaatactctctgtttcacattatactccctccgtcccagaatataacaacctagtaccgaataggatgtatcctactactacgaatctagattcatagtactaggataccgtcccatccggttctaggttgctatattctaggactgggggagtaaaacattttggcatctccattccttttttcagtggcggacctacggtaggacatgggggtacagttgtacccccaatttttttttaacaatctactgttatttaacaagtataatattgtctgatagttcaaaacacctattcttacgcacaaaatcatgctttccaatagtattataatttttttcttagttatttttttattttctataataatcatttttatttgcactagtaatccatgttagcacttcatttttttctcactggacgatgcttttgtaggtctgtacccccacaatcgaaatcatgcgtccgccactatcttttttagatttactaacatactatataaatttgaacaaatatatgaaacacatacatggattcatgtacgaatctattaaaaaccaaaacatcttatagcgtgaaacagatgaggtattaactagttaatctcaaatttattagtatctcgatgatgatatttcacatggaccgatggactacatcaccggaatacaagagcaaagaacctgcatttgatgtttatgcaactttgttgaaagatactccctccgtttcacaatataagtcattttaacatttcccacattcatagtgatattaatgaatctagacatatatatctatctagattcattaataccaatatgaatgtgaaaaatgctaaaatgacttacattgtgaaacgaaggaagtaataaactgccaattcctgcacaggaactgtcagtaccaaacaaaaatggcatactaattaatttgccagggcagaagttttgaaacataaactggaaaaaaaaaacttaatcatttcatcatcgttcgataaggcacctaagaaggataagttatagaccatcaccaggaaagactaacaacacaagcgtataatgaggcacaaaaaaatggtagacaaccaaaaagaacataaggaataggtgctctgcaaattacagaccactaccatgaaatgatagacactagcaagtaaaatatcgaagaactgaaaagggcaatttgtttcttcgactacttaaggctaacagtacttccatctatggtcatgtattagcatatgccaaaaaaaaaaaaagcaccagagaatcctaagacaaagttacaaaagaattattcaaaattggggaggttggacaagttaaggatgctgacagtgagccacaagcaagcccacaagggagcacaaataagagtgacagtggtggccaaatgggccgcactgcacggacacggcccactcagacgtcaacccgagtaaaaatacttccctctcaaagaaacaaaagagtaaaatactcgttcatcttggcgcgcgaccaagaaagcagaattcgccgtcttcgtgcctctgtttggttaggttagaattggaggactgaacaaggtagtcagtctgtgtgtaactttgcactgatgattagtcagagtcttgttgttggctttagtcccacatcggtatttgatgacgggggagcacgacttaaaaggtgggggtggtcttcacccatcaaactagtcttttgggttgtgtaggctaaaaacctaaagttgtggagcaggtccaatgtaacctgggtggcccacggttggtgggtcaggcctacgcactctaacacttgtgttaggactgatgtactctgtgatcttatattcttctgattattcattacaatcgtatttatatttatgtaatgctattcaatttgtacataacaattcaaggcctacaaattatcagctttatcagcttgttgaatcttgtttcatgactgcttgttttttcatcttcagaaaagggactagttttgtagtttgtggattctgtccttgatctttcagtacataggagtgttaaaatgaaaaacatagtgacctccaaaagaagggaaaatgacgagtagaagacatgtatttgggtagttccataatgcacacagtagaaatcatttgtcagaatcagtgttttggcagaaaaggtagaagaacgcagagtactctgcattttgtaatataggcattggactagcatagaatattagaatcgatagtctcaggattggtgattgcattagtacattggaattgcaatcaggggaatcttattcttctgtttattcattgcaagcataggcagctgcgcagtgggcacagagcgaactattctttcgccttttactaaagaataccgtgtgctcgctgcaaatagcagcattgcaagcatacttgtgtagtattaagcatgctcaaataaatttgaaacaaattcaaggccatgtttgtttcattaattattagcatgttgagtccggcctcatcctcatgtgcttgcttgttaatcttcaatcgaagtactggttcagtagttatggattgtgtcctttcatcctcccttcagtttgtgagcatatagcaggaaaaaacttatgttcaaaataaaaaggaagaaaggaaaaacagaggggaattaaaggataggattattggtttgtcatgcaaacattcagagggaaacgttgacaaagaaataaaaagaacagtgtgacctatgtatatgaactagtatatgggttgtttcagccaataggttccatttgtcagaatagagtttttttgctgatcggcgagttgcttgaggtcctgccggagcaaacaagtcgacagttcaataaataatggtttcgtcagtgttggtttgtgagtcttcagcaaaacaagtattcagttagagaaaagaaagtctatgtcaataaggctggaattgatagttctgaagtcctgatcatagccgaattcatttgttggaacaggaattttgatataaataatactataatacaaaaaagaaaagtttgataaacctcgtttgttatatctagtctttttgtctgtcaaggtatagaaaatgtttgatttttgttctgaaggggaggatctctaatatattcagtcagtggtcagtgccaactctgataaataattgatgccattacttggagaaaaccttgtgaggattgtaagaaaccgagggaaaagaacattaaaactaaccagtcaaaataactgtgctgacaacaatcttcacttgatgacttcagtcatgtttttttactaattttattgaaggagaacaaccttttctttggggatccaatggtgtttttccacggtagtttctcacatgtgcttggttttagtcacccgcataacatctaaatcagtgtaacttttaggtgtgtcttctgtcatatagacttgcaaaaaacttcttaagaaaaaggcctgcttttattcatagcagtactaagagagtgctcttcatcctggctatgtaattgggaaccttttgaaattgtagcaaccctttgtccctctgtctaactgaaatagaggtccatgtccctgcaaatatgcattactgtacagcaatctggaaattagcacaggctgaaactggacagttcccaattgaagcccgtgctttatttgatatatttgcctacctatttatcatatatcttagttaatctaagtcgattatttaaatttacttatatcggtcagatcttttctagggttttgccagtatcggctaaattgttttgtcgatctagattagctattgtatctaccacccagaaaatcagtcaaagaattgatattatgtttcttttcatacttagtgctgcatcaattgggtttgacctactaagtcatgcttataactataatctctagcttgctttttgatgccaataagggtttcatcagggtttcaactgatgagttatctaggcgttgcttcggctcataaggattatatacaagttggatttagccgatgacaacaaaattttcattgattatcaaatcgtttggatttaatgacatcggagctccagtcgatgtatgttttaacctttggatcagagcttattccattatatcattattagccgattggtttctaccggtttacatcgttgtcttattatattatcattagccggctgtttttatataattatttactcaagtatcagaatatgcattggatatgtagccgacagttcaaaaccctatcaacatcggctggtatcgccccatcggcttgtcagccaagcgactctttagtgatcaacatatttatctatcttgtcagttgcaggatcaaactggctggcatgcccgcatatcatcaatatttaggacctgcactagagctaagcagatctcctaggccattgtgttcgtcgacttagttcgcgctaacacagatcagataccatcggccaagcgcggatttttttgtcaacaagacggaggagaaggtattgaccaagattgtaatggagatggatgtggcggtggagaccgtagttgcggaggagacagtggagatggtggagtccgaggattctcaagctacagcggtgggaatggatgccgctgctcacctgggaaacacgatgtagcgcttgcaccataatatgatggcgtgggatatctctcctagatttgtctacccatctcctatagggatgtccagctcaagatcgtcaaatccttagcagacccactccacctcgatctttgagtatcgaggtggatcgcgtcttgctggacttgtatggctatgccctccgccatcttcacgagaaacgaggttagttagtaacatatgcaccaattttcgcaagctacaaagcaggatgtgcaaactatgagcataccttgattgataggtccttgaagggaatatgcagctaacatggtgtctgttgcgtgatttcatccacggggcatggatttttcaatgatccctcagtttagggatttttcaaaatttggtgttagatccttcaggatatatctgttgtacaaatctttcttgaagcagttgagttgttgggccatcttttttagagtccaatcctttactttgttctgttctacttgagggatcgtgaagatctcgag

SEQ ID NO: 51410 - DNA, 2705 bp, Oryza sativa
attaaggagatctttgaaattcatggagaggtcacaaaagtcgttttaccgcctgctaaggctgggaataagagagattttgggtttgttcattttgctgaaagatcaagtgcattgaaggcagttaaaggaagcgaaaagtatgaaattgatggtaatgttttctccatgttgttatcctttatcattatttattaaacttgatcttaatctaggtaggtgctttgtgtggaaagcagatgtgatttgatcatttgctgcaatgattttatgggacctttgcagttaccaccactactctgtatattagtaacttcgaaatatggttgattagaaataatcttgtgctaactgaatcacagggcaagtgctggaagtatccatggccaagccattgggagacaagaagcctgatcactcgttcaagcctggaggagctccaaattttcctcttcctccttatggtggctacatgggagatccatatggtgcttatggtggtggtggtcctggattcaaccaggtaaaccaaactaaaccaagtggtgcttatggtagggttggtcctagtatacctaaataccaaacacattctgcgagaaaatccacatataaataggtataatacatatgtataatcttgttgggtcaaatgcttcgttctctggctctttttgtccatccactaaaccctcagtccacaaaatgacccattcttgagcatcgccacttcagctacagtctgcctataaggcccagtggcccacaatgcccaacaccaaaccctagttaaccaatatccagcatctctattcctcaattccccatttccagctacccagctggcagcatgggtgcacggtcacccaggcatggcatggttactgcggtcccaagtgccaaagctgacaggtgcccagggtggcagaacgtcgcatttgccaggaggagcagctgagcaagtagtgtgcctgttgcgcactagttgatctctggatcctgtacaaggacatgcaggtagatggaggagctagcatgtgcgtcttgattctaaatcctaatcttctctgtaatatgtgcatcttgattcgaaattcgaagtttctttgttgatacgtaaatgtgaaatcaaagtatggtacattgtttttttatggaaaactgtggactgtagacaccaaaacaaaaatagaaagatctgtaaccacatcagggcatgttgtaagaacactaacattgacctgtgacggtgtatcaaagcaatccaatagactgttcacttcacatgctcccttgatttgtatgtagatgatgaagttcttagtgttgtctaatgatgataaagcatcatattctgaagttgtgaaaaatgccttgagtctgttgaagattagtcaacatatattgatagtctgttaatgttcttttatacatggatcatgatttttttgcatgaactttccatttagttattagatactacctccgtcccaaaatatatctatttatagcatagtatcttgtcccaaaatgaagctatttctccacctacctcctctcaactaattaatatcattctccttcacccactttcttttttcaatctatcacaaccttcctccaatcattcccatctactttttattacttgtgccaacctaaaaaagcgcacatatgagctgtttgttaattgtggggctaaattatactccctccatcccaaattatagggcgccgctgccccctttttaaggaaaatcaaacttggttgcttttgactaataatcatactaaccatatctatactaagtattatgcatgttatatcactagatttatattttgaagtacttctatgtgatgctaatttcatatttgttgggatcatagaatggaataaaatactagtcaaagtatattattgaagacggtgtaaaaaaaatatagccttataatttgggacagagggagtagttttctttaacgattttgtaacacctttaaattaaattgcattgtcatctattgtacattgattttggtagttcatatactgtccttttccatgaaatatgctttaagtaactctgaatacccatgctagaaatcttgcatccaccactgcatattgacaatttagtcattgtctctatcaacatttttgttacagcctatgatatatggtagaggaccagcaccagctggaatgaggatggtaccaatggtgctccctgacggtcgtctgggatatgttctgtaagataatgctgtcctagagtcacaactcacaaacaagtcttaccatacatcttcatttcctaacagttctgtttgtaatgtcttgacaggcaacaaccaggtggaatccctcctccgcccccaccgcgtcggggtgaccggagggatggtggcagcagaggtggcgaagggagtcatggccggcgatatcgcccttactagctttttcgttcccttggtcctgccgccatccagccatcacgcaatgtgatggatttcttaacctaaagaaacaagatagaagcttgtaaccctgttccagcataacacctgcaattgcgcaagacatgtaccgtcttcttttttcagttatatttatctgtcatgcatgtggtgcttgtgacttgaaaacagtgtcttgaagctttgtatctcgcggtggcgtctgtagtggtaaaccgatggaa

SEQ ID NO: 51411 - DNA, 5295 bp, Oryza sativa
  unsure (1)..(5295): unsure at all n locations
gattgagagctctctctataggtgccggttgtttcaaacggcacctgctaagcggcactgatgaaaccccaagtcattgatgtaagtttcacaaccgacatctttgatgtgcacgcgaggcaaaagaaaaatagcttgatgcattagattgattcgactcgatgctttgagctcataactgaatccgaaatcatcacaaatttaattcaaaaactaaatcctaatccaatcgaaaatcacatgatcattccaaaataaatcacaagacaagagacaatccaatcagaaatcacaaaataaatcacacatgagatgagaggagaggcgaaaattacaaaataaatctcacaggagatgagaggagagggacgggcgagcgggaggccactgccgctcctagccgaaccccctcctttcctcctcgctgctgtggaggtcctgagctcgggggccaaatcccgcaccgcggggttgccggtaaccagccacagcgccacgaagatgctgagagggagatggagaacgaagacgacgacggcaaggccgaggaggcatggcggagacaggtgggaggatgtagcgggtaggggtggtaatgaggaggtaggcgtgcggcgacagtaggggcgggtgtgagtgaggcggcgggagcaagtgtggaggaagagggaggaggaggaggangagacngaaaaggaggtgtggtgataaggatgactagacaagggagcagataaagtggttggggggcccgtttttctataggtgtaaatttaaaaaaataacaacacgtatattagtgcgtgtactgtaaattgagacctataatatattatagtgtcgggttctttaaaaaatcggcactaacaatatagtggcatgtttttatttaaaatcgacatctatctctccacaaaggtatttgttctagccgatggcgctatgccgaccagccttgggtgagaaaaacattattgatgtcgggtttagtattttctgtatatatagtctgtatatatagtgctgttatttttttttgcatttcggtagtagtgggccttttggccacctatgataccaggaatactagtttttttgaagagagattaggctgcattcgggagtgctagttcccaacccttctcacccgtttttcatgcgcacgcttttcaaactgctaaatggtgtattttttgcgaaaaatttctatacgaaagttgcttaaaaaatcatattaatccacttttaaaaaaattagcaaatacttaattaatcatgtaataataggtggttcgttttgcgtgccgggtcctccgaacacagtcccttgagcgactacaatcgagtactgtttgaacacatcagtaagatcgaaagtcagatccttacccgcttttctctcctggtcaacactttatttctaaaattaattctcaagtggatttttgttcagatttttttttcataccggtattcacgttaaactcctgtcctacaatttaacaacggacctacttttattgccttttttctattaatttttgacccctttgccttgaacaaggcaccaccttcaagcaaatgaaggatgttagaaggtagtggaagcaagaggaaggtagtggaggtcaggttgcacgctaagactgtgttcgggaggcacgtaaaacgacctatacattatgattagtaaagtattagctaaataaaaattgaaaaatagattaatatgtttttcaaaaacaacttttctatattttttcaaacaacacatcgtttagcaatttggaatatgtgcacgtagaaaacaagggaggtgaagttgggaaagtaaacttataccttgtttagttccatttttttttctaaaaacgtcacatcaaatctttggacatatgtatggagtattaaatatagataaaaaatcaattgcacagtttgcatggaaagtgagatgaatcttttgaggctaattagtctatgattagccataagtgctacagtaactcacatgtgctaatgacggataaattaggcataataattcgtctcgtggttaccaggcgagttataaaattagttttttcattcgtgtcaaaaaaaaccccttccgacatccggtcaaacgtccgatgtgacacccaaaaattttctttttgcgaactaaagacacccttaagaacgcaacatatgttggaggttgagaagtataaaaaagtgcctaaggtagtaaggggtctaattgaaagtataggatagaataaagaggtccaatgggaagccttggtaaataaatgtgtcctatatcttaaaactgcaattcgttcttattttttaaaattataatttcaaaattaattccttttcccatcaataagtacttactatgcaaattgcagtctgcacccgttcactagactggaggtaggaatgacgtacatatatacattgagaaatattaggaatttaactttgaagggaagaagcatatgtatatggatataaataaacgagagatttgcaaaatatatcaagtcacttgtttttgtatatcaggcaaatatattacccggctttgtaaaaagcccagaagaaaacaggttcttacagagtcttacaaaagtaaacagctaaaacagggtaacaaaaggctttgcgacacactggggacatccagctttctatgaaaggtgcagaccatcaaaaagtactaaaagccccctcactaaccacatcatgtatatacacaactgggacagaaaacgacacaaagggcctgtttatttggaaaaatattttacccttgcacgtcacattggatatacggtatttgaagtattaaatgcagtctaataataaaataaattatagattccgtcaggaaactgcgagccgaatttattaagcctaattaatccgtctttagtaaatgtttactttagcaccacattatcaaataatgacgcaattaggcttaaaagattcatatcgcaatttcctggtgaactgggtgattgtatttttttttacatttaatactttatgtatgtgttcaaatattcgatgtgactatgtgaaaaatttggtttgggaactaaaccatcccaaactctcgtaaggtacccagagtcttcgggcagattgtcaaccgcgcgccggcaaaccatccagaatgagcatgctttctcatggaaatcagcgcagttttttcttttagtagcagcctccatctttgcatcagggacaaagacatgacagacaacatgcaaaggagttttgattagtttgttttcaaacacccactcattccttgttatccatagaccccacaacatcccagcaaacactaccatccccacttgagatttcattttggttttgatagctctcataccatcccagaaagatagatagggacagttacattccaaaaataaattcaacaccatggcaattacattccaagcaaaatgagccaaaggacaagtaaaaagaacattccctgtgctttcctcattcaaaagataatattgtcaagtgacttgttaatcgccacacgtaaggtaatccattatcagatcatactcaacgaggggtctgcaaaatatattactctcttagttttatatcataagccgttttatatttttaagttaattttttttaatttgactaagcttatagaaaaacttagcgaaatctacaacaacaaattaatttcattaaataatatataacattgaatatatttttatattttgtttttataaatgttttaaaatattgccatatttttttacaagcttaatcaaatttaaaaatgtttgatatgaaaaaataaaaataacttataatatgcaacttataatatgcaacagaggagcgagtatagtcaattatttactgcagctagctaccacacatgcaagaagtgaaagtagagtacataggccatgttcttttcctattaagatacaaattttgtcacagttttcattaacacacttttcaaactaataatcagtactatccgtgaaattattttcattgaaatagagttaaaatatcaaatagattcatttcatgagtttaaaataattaatcaaacatcaatggtttcctcgtttcacgtgtctaagcttaagattgttgtaatttagattattgaaccagattactataagctgaattataataggccgacatataataagctgtgagctgtttgttttcctggattataagctgtttgttagttgttagccacccaataataaaaaaagcatcttttgagtggattagattatagtaatttgctttatagattataataatctatcataatatgttatcggtttgttttagcttatttctaataattcagattataataaccctaagctgaattaaacagtactgtgaatcaaacagtactctagaagtactaccgaacggggccatatgttgcgatcagagtttggaaacggaaagctacatacgtggcgtcgggccgtcggcacgtacggctgcaatgtggaagacctcggcaaattacggctgcaatgtggaagtcgtcgtcggagctcgttaggacaaatttcgccgacggaaatcgtcgttggtggtgcccgcatggctgcattattaattgtactatatgcaaactgcgactgttacggttttgaattgccatatcaatgtctttgggaaaaactatactataaaaaaacggcacaacccaggtcgtcgcagtatactactccctccgtcctatcttaagtattttatatgttttcgtgaccaacatttgaccgttcattttatttgaaatttttttattaatattattattattatttgatcgtaaaacatgaataatattttatgtataacttattctttttttataaatttttcaaataagacggatgatcaaatgttggatagaaacccataattttttttaataaaattttcaaatacatccctgttcttttctccaacaaaagttggattaacttttggatactcgtggcacacttttcaaaccgttaaacggtgtatttcgtgcgaaaactttctatatgaaagttgttttaaaatatcagattaatctatttttcaagtttataataattaaaactcaattaatcacacgttattaccacctcattttgcgtgaaacacttaatcttcatcttcatcttcatcttcaggagattcaaacaccacctcaaaaagttgttaaatttggacgttaaatttgttttactcaaaaagtcgctaattcttatt

SEQ ID NO: 51412 - DNA, 1517 bp, Oryza sativa
caaaaagttgccaaattgtggaagaagttaatgtcaactggccataccagagttattaaaaaaatgtgaaaggtcttactgtggaatttgttctactatttcatatgcatatgtctactgctggtagccatgcatgtcactgttaaacagttgaactagaaatgttcatgaaatcaggatgcatgtataactgactggagatcaatgtgtaagacataaaactcttgacaaattccaaattataggacaataactagcatgggggatttttttgctgttcaattttttggttacattttctggattagatgattttgtttttcattcattttaactaaaactaaaaaattattaaaaagaacttatataagagatactagtctaggaaaatccataggtgcgcgtactgtacatatatttcatgaattattcatcttaggttggttcgctcttaaaactgaactgagggggaaaccaatggggggtacgacagacaggcaagacttgttagtcaaatagttataagggtaataatatgattgaagtatgtacttggcaactcatcagtttaactctcaatttaaaaaaattcaatttatattagtatacatgtttttttatcattctctatgtttcagccatagcttataaataaaagttaattaagcaccaaattattttggttgcttttgggcacgtagcacgttttgtaagccgcaaccaagcacattctaagaattaaaagatactaccagcaactagattacttatgatggccaaaaatcactaggataaagcaaaaaaacgtctcgaaaattattcgtgacgtatcaacatcaggaaaattccgtcattgggactagtttgtcagataaaaataactttttctttaaccaatgctaacctcttacgatccaatggctttggctgatacagtgaatagtccgccacaacagtactgattaaatataaataaattatcttaccatatataactgcatttgatagagaagaaatagatacaagtacaaattaaaactcctgtcgatgaaagctaatgcatgacttcgatctcaaactgttattatgcagacaatctgacagggggcaggacggcatgatcaaacgtccagtgcggatcatattcatcagttctttgccggagggctcgggttgtggtactccggcgcaggctgcggcttgggctctggcttgggctctggcttcggctctggcttaggtggcactggcttcttgtggaagtggtcgaagaagtgcttctccttcttgtggatatggtcgaggaaggggtgttccggctcaggcttcggcttgggtggctccggcttcggctccggcttgggtggcaccggcttcttgtggaagtggtctatgatcttcttcttgatgggaccgcacatggtccctgacgcgcacaacgctgatgggtagtgtgtcttgcccccaatggcgacaaacgtgccctccgacattggcacgatcttggatggctcctg

SEQ ID NO: 51413 - DNA, 1037 bp, Oryza sativa
cgctttgaaattattttttttaagtttgactaaatttatagataaaatagcaatatctaagacattaaattagcttcattaaatccaatattaaatatattttgataaagtttttaataatatgtttgttttaggttgaaaatgctactatttttctatgaacttaaagaaatttaacttttaaaaaaatcaaaacgacttataatacgaaactacatagggaatacgtactcttgaaagcatcctcagctttcatgttcttccgggtgcagtcggcgcacttggccgtgccgacgacaaccgacgccgcctcaccgccgacggcgaccgccatcaagacggcacaaacgccgaggagaactagtcctcgaggagcacctgccattgctgagctaatcctagctagctctgtgtagctaaatattgctgatgtgtagagatggatgaagtgaaaggtgaggcaaacgcgcggtttatataggcatcgatgaatacaaacacagcttgcttgcattattgatccatcaatcgatggatcgaccagctagctatgagcaaaaagggccaatttggcgccgaatttgcagatgggcgaattaaggccgtccaaactgaatgatttgatcacgtacgtccaatcctctctgcagcccagctacgagaaaataatgatctatccatcggttggtatacgtaggatccacgcaccgctttatttatgcatgcatgtgaaatcttaacagcaataagtacaataatcgcactgcgtcttaattaacttcttgtaaactgagtctgagagatgattaattgatcaggagtactacaatgagccgtacatcgtatctgcagtatatactttgcaaatgcattggattgttattggattggatctttgaatatatgatcgcttaacacatgcaaatttaaaggtaatttattgtctgcatgtatatatgcacttagtacacatgtccagcacaaagtactgacagataaagattttgaacatttgagattaattgacaaagcaggaa

SEQ ID NO: 51414 - DNA, 10826 bp, Oryza sativa
gggacgtgaccctatatatctgtagtcccggttggtaatactaatagggactaaagatggatttttagttccggttatttcacccaggactaaagattcctatctttagtcctggattcctattctcggttacaaaaccaggagtatagggggttaggaactgggggtaaagaccatttctccactagtgcttcttgctctgccaccacgctgctcacgctccgccgctgctgctgcttgccgccgtgctgctaagcaggaagagaggaggaagaagaaaggggaagaaagaagaagagggaaaaggggtagtttggtccaattttttctggaaatgcatccgaggggtaagtagtggtatcttttaaatatgtgtaaaattataatgatatatttccaaatacatgaatacaagtggcatatttcgaaactgataaatttttattggcatgtatccaattaaccctaatgtatttgcctgatataaaaaaacaagtgacttgatatattttgcaaatctctcatttatatatatccatatacatatgcttcttcccttcaaagttaagttcctaatatttctcaatgtatatatgtactcattcctacctccagtctggtgaacgggtgcggactgcagtttgtatagtaagtacacgaagatcgagtcaagcgagcggcgtagaggtcatgtgtaccgtgtacttacttattgatgggaaaaggaattaattttgaaattataattttaaaaaaaataagaacgaactgcaattttaagattttggacacatttatttaccaatgcttcccattggagtatgggacctctgtattttggcctatactttcagtttgaccacttactaccttaggtacttttttgtactcctcaacctcgaacttatgttgcgttcttaagttcactttcccaacttcacctccctcgtttttcgagtgcacatatttgttttacttgttttgaaaaagcatgttacttgttttaaaaaaaattatattagatcaacgggtaggtgaagaattagttatattataaaacaaaatttgaataccaaatatatatagctataatatagtattttaagagggaaagagtagatcgtagcaggtggacaaacacagctctgctatctataaatacacgcgccacagacaattggagcttattgaagggaaactaattaaaggaagagctgcagctactcctactcatatatctaggaaataagttcccagttaatgttgtacaacttacatgcgttcatggcattctggctacttgcagacctgctgattcttctggcttctgccgcggagagcatctccggccggcctgccgccggttgccagacacggtgcggtgacgtcagcatcccctacccgttcggcatcggccccaactgctcccatgggaagggcttcgagatcgcctgcgatacccgaacccgaaacggcagcggcgagttggtgccgaccctcgccgccgccaatggcaccatccatgtgcagagcctgtttgtagcgccgatcccggaggtcaaggtgatgctgccggtggcgtaccagtgctacaactccagcgacagcgtcaccgagagtttcttcggcgcggtagacctcaacaacacaggcgtgtaccgcatctccgacaaccgcaacatgttcgtcgtcattgggtgcaacaccctgtcctacacccagaacgggaacagtcgcggcaaaggcccttacgccggcctctactacaccggctgcgtctcctactgtaacgactcgtcgagcgcgcgggacagcatgtgcgccggcgtcggctgctgccacatcgacatctcgccgggcctcagtgacaacgttgtctccttcgggccctggaagcgtggcttccaggtagacttcagcccctgcgactactccttcctcgtcgacaagaacgagtacgagttccgtagcgccgacctcaagatggacctcaaccgaaccatgccggtgtggctggactgggccatccgcgactccgttacctgccctccactggaggtgcaggagaagaaaccggctgggtacgcgtgtatgagcgacaacagcgagtgcgtcaactccaccaacggtcccggatactactgcaagtgcaagcaaggctacgatggtaacccctacgtcgacaaggaccaaggttgcaagggtaagattaatgtttttattttattactcctagttaacagttttgctaaatatatagtgccaccattttatttttacctttcgttgtgtgcaccaaccctgttggtgtttaaattcattaactaatttttttttaccaggtttcatttgatcttttcactatttgatgtaggcgcaaaaaaagtgaaaaaacgtattgtgtattttagtaagcatctatatatacacggccgtgtgttgcaagtttcacaagttgcgtaattttgcgtgtgtgtgatatataggatttgaacgggaacctgttcttcaagtagcgtccttaccatctcacctataaagaactttgtgcatgcgggagagatgcttattcttttgacttcgcccctctaaaacttgtaatatataaattgcactataaatgatatcaaaaggaaaatttatcaaccacaaacttgtagatcacattgagctctacaatttcgatatagagcacagctccatctgagttcatttaaaaacataaaagtttgtttattcaacaatagatttgagattttgtaacgaatatcaggacccgtaaaaagtctcgaatgaaaaaacattcaactatatagttgtagagctctccaattttcataaaaagattttcatcatacgacttcatatatatcaagatactactcctttcctattgtagtagtgctattatttttaagggtggtattttcaagagaaccgcctcaaaagttaatttttgcgtgcctttccatataagaattgccaaaaaatgacatttatgtaggaagcccatctgaaaaaacttgtaattctatgaaaatgtctaaactttaaagatttatggaaagttcattttaagttcaaatgaggtgaaccaaagttatatatgacccttacaatatttttttatttatatttctgttagtataattgtttacttatcatttacctctatatgagttggtatgttatctaacgtgacattagtgaatgaccatactaaaagaaatgttctaagaaaaatattaactaagttttactataagaagtactagaacgatctcggagaactttagtttacctcaataggacttaaaatgaattatctataaatttctaaaattttgatttcttaaagaactgcttatacaaaaatagatactagagcttataaagatatttactacaaagttgtagatctagttaagctctacaattttaatatagaatgtctttatccaagatcgtttgaaatactcaaaagttcgttttcaaaaatagatctgagagtttgtaaaagaaatagatctaaacgtattatccaaaatgttgaaaaaaagtttcaatgtagatttcgtgaagagcgacaatttttataggggggttcctaagaatttgccagttaaaaaatattttatacgtggtttataatcctggaaaggcgaagccatcttcacacacgtgattttcattttgagttgcctgtcaagagaaaataaaaagaagcctaagcctacgattttttttactagtgacagtggatctaacgactaatagatatgatcctttttatatgcacagacatcaagagtggtgatgtgtccaacaagaagaaatatccctggtagggcgtgggcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccattgactatgtttttaattgtttctacaatataccattcaaccaaacaaagaatttcttataatgcctaaaaatataagggttgacagttaattgaaaaaactaaagaaaaacaacaattttaaaaaattagcctcctagcacatgatataagaatataagtgtgtataagtttcatgctttttgcattttattattttttgtaaaatataatatgtctgttatttacatagactacttttctgcatcgtttgtatatttttatacaaatcatctttcatgtgctacacaaaatatttttgttattttgtttgtaagtgatttctctctaatgccacatagaatgacttttcaaaaaaaatacatgcaagaaattttgaaacataaacagaaaattgtatattgtgtaaggaaactgcactaaagattagttacagcaatatattgtgcacgccaatattaatataacattagttgttcacaataatatttatcaaataaaatgagccttcattcatactccctctacccaaaatataaggcacaaccactttttttccatgtctcacaatataaggcttgcatacattagccatcacctcttggttctttaaatttggtttattttaaatcatctaccgttaaatcctccaatcaaattgcttgcatgtatggatgtgatccaatcaagaaggtgattaaattatttcttggtctttgtgttatgagtggttgagccttatattttgggatagagggagtatttctattaaaaaataatactgcaactcatatatggatttgttatgtttgctaataagttttttttaactttcgtaggaatcactttgggattttccttcctaattgttgctgttcttttcacgctaatgatgcacaaaaagcgaaaaatgaatgaatatttcaaaaagaatggtggttcagtgctacagaaagtggacaatatcaagattttcaccaaagatgagctaaagaaaatcacaaagaataattcagaagttcttggtcaaggaagctttggtaaggtgtacaaagggactcttgaagacaatactccggttgcagtgaagacgtcaatcgaagtaaatgaagctcgaaaggatgatttcacaaatgaagtgatcatccaatcgcaaatgatgcataataacattatcaagcttttgggttgttgcttggaagtggatgttccaatgttggtgtatgagtttgccgctaaggggaatctgcaagacattctccatggtgatgccaacatccctctcccgttgggcttacgcctagacatcgcaattgaatcagctgaaggtctaaggtacatgcactcatcaacaagtcgtaccatacgacatggtgatgtcaagccggccaacatacttttaacagataagtttatccccaagatctcagattttggaacatctaagcttcttaatgtagacaaagatttcaccatgtttgttgtaggaagtatgggctacatagatccagtattccataagaccggccatttaacacaaaagagtgatgtatacagttttggagttgtactgctagagctcatatgtagaaagccaacaatatatggtgaaaattgtagcctcatcattgagttccaaaatgcctatgatcaagagaacagtgggaggataatgttcgacaaggagattgcaaatgaagaagatatcctaatcctagaagaaattggcaggttggcaatggagtgtttgaaagaaaaggttgaagagcgacttgatatgaaggaggtagcagaacgatttgttatgctgagaagatcaaggaagtgtggatagggaaattatagtgtaagtcctcaacactgtgagtagattactatcgagggaactcctaagcactttggtgccagcatcagtgcaagaagcagtgcgatgctttctgcaccagccactccacttaactagaaggtggacaataggaagataggagctacaaacaaaaatatgtattttgtggtaggcatgatataatcaatgttatcaatcggtgtcatttcatttaaagtaaattgtgtttttcaagtatgtatctcctatttatgttttctgtaatttgaatcgatttttgtgtattgtagtacaaaactgtgtaatctattgttgttgtgtggaactcaggtcatgttatatattgtctatggttgttttgattgtagcacgtggcttggaaatatttcattgatgtgcatgtactgtaacattgcttagctatatctaaagtaaaaaaagtcattatccttgcaaagattttagtgtaatcttgcatagtttacagagatagattggcttgccacctatgcattattgggttccaatatgtgccaagaaggaaatgtctaacatttgttctcaaaatattttatatttctatacataggcccatttggttgggcttaaactcctaaatttaacttcaggagttggatatagagtggagttgtggagtagcctaaacctagctcaacttttctagtttattttataagagcactctagttagctccgatccttttttttgtcaagcagaaaccttttggttgggctccagctccaagacaagttggagcaagagctagagcaagaggtggtgccatgccaaacaggcccatacaccagcaaaaatgcccatgcattacaatgtatcaagtcaacctttcgcttattcatcttctcatacattgcaacaagaaaaactaatataataattaaaaaaatcacatgattaggttaggtttcaatgtcaatatagttttgaagatgatgcggtgaattttttggataatggaataaattcaagcctttacttcaaataagctataaccacttattacaaattctctcaaagagagcaaacattcagaccatgtcatagcgacgggcgcatccggcaataacagatccaatatacatcgtcaccactcagaccaacaccatgtagacttctcgcagcatgactgctagcaggcaccacatgtaggcgtcagcgttaatgaaggaacgttaacatagagatcgaacgaagaaggcaggtagatcgccacaacccaccttgcagcacgggatgacttaatgttgacatccccaaccatgagtggcgttggacggttggagtctgatgatcattattggtggcactagcattatactccctctaacgttttcaatttttttctaagttaaacttatgtatatttgatcaaatctatagaaaaatatagtaacattttcaacataaaataaaccaatttaataaaaccaattatattcaatgctagatttaataaaagcaatttggtgttgtaggtgttgctatatttcgttataaatttaattaaaattaaataagcttaacatagggaaaaaaatcaaagtgtataatatggtacaacagcagcagccacagccatcagagggttcagggtatcaccgcctccgtgcatcttcatatgtgatttcctttgccttccgcggagggcggttcaaggggtgcagactcggcggcagctgttaacctttgactgcttgcctttgacaagatgatgacgggaagaggctgacggcgaaggacgtcgtggagcaccggtggttgacggggaggcgcctccctgattttagattcacaattttttcacattgttttgattagcattgtaatctgtcaaacgagactatttaaatgttgttggtcgacttaagtttatttaatcagattgattgccttcaaaattttataccaaatttgtttgtaacagaagaaattcgtccatcctattgccttacatcttggcaagcacgctacaatactcttcctggacagaggagcaatgatggggtaaaaaggagcgtcatcattcgtccaattaatggcttatcaaaacttgaattttaaaatttgattttaaagttggttttttgatttttttttcaatgtagttttatttttcagctttggcttttaaatcactaaggacacatgtagtaatttttacttgcaaatcattttttatccctaaaaataagctgttacggcttatataagcagcaaccaatgacccaaaatcacaagaagaaaaactggcaggtaggtccaactgtatgtctgcagataattctttcatcccatcggtttaccactacagacgctgccgcgaccgcgagatacaaaacttgaacacgactgttttcaattcacaagcaccacatgcatggcacataagtataactgaaagaaaacgacggtacatgtcttaggctattgcaggtgttatgctggaacagcgtctaagcttttatcttgtttcataattagttaaacaaatccatcacattgcgtgatggctggattggcggcaccaagggaacggaaatgaagatattgtatatggtaagacttgtttgcgactctagggcagcagagattatcttacagaacatatcccagacgaccgtcagggagcaccattggtaccatcctcattccagctggtgctggtcctctaccatatatcataggctgtaacaaaaatgtccatagaaacaactacaatgtcaacatgcagtagcagatgcagacgaagcaattgcaaacgaagaattatttgtgaatataatttttacatgtgtgttcttagcaaatctaaaaacaaaggctgaaaaataaacttcaatgagaaaatttcaaaatcaactccaaatttaaggttgaaaattcaaattttagctgataagcatcagcgaaaagatgaggcttcaggattcctagcatgggtattcggagttaattaaatcatgtttcatagaatttatataaagatgctagaaattaattaaataaaacaataatttagccccgcggatgaaaacagctcacatgcatatatatctcacaaatttactagatatctgataactaaatgcaaagttcatgcaaaaaatcatgatccatgtttgaaaaaacattaacagagtatcaatttgactaatcttcaagagactcactcaaggcatttttctcttcagaatatgatgctttattatcattagacaaacactaagaacttcctcatctacatacaaatcaagggagtatgtgaagagaacggtgtatgggattgcttttgatacaccatcaaaggtcaatgttggtgttcttacaacacgccaatttcatatattttttttcgcttccttaaactgccttcaatgcacttgaccacaatctctcttattccctgccttagcaggcggtaaaacgacttttgtgacctctccatgaatttcaaagatctccttaatcttctctttagaagcattgtctggtaagttcttcacatatatagttttcacctgtaaaagaaaaggccattcagacaaatgttcctagggaacaacaaaacaaattaaaatgatatgaaatttcaaagctaattatctctatgaatataaaaaaaaatcaacaagcgaagggtgccttgtacgaataggacaatccatccataacagaaacaaccttgcacaggttgagccagtggacagtggtattgaatcagtagaataacttccaagtcaaacactcaatctaaatagtatttcagatggctttaatctacatacaaaaaagtgtcagattgctttaatctacatacaccaaagtgttgtcagttatacaatccttaaagtgccatgtagaaactaaaatcatgaagcagcggcatcctggaaataaatcaataaaatgatggttattttggttcaacaatggtaatcagtagttccagataacaaaaactaatgtgaatgagaaatgattaacataagaattacaaaatatttcatgtttcttagatcattggccagttcctttagcaaattatggcccaaaagaaacaaatccaactcctcttttacaagtgagttaccccaataaaatacgcaatataaccagttttttttcccaagggaccctagttcaatttgcagagctgcagtgcatccgttgagcatagaaagcgctgacttttcatttacagtgtatactggggcagctgcagaagaagaatctgatgatgatgaacccttaggttcagcccagctgacggtcaactggctaccatcaaccttaaagtttggtgctgacaatttctgcttggcatagtctgcacaagcatggttataatactcaacaaagaggaacccacggttacggcttggatcatgtaaatcctgcaggaccaaaacaaggtctcaattagcaaattcggggccttcctagtgcaaagtacaaccatgaaatcacagacacaccttgaacatctcaatgttcacaacacctgggcccttcccctggattatgtttctcagctcgtcctcactcaaccccttgggtacattgccaacaaatagcctgtgctttgcctgtgacaatgagcaccgcagtgtcctcccctgcaccacggaccataccatccaacataagtgcaccatacgtgatgcaattagaacctctgtggcaacccagagagccacaataccttgtgttctttgtcatgcagatcctcaatagcacgctgagccccatccttgccggtgaaggtgacaaatgcgaatcctttgttctccttcgtctctttatccttcatcaacctcacctgttgtcatccagagcttcaggttattgcactatgtgttacagggatgcaaaa

SEQ ID NO: 51415 - DNA, 3056 bp, Oryza sativa
agggaggaaatcttaatcagaatagtgatgtggcacaggattttttcaataacttccaagatcgggttgattacgctgtgcatcatgctttgatcaatcagtctggggtgttagtcaatagcttatcaaacatgatgaagtcaatagccgatggttcaatagctgagcatcaggctgcaggcccggtttatttgcaaggaggtgtcttcccaaattatcggtctttgattaccgatgttcagccatctactcaggcggttacctccgttgcaccaacaacttagccaacggcgccggcaacaactcccctacctgcttcatcagcgatggcgccaggccagccggtgaaccctcggttgttaatgagagagcagccacagcatggcgggcaggttgtgaatcggctgacccaagatcaggttgctgccatgtttctgccacctcaatctgttgttgatccaatacatcagcagccgattcaacagacacccccaattcagcaggttgtacaaccaatccggcaacaggtcatgcaaccattcagcaaacaccaccaaggcagcagcccctacagccgattcagcagacgctgttaagacagcaaatcgttcaaccgatccagcaccaaggttcaataagcgcatcggccgggtttgcaacgcctggtggtcagcttgtacaacaatttttaaaccaagttgtcccagaacatttggttcaccacgtacagccgggtggcacagtaatgcctcaagttattcctgagcacttggtacgcaatatccagccgaaccttcataattaccaagggggtaacttgaattatcaatatcagcctccttccccgcaagcccaatatcagctaggggcattggctcaacctcagtttgcgtctcaatacggtcagttcgagcccatgcaacagcagtcacaaggggcagctcagcaacaaccgtgggccaatgtgattgctgacgtaatgagggaacagtttgggcttaaaccaaaagagactggaagtttgtatcggcagccttaccctgagtggtttgagagagttcctcttcccaattggttcaaagttctagacttctccaaattttcgggacaagatggtgtgtcaacttatgagcacattagccgattcttggctcagtgtggtgaagcatcggctgtagacgctctgaaggttaggttattccggttatctttatatggatcggcttttacttggttttcctctttgttgtatgggtcgatcaatagttgggccgatttggagaagcaattccacagctatttctacggtggggttcatgagatgaaattatctgacttgatagcgattaagcagcggcatgatgaacctgtgcaggagtatattcagagattcagggagatgaggaacaaatgcttcagcctgagtttaactgatgcccagttagcccgatatggcctttcagggtatgattgctccgattagggagaaattctcgtctgaagactttgatagcttgtcacaactgatacagaagctaaccttgcatgagcataggtctgcggaagttaagaaaagctctaagaaggttaatcatgtttgtctgtacatgtatgggtcggatgatgatgaggatgattctgaaatagctgcagccgaatgggtgaggagtaaaaaggtcataccatgccaatgggtaaaaagttctggaaaagaggagaagtatgactttgatattactaaagctaacaagatctttgatctgctactccgagagaagcaaattcaacttcctgctggtcatacaatcccatcggctgaagaattaggcaaaaagaggtattgcaaatggcataattctaggtctcattctactaacgattgcaaggtttttagacagcagattcaagtggccattgaggggggcaagattaggtttgattattccaaaaagccgatgaaggttgatgataacccttttcctgttaatatggtgcatacagctggccaaatagccgatagggtccgagcaaggggttttcagggaattcggtaaagattatcgacaaatatcatgaagaatacgatgatggttttgatccccattggggttgtgagttctttagattctgctggaatgaaggtatgagattgccatttattgaaaactgccctgggtgcagtgatatcgttgagagctcaagccgatcatataataggggtggtcgactaaggcagacaagagtttctgttcatcaaagattgggtccagtgaatcaagatcatggccaagaggcaatgtaatcaggaagaatcaatggtgtccttctggtattttcacgaagaatcagaagaacatttaataaatctagatttggaaataaatgtggatggaggaaacataagaatttttctatatgaacagaattggttgtagaatggtaagctctaaaggaaaagtgttgactctagggagatggtatttcatgtactctagagatgtttgggaaaggatccaaaggaaatatatcccagagcaacggttagaggctagagaaataaatggaggggttttgtaaaagtcaaaagaaataaaaaggagggttttataaagtttgaaataaagaaggattttataaaatttaaaagagagcatttaactttacaaataaaatttaggtccaaagtaaaagagattaaaagaaagtaaggttgcttcaaaggaaaagtcgagaagagcacaactaaaacttttcgcgaaaatttttccctgaaaatttgagtatattgcatcaacccttcgctcattcatcttctcatacattgcaacaagaaaaactaatattatagaaaaaatcacatgattaggttacgatttcgatgtcaatatagttttgaagatgatgcggtgatttttttggataatgaattaaattcctgcctttatctcaaataagctacaatcacttattacaaaattctctcagagagagcaaacattcagaccacttcatagcgacgggcacgtccagcaagaatagatccaatatacatcgtc

SEQ ID NO: 51416 - DNA, 3917 bp, Oryza sativa
gcacatctacttcctcattttctcccccaaatgcctagtacatgagcagaaaattcaatgacaatatgttcaagcttaatgagaagataaaaattccaactaatagaattttcctatgattgatcttgtacacattttattcttgactagacttgttacttgtgaacaactatctatgttagggaaccttatgcatctaagtagatgataattgagatatagttgagatgaaggaaattcttgtgttctatctcatgacaattggggatttgtttttaaaatcaaaaatttatttggaaccttactcctcatatgactttattcctacccaacaaggccatacaccaagccattaatgatgaaccttatgcatgtgtatgactacctgtaattatattgagctttaccaaatttttgtgactcgtgttagatgtctctcatgctctctcgatcaaggttgcacaaccactatgttatccatataagatgctaagcttctacactggaagttggcaccattccatccatttcgactaccactgaaaaagaaaaaccaactttgatgaataaattctccattcaatttatcccttcttctcctaagaaaaatccttggaaaagaaaaagaaaaggagggaaaggcatggctattaaaaaaatatttctcttcaaaaatatagagcaacatggaaaaaaaagaaagaaagaaaatggccatgccccctctacaattatgaaggagaaaattggagaagcaggtataaataaaggagaagcattttctttattttccatttttccacacatatcatacactttccacccaaaaattagcgatctttgtttcgagagtatgatcgattatcttcttgagtccatgtatttgattttgtaatatatatgatgaaggtatgttccgaattatgcctaccaaactccacacatacagcctttagaataaggaataatttcagcaaaatatgccttggtaaggatccacagacattacaaaatatccgagtgatcgagggtaagtcattatgatgagaaaagctggtttgggaaaatttataaacccccaaaagtctgaagtagaatacgaggaggaccagattcaagactgttccatttatcaatcacccaggatagtaagatagccaccgctgaagttcacaggtacaagaatagttttgaataatttatgtgcttctattatatattggataattttattctgaaatttatctctaacctttactcaaggacgagcaaagagctaagtgtggggagtttgttggcggctattaaatgccaaatttatgccgtcaatacctgcataaacagaaagaataaagtatccaacatagtgattaggtttatttctaacatattccacgagtgttggtgcatatgtgcctgcaggtaataaaccgccgaagttgggatgaaaatcagacttaagtggaggtgaaatcctatccatacaacgagtgggccaataactacacaaaacatcaacaaatggtccttccactcgaagaaatagatatgggaggctgaggaggagcaacaggccgaaaagtgggcctattgggccatacatgggttcggccgaaccactcccacagctgtctgatatgcggcttggcagggacagtccagatgactccctaatggcggttggagggtagaatggacatttcacatcttcacttcactcacacactccaagcttgagctgaattataagaggctctattgtactttattgtatactagattagagagagagtagagtacaagaagtcagaggagttccggaattgtcggtaatcctcttcttatttcttttgctttgtttaactactctgattataatagaaatatctttcgagtaatttagttttgcttggtgagaattatctcttggttagttcctaatcagcgtacgagatcatcgttcactataatccagcaaaatatagtgattgctttagtgtgtacctaacattaaagtaagttattaattgcttagacgctgtgtctaggtagttattaatcgctccgtatcccacagtaggtgtggggtgggtgtagaggtggtgacagccctcaagatcactgaagtcctccctaactaggtacgtagtagagcgatatctgggagtagtaagctggccagtgcccgaagtatcgtattaggattaaagttaagctttccatagacactgtttctcaccggtgaatccactctatcctttgcttatccttagctttatgtacttggacgtacctggtgaagagccgacacagacgttccctgtggaaatcgatacctgagaatactcctgggtgaagtgttacatcggtatatctctataaggttaagaaataccaacatggacccagtcatgttccctgaagcagattactaggttggacagatacgatctacaatagccaatctaaacaattccttcttggagacaattggaccaacaacctagcgtccttcttgttccccatctcaaggagaagagcaacatggagttgggaatgtcaatgttgaagatgtccctagcgaacacctgagtttagacccaggccgtaatccccataatgcattgccaagaagaccaagttggaaaaccccacttgccgaggtaatcgtgatctttgcgaccacttgaacaggcggagacgggaatgacgagaacaagacggacgtcggccatcaccaacgttgttctccacaacgataacagaacagcgatggcaatcatgaagctatctaaatgaggaccgagaccgactggattggcaaagctgcaaggacgagaacaatcaaggctggagaagtcagggtgacaatggccgaggtcgaaaacaccacgataacaacagacgacgacgagattcacgttcccccggttctcggagaaatcaaggacattggcatagatccagaggtcgtactcccgattatagttatccttcgttgtcttcatcatcatcgataggtggctctcgaaggccacgaggacaccaaccacctctcgtacctggaggaggatgtagattagctaaggtatctaccaccttgaaaatcagtcaaaggcttgattgtctagatgtttattttcatacttagtgctgcatcaattgggtttgacctactaagtcatgcttagaaccatgatttctagcctgctttttggttgccaataagggtttcatcggggtttcagccgataagttatctacacattgcatcagcttataaggattacatacaagttagatttagccgatcgcaacaaatgtttcactatttatctaatcgtttcgatttaatgacatcggacctccagccgatgtatgctttaatctttggatcagtgcttatcctatcatgtcattattagccgattaatttctactagattatattattgctttattacattatcatcagccgattgtctttatatcattattttttcaagtatcaaaatatgcattacatatatacccgattgttcaaaaccgtatcgacatcagctcacattgctatatcggcttgtcagccgatcggctctttcttgatcaatatatttatctatcttgtcagttgtaggatcaaactgacctgcactggagtaaagcagatctcctaggtcgttgtgttcgtcgatttaagttcgcggccaacacagatcgggcaccgttggccaagcacggatttttcgtcaacagtttcatcgagaagttctccatccagagtggctcacaaatccagtaatgtttcccaaggccaatgacaagtagagaaggtgtgtggatttcattgacctcaataaggggtgccacaaggatcacttccctctacccggcatgatcaactagtggactcaata

SEQ ID NO: 51417 - DNA, 1545 bp, Oryza sativa
cgatgttttttgttataccaagatgcccttcgagctaatcagtgtaggcaacatgtaccagcgcgagattcaaggggctcttggtgacctgatcggccgaaatgtggtggcctacgtcgacgacgtcgtggtcaaaacaaagacaagcgacaagctgattgacgacatgagggaaacattcaacaatctccgacgacatcgactgaaattaaatccggagaagtggacgtttttagtaccatcagggaagctgcttagtttccttgtctctaagcgaggtattaaggcaaacctagagaagatcaaggcaatcgagaacatgaattcgcccacaagactcaaggaggtacagaagctagcgggatgaatggtggcactaagtcgattcgtggctaggatgggagaacgagtacaacctttcttcgctttacttaaaaacccggacaaattcgagtggacacaggatgccgagaacacgttcatcgcgctcaagtggtacttgtccaaccccttgtagtcgttgcccctcagccaatggaagagttatttccttatattgccgccacaccctattctgttagcactgtcatcgttgtcgagagggataaagcacaacacccggtgtactatgtcaacgaggccctccatgacgccaaggtctgatatcctcaaatacatagactgctctacgttgtaatcatgacattgcggaaactgcgccactacttccaggcccataaagtcacggccgtctcttcttcccccctacgtgcgtcgtgcctgcctggcgctgtcaaggccacatctctgggtcatcctgcagcatgcctacacatcgccatcgggcctcgtcgtgcgtgcggtggtcgagcatcgccgtcgggccccgcatcgacttgttgctctccaggtgcacgacgcacctgcaccactgcacgtcgccgtcagccccgcatcaacaacgggatttcaccgttgatgttgctgctgcttcaagccgtggtcttccagcatcttgcgaagttgccgtcgaggatgacgactcgctggatattgtcatctctgctgcttcaccttgttggttcccaccatccgcatgaagttgttgctgtaatgatgccagatcctgccggcgtggaaagggcagcacgcccgcttcgttgactgaaacaattagcaagcagctagaagaaatctggagcagcaagccgctgaaagaaatttgggatttttttccccttgtgttttctgttttttctctcttgttgatgcaggtaaatgcaaatgatttgttttatgggatagctggttacatcgattctggttggaggacggatccaatggtgcacttgtgccgagagatttttatcttcatcatggacatttctaggttagaccaaccatccagaagcctattaacatttttttcatctaacctataaccaagccaagggcataacggacattttcaagcaaactaaccagtcaactaaagaacaactaacggtaggggtatagaagagttcaaggtgaaaattcggaggt

SEQ ID NO: 51418 - DNA, 908 bp, Oryza sativa
gcacgccactttaattgacagttaggctagtacgtttgaatcaatgctttccccatttaaggctggagatcaaggacagcacactcgcactgcttattctcgctagatggccaataaattcataaacgtgcacagcgaatccagagtcaatatttcatgtgaatttatgtttgtcctttgtggttaacttcatttaggtagagaaataaaaacaacaggcagatattacagtacacatcgtgccctgctaatatgcatgcgatatccaataaatgaacccggtcacactttaaaaaaaaaactcctgcggatgaaagctagcaagtacattatatttcaatgtataatctcacacgggggtagaaagcgttattctgcggacacactgatatggcacgaaatcatacaagaccaaacgtagataatgtttagtgcttcgctggtgggctagggttgtggtactcaggcgctggctgtggcttgggctgtggcttgggttccgactttggctcaggcttgggtggtacgggcttcttgtggaagtggtcaaagaagtccttctccttcttgtgaaagtggtcgaggatggggtgctctggctctggcttcggcttgggcggctctggcttgggatccggcttcggtggcaccggcttcttatggaagtggtcgatgatcttcttcttgatggggccgcagatggtcgccgacgcacacaaagccgacggatagctggtcttgccagcgacggtgacaaaggtgccctccgacaatggcacgatcttggatggctcttgcccggggcatggctcgttggttgcgctgtggagctgggcaatgcagtcagagctgtaaaggtcggtgtcgagagggacgctgaaagcgccggagccgtcaagcttgcatgc

SEQ ID NO: 51419 - DNA, 3341 bp, Oryza sativa
ggccgccttctttgcggagattgttcgcctgcacggtgtgccgctgaccatcgtcgcgatcgcgactctgtcttcaccagcacattttggcgagagatcttccggctcgctggggttcagctgaatctctcctcagcttttcatccccaatccgacggccagtccgaggtgacaaataagatcattgccatgtacctacattgtctcactggcgatcgtcctcgacagtggcttcgatggctgccatgggcagagtactgctacaacacgtcgtaccaatcgtcactccggacgtctctgtttcgtgttgtcgacgagcgcgagccgccgacgcttcgagcttacgagccgggctccacaaggttgccggcggtacaacaggcgctccaagaacgggatgattttctgcgcgccatccgtgatcgtttggaacaagctcaacaaacctacaagacagcatatgatggcaagcaccgagtgttggagttggcagtaggcgcttcgtttgcttcactgaccaggtgcatgtctagctgtcaagaatcgcgcatgaggcgacccgagtgcaatgtcccatatcagattacgcagcgcatcggatcagtggcctatcgcctgcggctgcctccaggtgctggcttacatgatgtttttcatgttggattattgatgcctttccgtggcgatccgccggaccatgcgccgcccctgcctccgacgcatcatggtgatgtttgtcttcaacctgcttctgtgtcgcaaagtcgtttggcacgtggggttcgagaggttcttgttcagtggaaagacaggccggcggctgaggcgtcctgggtcggattggatgattttcatgctcagtatccagattttcagctcgcggacgagctgcttctccaggggggagagatgtcatgtggggattgcattatgcacggcgccgtctcagagttccgccgacacagccgtaatgaggaacagtcatcggtttagtctctgttcagtttacgagtttgttagtcatctttatctctccagttgttaggattctatccctcagctcccttataaattgtaagctgctttcgttggaagtaatcaatcaaagttcagattaatctagtatcagttcctgccttgccggtgcggtgccgaacacggctcctccgcgccgacgaggtccaggaccacgttctgttacagcctttaaatacttcctccgtcgcaatcctccttccaatctcctcgtccgtgacaacttggtatcagatttctctggttccgttcccatggcttccactcaagcacagctcgacgaaatcgccaagaacctgacatccatggcggcccaaatctcagacttggccaggaagatgagcgtcctcgaacctttggttcccctggcgcccaagctcagcagtttgcctgaccgcgtcacacaagtccaggcgtccgcgttcgagtactccgagcaagtccgcgccctcaatctggccgtccagcgcgtcgaggccagccatcgctcgtcgcccgtgccagagacgtcggggtccgctacgcacgcgccgcgcggcgctccgccacccaccggcgacaatgacaagcagtcgggcgacgactccaccgtcgacaacagttttcttcctcgtgccaagttggagtttccaacttacgacggcaaaggcgatccgcttccctggctgaatcgctgtgagacgttcttccgtggccagaagacaccggagtcacgtcgcgtctggtatgcatctttgcatcttctcggtgatgctcagttatggtactacagattgtaacccaattccggcgaaccatcgtggcagcgcttcgtcaagttggtgcacactcgctttgggccacccatgacggacagcccgctcggcgaactcacgacactttggcgcaccggcacagtggacgactacatcaatagcttcctcgccttggcttgccgcgacgccaaactatccgagaaccagcaggtgcaattgttcacggcaggcctcgtcaatcccctcaagacagatgtagctctctgccggccgagttcactggacgacacgatcatgctcgcccgggcgtatgagcagcgggttcaactcggcacaacggaccccgtgccggctcgctctggccgcacaccacggccttcgctccctgccctgccggcgcccgtgtccgccgcatctgccgcgtctacggcgccggacgccgcgtcatcggcatcgaccagcaaacagcccctggtgtcggctctccctcgcaagcgcttgtcgccggcggagatggcccaacgccgttccgagggcctctgctacaactgcgacgagaagtacgtggcgggacatcgttgcaagaaatccttcgtcgtcgaggtcatcagcttcccagaggaagctgaggagaacaccgacggcgcatgcgctcacgctagatgagcctagcatctcgctgcatgctctggccggcgtccgcacgcccacattcaacacgatcaaggtgcaggcccgcatcggcgcaacggacctcgtcgccctcctcgactccggctccacacataattttatcagcgacgttgccgcccgccgcgcccgtgttcccctggaaccgcgccacggcctcagcgtcgcagttgcaaacggcgatcgcatcacctcgccaggctgttttccgtcccagcgtgtcaccatcggcgaccacactttcgtcatcgatttctacgcgcttcctctcggcggctacgacgtcgtcttgggtgcccaatggcttggctctctcggaccgacgctctgggacttcgccaagcagtcccttgccttcggctcacccaacaatcgcgtcatctggaccagcatagacgcacctgcaccacctctctaggcggccaccatcgacggcgcgacgggcgaactcatgtccgagctgctcgacagctttcaggacctcttcaccgaaccacaaggcctaccttctgagcgccatctctgccatcgcatccgcctggaacacggcgtctcagccgtcgcggtgcgcccgtaccgctacgcccacatccagaaagatgagttggagcgccagtgcgacacgatgctacagcaaggcgtgatccgcccgagttcgtcggcgttctctccccggccctactgatcaagaaaaggaatggcacgtggaggttctgcatcgactaccgcgccctcaacgacaagaccgtcaaagacaagttctcgattccggtggctgaggagctgttcgacgagctgcgaggcgccaagttcttcaccaagcttgacatgcgttccggctaccaccaagtgcggatgcac

SEQ ID NO: 51420 - DNA, 3857 bp, Oryza sativa
ccaggccgtcctggactggccgtgcccaaaaatgcgtgcgcagttcggggcttcctcggcttggcgggctactaccgccgtttcatccgcgactcggcaccatcgccgcgcccctcacgacgctactgcggaaggaaggcttccactggtccgagacagtggcatcggcgtttcgacaactacaacacgcactcacggcagctccagtcctccagctcccggatttcaacaaggagttcattgtggagtgcgacgcatcgagctcaggtccgggcgctgtgcttcatcaaggcgccgggccggtcgcattcttcagcaagacgatcgcgccgcgccacgccaagctcgccgcctacgaacgcgaattgatcggcctcgtccaggcggtgcgtcattggcggccatacttattgggggcgccgcttcctcttagaccagcgcctctccaccgtccctcagcaccagtgggctagtaagctcctcggttttgactttgtcgtggaatacaagccgggctccacaaatgtggtggcggacgtgctttcacgacgggacgaacactgtaacaccctgaaaattcgaccgacaaaaatctaaactctagaaatatgggccttcaaaaactttttaataaattgcatcatgctgattttgttcgatcattttatttgattttgatttcgaagtttattaatcgtgagtaaaggatagttaattagaaatcaaccctaaaaataaattggtaaaatgaatataaattaaaaaaaaggattaggtggggatagaagtaaataaaatattgtcgcgaccatatttggatcaattgaatttaagacgataattaaccctaattaagacttcaaataaattatataaataatatatgagtaatattaatctagggtgaatccattggttggaataacacacatgttgagtaaatgcatatatgcaaaaattaggaattttggaatcaaatttatatgggaaatacactaaaatcagtttaatagaaaaagagcactattcatcggccgccaggtgttcgacgtggccctagcccagcccctcctctacccctagccgcgcgccgtctcgtcgcctcgcgccgcgcgcccgccgcgtcgcgccccgcgccgccgtcgtttcattctcttcccccttcccctctctttcttcctctccacgccctataaaaaccccttccctccatccccaagcctccccacacccattccccatctttcccctccctctccccttctccacgcaccgccgccgtcgtgccgccgcgccgccgtcctcgtgctgtcgtgccgccgctttagtgcctccgcgccgccgcccaagtgcgccgcgccgtgcgccgtcgtcaccgccgccgtcggtgagccgctgccccccctgtttgttgccgtgccgccgggtagagagagagagccgagagagagagatgtagggagaagccgagggagagaagaaagaaagaaggagagaaaccgagaggaaagaaagagagagagaaaagagaaagagggaaaaagaggagagagagaaaaagaaaagaaaaaaagaaagggaagaaaagaaaaataaaaaggaaataaataggaaattagagggagattagggaagtgtagaaaatttaaaataactagaatttgattataggattaatgaaaatatcgttaggtgaactcctactatttaaatacctaaagtactagaatttgattatagaactaattatttacgaattaaacaattagatgaatccttatagattgctatagatcatttttagtaatatctataggagatcaattcgcggtaataatttagatgtaattaaataaatataggaattatcataaattattatagattatttttgggtaatccctataagtaatcgattaacggtagaaactagggattttagccgtgtatcatatttagtcatttagtcatagactaaattaggtcttataatatttctaggatttcgtccgttttttagctcgcgatagaaatttctaacctattatatggatgtaatgctcgggtagattaaattaaaaacttatgacaacaaatatttatacccgcaaaatagtttaattcgaaattgggtttgctttagttcgcgaatagtaaaattaatataaaggaattgactttcgctttcgactttcatttggatttatttgggtttttatttgaattctaaccgaattcaaatcaattttcgcacgtaactatagagcccgagggagccgcggatccaggcgaaggtcaagacctacaagatctcgagcaaggcaagtcatcactattccttgatcacgttgatcccaattgtgaaattaattttgtttacaaataagattgcatgcaatgatgaacatcccacttgtgattatgccatgccttgttattgtttatcttcaattccttgtaaccataattacgtatgagtccctagtcaattatgacacttgcttagagaatgctattctagaatcttgcatattcatatttatcaaatgctatatgcttgggcaattacctttgggaaggtaattgagatgcggcatgtggaggcatgagcaccacattgccatgataatggtgacaagaaaggaattaaaaacctatgttttagaccggggcggatggtggatttgggtggtatccgggaaaggctagtaccgtccccggtcaattaaggaccgagccatgaagttaagcatgaaacgacctcgtacaaccacatttctcgaatggggttagacctagcggagtaaatagccgagcggaggcagtatccatgcatagtggtttctcatgtgtatggcaggggctctacaatggtgtcgccattgctaggactgtcgtgtgttgagttgagcctagttataacttaattacatgggtgtaaaacttcccttcccgggtgcgccagaactcctctcattgctagaaaccgtgtacgcctagagtgcatgaggatgaaaagttcatggagcgggtactgccaatgcgaggttatcgaaaggctttgccgtgacgcgtctcatgtgttgagacaaggctcatgtgttgggcagtcatggagtgtgggtaaagtgtacatccactgcagtgtgagtaaaccaaaactattcgaatagccgtgctcgcggttattgagcaccgggacatgtattacacttggctagtctctgaattcttaacttgtgtgggatatgttattgcatgatgaaatttctatgctgcggagtcacttcttgagataggggaaagtggacgtcctcagaaaaccataacgactcaatggcgggaagctatccttgggatcacaatggatggtggacagaaccgtcgttgtttaaatacaaacactggtactaaaatttgatcagtcaatgctaggtcttaagtttgtgaaaagaattataaaacttgctttgcacaaaagaaccaaagccatcctttgaaatacccctatcatatgtattgttgatgtggcggcttgttgagtacggttggtactcacccttgcaaatataaaattaatcagaagcgggagatgaagcttcggagaacccctatgcctactaccaggagggagaagaagacgatggtgcccaataggtcttagtacggtcgttgcctgtgcaatggcatgccgctgcctaaattccgctgccttatctaaactctgcttttggttgtattccggaccgctcggtccgatgatttaagataatgcctgcgggcttatgttgcactaatttctagtagactctcgtgtatgagcatttggtatcccagctataaattactgtgtacca

SEQ ID NO: 51421 - DNA, 1009 bp, Oryza sativa
atcagtcttgttcagtcaggctttactcaattccttaactgatactaggctggcattagcatcccctctatttggagcatttaagtcatactattggcttttccataagtatctagagatcagccaaattttataggctgtgattagcagtcggactcatattggtgtgttccttctaagatgttttataggccaacatctctactttaagaaaaatcactcaatcacattaatgtatctccaacttgccatacagaccaggagagaactacatcaaagaaagaagcctttttaaggtctcttctcccagctacctaataggatgtttcgccaccctaatttaccagatctttgatcacataggacaggttaccactattgtgtagctcaagtatgtctcaagcccatctcactcgatgcattgtctgtcacaaacccgtatggctggtccatatagctcacctcctccaactccccattaagaaaagttgtttcaacgtccatctgatgaacgataagaccataagaggctaccagaacaaataatactcaaattgtggtcaagcgagcaactgatgaataagtgccgaaaaaaatcattgccttatttttgggtataacccttggccataagtcctgccttatacttttcaattgtaccatcaggcctaaactattttcttgagaactcatttgtatcctataggtttgcagtcgtatggacactcgacaacttcgcaagtaccattagacgtaattgagtccatctcactgcatagcgcttccttccaatagtcagcatcaggagatgaatataccgagatgaatatacctcttctatggttcttggagtatcatccacaaggtatacaatgtattcatcatcaaaagactttgcagtcctttatctcttactctttcgagtagctatagtgttatcctcctcaagatttttccacaggcgttgttcatcgtgttctatcggcacaaaagactcggggataaaata

SEQ ID NO: 51422 - DNA, 3170 bp, Oryza sativa
tcatcatcattactcacatagttcacaacattattacatgggtcatccaacattattacatgtgtcatccacagaaaagcggtacaaacctcggttgtcataacctttagcaacaaatgtttcatatttagacaggacacatttattggactcaaacacaagtttaaaattttaaacattgatcgtgccaacacatgcgaaccgttctgcatcagcaaggaggaatctctcctgacctgataaaaataaaacagggaatatcaacacacaaccaccagtatcaacccaccacttaggtgaatgaaatacataacgaactgtaggtaaaaaattaccataccaagatgttactcctccatcgctaataaccatgtttgcagattttttgaccttgcgatcagggcaatacttggcccaatgacgacttaacacacacacacaaagcagttatcctttgcctttctcttgccttttttttttaaaattggttatagccttgggtttgatatcatatatgactttttttcataaaattagttgtagccttgttgtgggatgcttgagcattccttttctgcaccaaatgctaaaacctccctcaaactttttgtcgcggttgttctttgctatcaccttctcctcaacacccaaagaggcaatgagatcaataacactgaacacttgcctcatgtgttttagacaagtagcaaagtccaaccaatatgtcatctatcacaaacttgtctagcaactcgtagatgttgttctcaagttcctttggtagtgcctgaaactcatgagcttgttttactatagaacggtcatcgacgatcttatactcatagcaatgtttcatgacatacaactcactgccagtatcgaagactccgaacatggcctcaagtgcatcccacatatcctttcgtgaaggcatgtgcatgtacacttctactcttttgttggctaatacacttatctatgctccacggaacaagcaattcgcgaactcgaacttagcctcctccacaggggagagaccgtacgatcgtcttgccctatgaaacaaagaaatattgcatagccgtcaaccacaatagtgcacgtgccttctatctcttataatttgaaccatcaattgcatgaggtttaagtgatgcagcaaaggcaactaccaaaaagacctgtcaagtttttggattgttgaaaatataatcataatctctactatcataaaattgaagatatttttctggtattttggtaagtcatccgtgcttgagtcggttttaatttcttgtttcggttttaatctctactcctcaaaatccgtaatttaaaaaagggcgaaaaaaatcacacggaaaaagaaaacgcccataaaataacatgaaagataaacagggaaaaaaacgtccgattcgtaccggaacgaaaaaaaggcaaaaaatgctgggtaaaacaaaaaaaaccgaccataaaaaaatgcaggacattggcaaagtacttcagatataacatgtactactcactgtagttatgtggtacttctattcaattaatcatctctcagtacacattgcacaaagttataagttctcacccgtagtttacattaggaccagttcgattattgtacttgtaacgatgattcatgctgtcatgcatgcataaagcggtgcgtggatcctacgtatgccagccattaatggataggttattatcatttatattctcttcgtctcaggacaaaccaacttaagatataagatgctactcaactaaggtcctgtttgtttcagcttaaaattattgtaatctagactattaaatcagattactctaagcaggattataataagctgacataaaataagctacgagttgtttgtttctctagattattagagtcatctaagggtagtgggtcattagccacttaataatctggaaaaagctcctctagaggagattattggattatagtaatctggcttatagattataataatctagcataataatctacttgtttgttttagcttactcctaataatctagattataataatcctaagctgaatcaaacagggcctaagccaaccaaagggggtgaatggttggtataccaaaaaaccgaaacttttagcggaaataaaaatgacccccaaattcgacggagatcggtctgaccgcagttgtccagccggtctgaccgcgcctgtgccgtcggtccaaccggtgtagaacgatcggtctgaccgccctgagatcgcctttacgccgccggtctgaccgcctttacgccgctggtctgaccgccgtgatgccgccggtctgaccgccggtgtgtcgctagttagaccgccgaaatccggtgaaatacaaatcgaagaactcttaaagtgggtgactactttattgattctctctgtgtttacaaactcatactagaagtcctatacaacttaggaaaccctctagtacaagaaacaaactttacataaccactcataccaaatttggactcctttcaaattcgactccgcattccatacacacacaatacctccatcgtataccatatggaatcttcaccaaccatgtgtattgaactctagccgtagtatcccgtatgatctctgaccaccacggacgtcgtcttatccccaagccgactcttagtccatcaccgcaaatactctcctgccatccgagtcacctacacatagaacaaacaaagaaatcatattccgagaccaagctatctccaaccttgactcattagtagcaaacaacagtattacatacgtatagtatccatctagaagccataatcatgaaacaatcacggatatccaaacaaacaacccgaaaccgaaaccgacacagagtccgccggtcagaccgcgggctgcaccggtctgactgcgcgatacacgccggtctgaccggtagcacatgcctggtctgaccggacctattccagcagtacctgtagatttacctgtgaaatccaatcatctcctaaaccacttggtgaataaattgtaaatatcaaaaccaataatctccgatgccaattgttcatcacagaataacaatcaaaaacacctttaattttacagttacatagtctagtataacgaatctgaatatcatcatgtccagat

SEQ ID NO: 51423 - DNA, 936 bp, Oryza sativa
tagggtttttatcaaattgcctggatagtttcaatggacaaatggatcaactggagcaaagtattggcactagtaaccgggaacatatcctatgcacactccgtgcataccaactagcaaatgccacgaaaattctacaaaacattatacacatacttcgaataatattacacctatatgtgaaattttatcttcaaattcattatattttggtcgtaataaaaaagacaaaattctgacacatttttaattacctagaaaactgtcagattttttttgttacggctaaaatataatgaacttgaatatgagactttatatatatgtgtagtactaataggagtaaatgtttaattttatagaatttttcgtgatatttgttagttggtgcgcacgagaaacatgtgtacatagaatatgttcctggtaaccatatatgatctttagtgagttacaaatatcctaactattttcatatttttcattcgtaggaaaaaaaacaattctttagcttttgcatgtcagtcgtacatgcataatatatataaacattacactgttgatatatagtaatatatattcatctcaagtgagcattcgttattattttctattataagttgataacaacaaaatcacaagtcaaatgtatttgttatcgttgctaatgagaacttatgatctttgtaggcataagcctgggattttctttcctgatagttgctgcactttttactctaatgatgctccaaaagagaaaaattaatgagtatttcaaaaagaatggtggttcaattctacagaaagtggacaatatcatgattttctccaaagatgatctaaagaaaatcacaaagaacaattcacacgttattggccaaggaggttttggtaaagtgttcaaagggacgcttgaagataatacaatggtggcag

SEQ ID NO: 51424 - DNA, 873 bp, Oryza sativa
ttttcccagaaaatttgagtgcattgcatcaacccttcgctcattcatcttctcatacattgcaacaagaaaaactaatattataaaaaatcacatgattaggttacgatttcgatgtcaatatagttttgaaaatgataaggtgatttttttggataatggattaaattcctgcctttacttcaaataagctacaatcacttattacaaaattctctcaaagagagcaaacattcagaccacttcatagcgacgggcacgtccagcaagaacagatccaatatacatcatcaccatggagaccaataccatgtagacttctcacagcatgactgccagcaagcaccacatgtaggcgtgagcgttaacgaaggaacgttaacatagagatcgaactaagaaggcaggtagatcgccattactcaccttgcagcacgggatgacttaatgttgacttccccaaccatgagtggcgttcgacggttggagtccgatgatcattattggtggcactagcattatactacctctaatgttttgacttttttctaagttaaacttctatatatttgatcaaatctatagaaaaatatagtaacattttcaacacaaaataaaccaatttaataaaaccaattatattcaattctagatttaataaaagcaatttggtattgtaggtgttgctatatttcattataaatttgattaaaattaaagaagtttaacataggaaaaaaatcaaagtgtatatatggtaccaacagcagcagcagccgcaatagccatcagagggttcagggtatcgccgtgtcacaccctgaagttcttctcccaagcctaaatcattttaataaatgaccccaagatgat

SEQ ID NO: 51425 - DNA, 1963 bp, Oryza sativa
aatcgcgtgcgatgggatcaccgtccgatatcccgatccaacagataatatcacatgtgtctgttagggttggagtcaccatcaccactacggaattttaaagcagtagagattattgcagcctagttcaatttctctgtatatctctctctcctgtttctctttctcttcgatctctcgtttctaacgatctctttcctctgtacacaggccaaagccagcccagcccaacccaagccgccatcctccccactccccactgcccacgcacggggacaccgcttctgcttcgtcttcaatcctcggacgtttttcctccatgaaagcagcaacgtatccactaattcccatcacccatcctatcatctccctcatcaatcttactgtttaatgccaaaaatgaaactacctcgatgagctgaatccgtttctcaaacttctggtgacctctctaccttcctcctccacacacaccactgagtatgaatggccgtttttttttcttccaatctactcactaatcccttcctctcctgaatcaattttgtcgaagcaagatttcggcaataataaaaggggtggctatcaagataggaaagtggatgggtttggagaccaggaattttatacaggttcagggccttcttattcaaaaagtaataccctactcctgtcgggggattgatccgccgagtatattattgatcgtatgatctgggtgaaattcgtgcccctagaggcacccggacccctccttatataggggaaggggtccgtattacaaaatacagtccatatccctaacggaatatgtagttacagataaaatacaatcgtaaccgactaggatctcagatattttcttgacatacaagtttacattttaacctgagtccttctaaagatattctatctacacatggcaccccatacccagtcggactatacatgccgtgtaggtatggggtatccataatctccacaactaggttgtttacctaggaatagatgtcacctcctttcagccatatttctatctaggtggcagcctagtccgattacttggcctctacatagtggctactgcttacttgcttagcattttctagaatactgaatagaatttagaaataatatcatgtcttagccaacaatatgatagtgtcaaagtaagggtatggaaactggtggcattcgatattggaccgaatgagcctgaatagtttaattttgaattagaatgttattgatttcttatagatgtatttattctgcctggttactgactagtaataggtccggctaccggtcactggccggtaaacattatttggattcaaatatttccagtaagttctggtaaccagcaataaccaaccaactaccagcgttgcaaaggagacctgcatttttgtattgggttttaaaacctcggttcaagcgaaaactcaattacttggagatggaaccatagcttgttagtgtttgagttttgtcaatttattctaaattttacttggaaactatgtgtagcaggaatagtaaatggtctcatttatcaattctgcatgataagtgcatgcttaagtttgcttgttctcttgggtagtgtttggttgatgggatgggatgggacgggaccaacccacttttagaggtgtttggtttaggggtgagtggaatgggttggttcctagagaggaatattcctctcagatccgggaccaagccatccggaaaaatctggcggacgaactcatcccacctgggatgagcgcacggcgtgaggtgccgcttcgccccgctcgctcgctcacgtcgtgctctgctcctctgcccatcgtgctcgctcgctcgacgacaacggcgcgctcaagcgatggccacggccgatcccgtggtggggagggcggcggccgcgcctatcccgaggtgggctcacgcgacggcggcgaatcccgcg

SEQ ID NO: 51426 - DNA, 1661 bp, Oryza sativa
aacttcataaatattcaagcaaaagtcattgagcaacatgacttcaattgttccacttgcaacaacaaattcatcagttctattttctcttgcatgtatagactccaaatcacatgagtagcaacatcattcttcatatcagatgacaagtgattagccaactgggacatgttcaaccaaaaactctgtttctcttcttcctctgaaacaacggccatgaaccttactggtttttaagctgctatttcgacaaccagatctgccaactgccaaacaagctcattcatctagttttctgtgcaaatttctgttgctacaatctctgctctattgttttctgaaacatgtatcccacagggcgactaattagccatagaattaaaaaattcaatacattatttcaattggaaattttctagacagctcataaattttagaaacaatgaatacccataattttaggtagtatttccagaaacatgcagcttcagtttaggagaccacatggtggtcgcatcctggcggcgatatctgcagagggtcaccgccttatggcctaaacagcgaggggctccagcagatgaggcagggagaagaggtctctacctgcacgctgagccgcccctcctcctgcgcgtttagttgccccctcgcgctgccgcacggcgctctcatgcctgcttgctgctcggtgcccgctcaccgatgaaattagcccgccgctgctgctgttgccatgacgagagagccagggtttggtatggagaatggggtaacacacatgtaagggctgtgtggctaattgatgttgtatttgggggtataacaatccttttattctgtaaatcatttttcattccctttttcttttctttaactccctaattcttggcacacctaacaaacatccaaaccaggggcaaacgggagcttcggttacaaaagtgatggcaaaatcataaagtaaaaaaagaggggtaaaatcacaattgtgtttgaaaataggggaagaacacaatttccccatttaatttacattgagtggttctcagggatgtcagggactcgtggctgatgtttcagaaagtatttttggccaccactattccttgcaaagcattttgttccatgttgttttagcagtgaaaccgagactctgaaaatgcaatgctctatgctgctccctccatcccaacatataatgcacccacaattttaggaaaatcaacatttgcaaactttgactaacagttaaagtgtactaataatataatgtttagtgtcatgcatgtgacatcattagattcataaaaatatttttcatatgatgttaatttgtgtagtttttgatgatatatgtatgaaattaatggtcaaagttttacattgaagacactgcaaaaaaattatacgcctcaattttttgggacggagggagtattgaacttgatcactaaatctgaatacatgatactctagttacattccttttgttagctagttctgtctgatttcaagaatatatttagatatcttaacattttcttgagaccaccaaatgtccctgtttggcgtgtttttttacacaatttatgattttgtttccgattgtcaataatgaatggctaacaaccttcttatgcagttattggaattctaga

SEQ ID NO: 51427 - DNA, 1070 bp, Oryza sativa
ggtatgctgaaaaggtgttttttttattgtagtatactgctgctagaactgcataacttagatatggttaaaatatttattgactgcagttgcaaataggaaagccagtggtagttcatcccagacagataaggattacattcaatctttaaagggtttgtatttttctaataaaagcaaatcattttacatttattaaggaaaaaaactgacataatcaaatatgtatgttacagcatcatacccagaacgatcgtactactgacctccgacatatgaatgcccattttgtggtgccatcttttggtatcaagagagagttaaaaccctctctgctgtctcgaaaagaaaaatagtttacaacctatgttgcaaaagtggcaaaattgaattgcctcctttatgtcctctacctgaaccgcttgcaactttattgaatttcaatggtgatgcacgttccaaaagatttttgagacaaattcgatcatataattcgatgtttgctttcacctcaatgggtgcagctattgacaagtcaattaataatgggaatgcgccttatgttttcaaaatcaatggtgttgtgcatcacagaatttgtactcttctgccatcacgaggtgcaccacctaaatttgcgcagctatatatctatgattctgacaatgaaatccaaaatcgattaaatattttcgaaaatgattgcgacaatgctgatagaccagaccctgaaattgttagcgccttaacacgcatgtttgataccaataatgaacttgttaaaaatttcagatatgctagagaccgcctctctgaacatggtaatgaaaaaataactcttcgctattaggctgcaatgctaaagatgatgtgcagtataacctaccaacaagtggtgaaatagctagcataatagtaggcgatttttcagcaaaagaatataaatttggtgtgcttgttcacgataaagatcatggaatgcatcaagtgttttcattgcatccatcatatatggctttgcagtatcctttgctatttccatatggtgaacgtggcttccatctaggcat

SEQ ID NO: 51428 - DNA, 2192 bp, Oryza sativa
aacgctatgattgcaaaacttagatcacaaaataagattgtgctcgctgttgcctcatcaggtgtagcatctctcctactacctagaggtagaacagctcactcccgatttaaaattccaattgacattgatgaaactagcatttgcaatataaaacgaggaactatgttgcctgacctcctcattgaaagtgcacttattatatgggatgaggctccgatgacacgtaggcactgttttgaagcattggatcgcacattacgtaacattctttctgaaacttgtcctacaaattcaatcataccttttggaggaaaacctgttgttttgggtggtgactttagacaaatcttacctgttgttcctaaaggttcacgcctcgctgttattaatgcatcaattacaaatttagacctatggaaacatgtgacgttgttatccatgaatataaacatgagactgttaaatccaaccctaccagaaaacacaataattgaattgcatgaattcagtacatgggttctagctgttggtaacggaacattgcctatgattgcaaaagaaggtgaagctcaaccctcatggattataattcccgatgatcttcttgttgtaacagatggtgacaaaatcgttgctattgtcaacgaagtgtatccagactttcttgcatcatataaaaaccctacatatctatcttctcgtgccattgtttgccctgcgaatgcagtagttgatgaaataaacaattatactattgatttactcccaggagaatcaagaatatatcttagctgtgatacaatctcaaaatgctcagagcaaattccagatttcgacctgttatacccacctgaatttcttaattcaattaatgcaactaactttcctacacacaaacttgttttaaaggaaggtgttgttgttatgcttctgcgaaatttgaaccaatcgataggcctttgtaatggaacaagattattagtcactgctttaggggaaagaattttacaatgtacaatactaactagatcaatcatcggtgaaacagtttatataccaagaatcacattaagcacgtcaaaaatgaaatggccttttacattacaaagaaggcaattcccagttcgagtttgttatgtaatgactatcaacaagagccaaggacaaacacttgagcaagttggcatatacctcaagaaacctgttttcacgcatgggcagctctatgttgctatttcaagagcaacaagccgaacagggctcaaaatactgattgaaaacgatgacggatcatgtggaaaccaaacaagaaatgttgtttataccgagatactttctgctacaatggaagcggtgtgccctcactgccatattgcatatattttatctctatatttacctacattcttggtgtcacattgggcatcatttcctattgcaggcttggccgctccatgcgtagctttccctcctcagctaattgcaatggcttttgtatataaattttggagtaaatatattgtactcacatgtagtatatgctgtatcactgctgcaccaataggctactagatttctatgtgctgttttctcacttgcttagttcattacagtgatgcttcatatttacataaactaaatatcttcaatatttatttgcagccttccaatggcgtacgtgcttatttcagaccttatgtatggggacactgataaacggatcaaagcgagggtatctaggcaatgggactaccatgatctgaatgatgaaacaaagatctaccacactgatcttgtcttgctggatgaaaaggttatagtctaattaacactcatttcttctttattaatacttacatacaaacatggtactaacaaggtgctttatatacacaatatgcacggcaatagcatccatgttcaaatctatccacctgccatgattaagcttaggactcttctacaggaagggaaggttactactttgactccttctctgtcagatatgcaaacagaacatataggccagttaccaaccctttgatgatctcattcactaaatggacaaccttagaagaatgcattgctgcttttgatgattttcctgccataactttttcattgacaccttttcaagacgcccggtctcttgcggacagaaatgctttctatgttggtataacctcttt

SEQ ID NO: 51429 - DNA, 2068 bp, Oryza sativa
ttgaagaacgcaggagcaacctaccaacggatgatttaaaggtgtttttcaactcagatcggccgcaatgttgaagcttatgttgatgatgtagtcgtcaagaccaagaagaaggatgatctgattgcggacatagaagaaacttttgcgaacatccgcgccttcaggatgaaactaaaccctgaaaagtgcatcttcggagtactgtcagggaagctgctcggatttatggtgtctcgtagaggcatacaggccaacccggagaaaatcaacgccatcctcaacatgaaaccgccgagctcccagaaagatgtctaaaagctgactggttgcatggcggcgctcagccggttcgtctcacgactcggcgagtgggggatgccctttttcaagctgctgaagaaaaccgacaatttccagtggggacccgaagcacaaaaagccttagaagacttcaagaaacttctcactactccaccagttttggcctcgccacatccacaggagccgctactgttatatgtgtcggcgacctcccaagttgtgagcacggccctggttgtcgagcgtgaagaggaaggccatattcaaaaagttcaatgaccaatttatttcgttagcgaggttttggccgactctaagacaagatatcctcaggttcaaaagttattatatggtgtcttaattaccgtcaggaaattatctcactactttcaaagtcactcggtcacggtggtcacatcgtttccacacggggatatacttcataaccgcgaagcaaacggatggattgcgaagtgggccttagaattgatgtctttggacatatctttcaacccacgaacttcgatcaagtcacaagctttatctgatttcctcaccgagtggaccggtgccaagaagacatgccggaggaaaagatggaatattggactatgcattttgataggtcgaagaggcttacaggcactggagctggggttgttttaatttccccgaccggagaaagattgagctacgtattgtggatacattttcctgtgtcccataacgtggcggaatacgaggcgctgctccatggattaaggattgcaatctctctaggcattcgccgactaatcttccgtggagactctcagttggttgttaatcaagtcatgaaagagtggtcctgtcttgatgataatatgaccgcttatcgacaagaggtacacaagttggaagataaattcgatggactcgagctcacccatgtcctccgacacaataatgaggcagcagacagactggccaattttggctcaaaacgggaaacagctccttcagatgtgttcgtcgaacatctttacgaaccaaccgtgcccagaaaagaaacaattgaagccatggatactcaaggcgtaagcatgattgaaaccgactggagagaacctctcataagatttttgaccaaacaagaactccctcaagacaaaaatgaagccgagcagatttccaggcgcagcagactctacgtcattcacgagaccgagttgtacaagaaaagcccatcaggaattctgcagcgctgcgtatctttggaagagggaagacaattgctaaaagatattcattcaggcatctgtggtaatcatgctgctgcacgaaccattgtcggcaaagcttatcggcagggtttcttctggcccacagctgtttccgacgccgacaaaattgtgcgaacatgtgagggttgtcagttctttgcccgacaagctcacttaccagctcaggagttgcaaaccatcccgctgtcttggccgttcacggtttggggtcttgatatggtcggtccattcaaaaaggcagtcggtggttatactcatctctttgtagctgtggataagttttccaagtggattgaagccaaaccagtcatcaaaatcactgcggacaaagctagagatttcttcatcaatattgtacatcggtttggggtaccgaatcatattattactgataacggcactcaatttaccggcggagtatttaaagacttttgtgaagactttggcattagaatttatta

SEQ ID NO: 51430 - DNA, 1926 bp, Oryza sativa
attcttggaatattgaacaccttcgtcgattttatgcttgggcagttcgtttgtatctttcctctttgactactaacttcaagtttttccttgaagctttcagtcggggggatgctataataataatggaacatgatttttatcaattcaatttgcttacttgatttatcattgccctgcttgattttttggcttagtcaatgagactgaaagttttttaataacttttgcgagttctaggctcaataaggtttgacaaacacttttaagaaatcagaggctaagttagaattgtctagcacaacataaattcatcagtattgtacaaattgatcttccatcatcatcagaatcactgttactaatcagtgtcagttctttcatcatcggaattatcagacccagtcggccgaaggtcggcatcttggaatctctcaactacgtcagcagcaatcttgtcagcagctttttgcgcatcattgatgaggtcgagggctgtttcttcgctcgtcccgtctgcaaacccatcaatggcgtcggtatcgattttggggtataaagatttggtcatggctaatgccatgcttgctcccatactcccagcctccctgatattcttgaagtaagtatccagagcgactcttagcttgtcaaagatctcggaagcgtcaagtgtactcggaccggtgttattgaagaacatggcttggatgagtggggtagcggcattagcgactttatccctggctccttcaagcctattgatcttgtcaactaagacatcaaactgtgcctgggacttgattttgcgatctgcatcaatagattcatatcagcgaacggctataagaacatggggaatcaattatcattaccttcatcatcttttaaggccgagtccctctgctttgctaattcggccttgtctttctccagagccttgacctgcttctctaggtcggaaatcctagcagcttgcactgtaatatttttcggttaattgatatcacaaggaaggcttcacgaatacgtcagacagatatggtatttacctttggacgaaccactcaattcatagttggattcttgaagctcggagattctattcctcagatcatctcagtttttctcgcgagctccttgtcctcatgtagctggtttttagtagattcgagagttccaagatggggaactaatttctcaagagttgtggttttcgcctcattcctgagatgaatcctctgcaatatgaatttatcggcgtttcagcaagatatggaaggggacaattaaagctatgcacaaatggacttacatttacaatatgagtggcctggctgagtgtcttttttagcaagcatacttcttcatcttctttctgcttgcttatcacgatttcttgaggttgcatatcgtcgtccaccacttaattaggatgggagggcgcgagtcttcagccgcctgtatacggggaatttcttcttcatcaccaatcattggtcctaatgtatccacgtataaaggttagacgattgattagagtcatttggatcaacacggtttcgggcaaggtgtttacccgtgatgatttccgaacggggacgagtcgactcttgcgtcttaacgggagattctggcgtcgggtcactgctggtgtcttgtttatgagggttgtctgcctgagctccaacttctggaatctcttggcttggtctagtgcccgactggttttctatcgggggctcctggttaaccccggctctagcctcggccgactcgtttccggttgggggttgatcaccagatcatacattatcggttgctggctggttatcactcggatgatcctcagcggttggctcggtttcttttaagtttgttcccgtgctggtcgggtcagagtcttttcccggaggatctatatca

SEQ ID NO: 51431 - DNA, 1218 bp, Oryza sativa
aaagtcaagagagtctggatcttcacgatttggatcatgtttgctgtcaaactcaaaagctgtgcgggatctctctttgattggagctaaccggctttttatgaagtgccgcgtgatttgttctccttacaaaccctgctcctttagctttatcatgcgctccatcagttccactgcttgggcagcctcatctcctgtaggcaatgaattccatgtgtcttggtagaccgtagggagacaagaatactcgggaagggctggttcaggattttgaacgtagaaccagttggcgtgccagcctttgtttgaggtcttcaagggcatggagaagtatttttggcttagtgttcccctgagttggaaaccagcgcccccaacaacacatggtttgctcttgtttggctggggcttgaggaagaagatgcggcggaacaaggcgaaatgaggcctaatgcctagaaaagcttcgcaggcatgaataaaattggagatatgcactatggagtttggattcagatgatgcaagctaatcccgtagaagttcagaattccccggaagaatcttgaggttggaagagaaaatccgccatagaagaagtgagagaataccacgatctcatgtgtatcgggggtcgggattgcctcgccgaacgctggtcgccacccgatgatttccttcgccggaagaacgccgtgcgccaccatttcttttagattctcttccgttacatcggagggagcccactgactctcgaaactttctctctcttctgccatggatgcaagttgaatggattgatttggtccaagatataggtggaggggaatgaggaatcaatgcggtggacatgcggagaggtttcgtgggattttttgagaatggattggggcggattgatgaaccctagctttgacggtgcggtttgatactgtagcaaggagtggggaaatggcgagagtctcggcggggaaaacgaagcgccgcttggactttggtactttgttagggtatcgggagtgctaacaggcctaggcctgtccagtacttcaggccaatattattaccaggcgtggcccattgtgatccttaggaacttaggcactttttgctttagcaatttgtgctcacaatgatgtgacccgatgctgctaaaatcctttttaatgcgattagataattctttagaattactacgatgcaaataaaaggtacccaac

SEQ ID NO: 51432 - DNA, 2610 bp, Oryza sativa
cttgatgtcaaggtaacatgatatgaattgatcactttgcattatgaacaccaataacttggagttgttcttctccttagcattgttgcctctgttcttgcaactgagaactgtatgcccttgtttcgatcagtggtttaatgtactatggtccctagcttagatagtcatgtatgaatttgcgactaaggaatcatgcatacgataaaacttggtggaaataaacttgaagtttaaaccagaatgtgaccactagtgttcacaagtgatgaacatgaagattaagtacgggcacgcaaaacgagaaaaccattagcacataactaattgagttttaattattttaaacttagaaaattaattaatctaatattgtagataagagcaacttctatatagaaagtttttgcatgtaatacaccgtttagtagtttgaaaagcgtgctaacggaaactgaggtaaaatttgtatcttcatttgctgacaaggccgtagattgaaaagcatgcaccagtggtatgtcaaattcttgtgcaaatttggtcgcagctcatacatcatattgttcaacatttctctttaagttgcatacaaattcagggctagagaaatcaacatgctatccaatgaagagacagtaaagctgcacatcatattcctaggtcgttcaattatttttctgtgcatgattacttacatccatgttcaaatgatagtttatttgagatttatacctgaaccgaagtttatttgagatttatacctgaactgaagcccgtgttattgtgccgtggagccggagaggaaacttatgcaacctgtgcagaactaactataggcctaaatgcatgtgttgagaatacactgctaatagcttgcggagcagtctagagatcaaggccgtagtgcaaaatgttatgaattctagctgcggtattattagcagtcctctaattgatgctgtaagcttcaagtgaaattggtggtcaatgcaatgaaatactctgggatccagttctgtgagggtaaccaatggtttttgccttctttaaaagttctgtctttgtatccattagattgtgtattgtctgtttcccatcggcctagacccatatatagggtgcctcgtctttggcttggtcccacactaattagattagagatcacatggtattaaccaaaacaatgaaaattaacatagaaatgaaaacgttgcatatgcacagcgcctccgacttccttgcctctgtacgtcacctctatgctgccaacttgatcatgtgatcttccatccagcatcacagcatattaattttgttctcaagctttatcttccatagaaaatgtactgctgctacgccaggagccaggaggcaaagtaaaactggaattaaaccatacatgcatgcatcacattcaggagaagcacttgcccatatattctctgataataacctgattaaccattgaacaaccgaattcaattaagtagaagaataaaaacattcggcaagacctcgtccaaataaaataaccgaataaaaatcatcggctgtcaatttttgatatcaacacacacacatatgtacgacgttgaagagaagaaaagaaatgcccatgaaaattatggtgagttctggactgacttggttatatggtaggtcttacatcacattattatttagttttggagtggttggacgaaatagtcgtggctgggatgttgggcttggcttgtttgggtcgatagacggatgtagaatggaaacacccggacgaacaattggaccttccctaaggtaattgcccaagcatatagcatttaataaatatgagaatgcatgaatctaaattagcattactaagcatttgtcataagtgactagggactcataggtaattatgggtacaaaggaataaggtaaaccatagtcaaatgcatgtcacaatagcaagtaggatattcatcattgcatacatttttatttgtaaacaaagtaagttcgcaattgggatcaacatgcttaagggaggggtgatgacttatctgctcaggatagtccttattcttgataatacttgatccaccttcacctcctggaagttgcatgagttgcctcacgactaaccgatacacattctatgataggcgataaaaaccaatattcaaacaacaatcaaatatgctcaaacaaaatataaatgttggagtcatacctagggctgctcatactactctcgtttgcttatggattgtatggtgctaagagatctcaaaatggcggtagcggcttatataggcaagggggaaaattgaggtagcttaggctctaaattactcaacatgcaagcaccttatgggcaagagagcttaggggctaagacttcttaatccttctattgtcatgatggcttatttaggagctaaccaacacacatgatacatacattttgttaacatgccgcttagtctacttactgggctatggatggactatcactacagtggctccactctacataaaatgattggcactagagacgtgaaatggctcatagagtaatctaaatgtaatgattcaaatggacaggctggggattggcttatt

SEQ ID NO: 51433 - DNA, 4495 bp, Oryza sativa
ggcccttcccaatttggagaccatttcccaaatttattatcttttgaaccaacaggcagaattgttttccacattaattctccaatttgaaacgatttttccttcacctttttattgtaagctttagctactctcaatttatctttctcaatctctctcaaagctttcaatctttcatcactaacctcatctattccgtccatcattaagttgtgataatctactgccgacaaattattttgtctggccaatctaagggcgtccagattcacctcaacatgcaaaatggcctcttgcccatatactaattcaaatggtgttacctttgttgcaccatgcttagatatacgatgagcccacagtgcctcagacaaaacctcgtgccatcttttaggatgttcctctattttcttttttatcagcctaattaaagttttattgcttgactcggtctgtccattggcctgagcatagtatggtgatgaacaaagcaacttaattttaaagattccgtaaattcacgaacttgatgtgacataaatgatgatccttgatcagttgtcaaggtttgtggtatgccgaatctatgaataatatgctctaaaataaaatcaatcacttctttatgggtcatattttttagaggaacagcctctgtccactttgtaaaataatctgtagctactaaaacaaatcgatgacctttggaagaacaaggatttatcggggcggatgaaatctaaagcccatccacgaaacggccatggtttaataataggatgtaacatagcagcagacggctaattggatatcaccaaatttttgacatgactcacaccctttataatatgtaaagcaatcttctaacatagtgggccaataaaaaccagctctccttaataaccatttcattttatgagccgactgatgtgtaccacatataccttcatgtacttcacccatagcaaccttgcttggtctaaacttagacattttaaaagcaacccatctacagatcggcggatacaaatctccattaagtaatatatattttagggcttgacgccgaagttttctttcgacagtctgactagggttctcaggtaactggttaaaggttttctccaatcatcaggatggaccacataaatcttaacatgctctagcatcggtctttcaatcataaacaatttacctctactgactcgataacgggatgcttgttgcgctagattattagctagaacattctcttccctagaaatgtgtttaataacaaaatcatctaaatttgctatgatctccaaacatttctccaaatacatattcagtgatccatcaaagcattgataattcctagaaacttgttgcacaactaataaggaatcaccataggcctctatattctttacatccagggattctaaaatttgcaatcctcgcaaaagaggtcgtactgggcttgattattggtgcaaaaatattctaaatggacggatgtctcaaaaatattgcgtttggtgaaattaaaacaacaccaacaccgtgttcctctctacaagctgagccatcaaagtaaagtttccatgggcatacagacgagtaactaaccctcttcatatcatcattaatcctatgatcaacaataaaatcaacaacaatctggcctttcatggattttaaagattcgtaagccaaatcatactctactaaagcataagcccattttcccattctaccacttagaatcggcttttgcaacatatattttatgacatcggtctgacaagccacaacacaagtactagatagtaaataatgccttagcttggtgcaagcataatataaggacaagcataatttttcaatgaacacatacctcgtttcagctcccagaagtcgacgactcaaataagtaacaatatattcttttccctcaacttcttgtgtcaaaacagcaccaataacaccctcttctgcagcaatatatagccgaaatggtatcccggccttaggggctcttagcaccggagaagtagacaaatacttcttaatttcatcaaatgcttactgctgttctgccccccaaacaaattcggtctctttttttaaccgaagtatgggtgtaaatgcattaactttgccggacaaattagatataaacctcctcaaataatttaccttccctaaaaatttttgcatgtctaacttacactgcggcgctgttacttttctaatagcctctatcttggcagggtctatctctatgcccctctcatgtactataaatcctagaaatttgctagacgacacaccaaaggcgcatttaagtggattcatttttaaaccatactgacgcatcctctcaaacgctaaacataaatcggctaaatggtgatccatacattccgatttaacaactatgtcatcaatgtatatctctaatataacaccaagtaaatcatgaaagattaaattcatagctctctggtaagtggcaccggcattttttaaaccaaatgtcataacgacccactcaaataaaccgacaaaactaggacaacgaaaggccgttttagacatatcttcttcggccataaatatttgattataaccagcattaccatctaaaaagctaatcactctatgtcccgatgcatcattaattagcatgtcagctatgggcataggatactcatctttaggggtggctttatttaaatctctaaaatcaatacacactctcaatttcccagtatttttcttttcaacagggacaatattggaaatccattgtgcatacctacacggcctaataaaacccgcctttaataattggtctatttcttctttgatccagtcgtacatattagaattaaatcttctaggtggttgcttataaagcctaaacccagatttaatgggtagccgatgctctatagctctcggctaagtccaggcatttcatgatattcccatgcaaaacaatcgacatactctctaagtaaaccaattactttaactttataatcggctgtcatgttttgatttataaatgtcggtctaggaatggtgccatcacctatatcaactttctctaaagggtcagccgacgaaaaaccttgtcctaatttttctacttcatcaaaatcatcaatagcctcccaaatatcgttcttatttgaccgatattgctctgcacgtttttgtaaccaatctaaattgctttctttattcatttataacatcacactactgagccgagctgcagaagccggctttatagacacgggtacaaaaccatccttagtgacaataacataatcataatcagaaagatctaagcctgttaaacactgaatattaccatactgccaatcaactgaggcatcggctaaagcaacgcaagccgaagtatctgcatgaacaacctctacatcatcacctacccactgtattaaagtttgatgcaaggtagaaggaacacaatggtttgcatgtatccaatcacgacccaacataacattataattaccttgcacctcggcgacgaagaaggcagtagggagagttttgctcccaatagttagctccatggaaataatgtccttagcttctgttggctctcccgtgaatccattaagtgtcaaattagcttttagaagctcactgtcctctctgcccaatttcttaaaaactgaatatggcattaagttcactgtagctccaccatcaaccaacattctagaaataggcctcccattaatatgccctttgatatacaatggtttcatatggcggctcgattcatcaggcttttcaaaaataacatctttaggagcaagacataattgtgcaatctcttcatcgacgaccctaaattcagaaggtagtgtaaaaaccatattaatatccattctttctggaagcggagagccatctctaattaccggggaaccacattctaacagatcatgctcttcatcactgttttcttgaactgaagctgcaacttgtttcgccctccattccctgcgaacacgtaccatgggttcaggattgatatcattgaaaatttcttctctcatcttctcagccttagactgtctcaactcttgtgcgcgtaatctttgcagcctccgcttccgagtgtgtccaatatctggagggcaccattggagctgtttacctttgccgggctgcatagacacattttctccacatgaaccaccaccacaatcagctgctggcactgcagcggaagaactgttcatttcggcaggcacggctgtgattgcggttctgttcatctgggctggtactgtagcagtcggagcactgttcacctgggcctgttctgtaacaaccgcactactaatcactttctaactcacatgtgaattgcccgctcctccactgatcattttttgcctgccaaaactgcactccaatttcctcctgaatccccaccttctttcacacgacgccccttatt

SEQ ID NO: 51434 - DNA, 1176 bp, Oryza sativa
gaaagatcaacttggaaccgaagaccactttcaataaccgtagttacaagggaatcaataccagctaagacttcaagctgcattgttctgtagtcattttgaatagcatcaatcttattgacaacagtttggatctttggcttgtttttgtccagtaccacctgcatgtcaaatgttagagcacaagaaaacatactcaagaatggaagctatcatgcaattagatattacctgagcaataagcttcttgtaaggtaaatggtcatccctcaagttcaagtgtgcaatatgccctactgtctcaaaccctgtaggaacgattattccttctgggagtatttcctctaaaatctacaaaaagtaagattcaatcaaaacagttaagcagcagaaagtgaacagacaacgagcatggtgcataagaatatttatttttttccatgtgaagcaatgttgatcaacatatctaatagaccccacaagtaacaatgtgatgacatgctaatacagtcctcatgctcctggaacatacagtttaatatctaaacatttcggtagatcaaaccattatacagcatttggattgaaaacaaaatctgtggagttgaaatttgtgctgcctaaaagttaattagtaatcccacaattcatatttgtgcctcgataatgcatttgtacgactgagttttcaattgcatttctatgttgtcacatctttgaagcaagaacagagtagaccaatcatctatgagaaaactgggaccagactctgatcttgagacaattcaatctaacctgtacagactgaacttttggtctgtatccggtatttgcaaaggcagtgttacctggacagtacagaagcatcagatactgacacaaatgagaagcttgaaaagaaagaattctacagactttgaagaacttgaaaacaatacagtaaattaaacaagcattattttaaatctacagaaattggataattttattctagaacaaaaggtaagccacaaggggtaaataccattagaactaaaaaaaggggtctcaaaggaactgagcatagcccagttggtaaggaggtaaaatggttcatcttacccacctgggtcagattgacctaggcacctaagtatcagccacttgtgacacatgtcaaacaagacaagtagtctg

SEQ ID NO: 51435 - DNA, 1431 bp, Oryza sativa
tgttcttagcatatatataatttatggcttccagatcaacagacagaagcccagaaggttgaaaacacaaaatgaatggctatttactgcacatagtcaaaccaactttgatgattgatcctttcaatcaatcgccaactcatgatagtagttggctcacacttctgctaactgattctttgtgtttaaatccatgtgtatcctataatattagggattagggatacaactggagactagaacatctcaaggacaacactggcattagataacaaaggaagccgttggtataatgacctaatcaaaaaaatgcactggcacaaaaaacagcaaatacttggacaaaaataataacaagagatgaagagaactgaaagaaaatgatgcttagaccatcaactgtaaacaggtggcaaaatacctcattcattggccagtaattgtagaacaaggtcaattggcattgcacaagctcgtaggatgaagatccatccttgttagtttcatggtccaacacaacctgaaaagttggcttaactaaaactagtaaacagattccactgaaagagaaaatctacaaaagtaagatatacatcatttcttcatgtatcctcttggtatctattttgtaataacttcataaaccttgaagataattttgcaaaaaagaataaaaaataagctaccatttctgggtccaaataaggtaatattgtgtcaaaaccagtgaaatacgtaaattaaaattttaaacaggctgaaagtgtgattttcctcatctggtctcgaaaagaatagttagaaagaaaatactgtctagtctggtgagttcttgtgagtatcatcaaggtagaatgctgaaccaatttggccagcgcacacccaaacctcatttgatcacagttgaatccacagaatcattcaaatagaaacttttcctaacctatgtgatttttatttctacaactgcaactatgaaaggctatttggtgacaagaattcatcaccttgacagcctccgggaggtcatcaaccctcttgttggcatagttctcgtccaggagcagcaaccgggtgggacctcctctccacgtgatcctcccgaacccctcctccccgaccaaccccatccactcgtcgccgtgctcctcttttctctctccgatcacctccaccacatatactttgtctttagtatcccttgccgtagccgcagcctcgccgcctccttcatccttcttccccttccgtttcctcgcggggggccgcgacatcttggcaaggttggggaattgcacgaagcctcgggcgttgaactcgcgggccagcttctctcggcgagccaccgcagttggcagggatgaaggagtggcgaggcttggatggggaacccgggaagaggacgccgccgtcgtcgccgggttggcggac

SEQ ID NO: 51436 - DNA, 904 bp, Oryza sativa
agaaaaatcgaggtagttccaactatgaaataaccgagatagcagtcatgtctttctatttattaataaatttcctgtgatggctttcagattttattgtaccttacataaagttcattgttagcaacctagcatcaaagcttaccgctgtctcagaaaagcatttggtgggaaatcctttttgcacccactagaaattagaaaatacaccattttagtgcttatgttcgtttgttaatgacttgtttcaagtgtatctaatggtttagtgtggatttttttctccttctttatggctcttgttgatatttgttcattgttttggggaaccaggtttttaacatggacgctagaaggtttatcagttcaatatactcaagccaacatgtgcatccagtcacacaagtagtaatgaatttgcccaatgatgctgcagaatttttaggtgggttttcattatttgtgttacttaattgaactgttatcttgagttcttatgattatattagagaacaaatttcattctagtatggtattggcttaattcactcattcgcccgttgtgaaacatccactaaaattctgttgaattttggggatgtatattacaaaggatatgcacggtttcatgtcgggttctctcctctcacttttttactatagaagagtaagaacacacaatgccttttggattgtgatcagctgaaatgtagtaatttgtaacctgcatcttataacattgattatatggcattacacattgcagatttacagaatacacatcaaatgtgaatacgcatcgaatgtttgggagaaaaattgtttgggagaaaatctttcttctacaaaatggcattaccaatatagaaactaaataggggaagaaagtctatgagtggtaggg

SEQ ID NO: 51437 - DNA, 2550 bp, Oryza sativa
agcatttacatggtctaacttacataatttgttattttggttaaagtgagataatatacagttagttcatcatgacataaggatatgatttgctaattgctacccttgcaaacaaatgtattttttctcttcctaagaatagtttttctttctttttaacacatgtatctttggctacgtatttctaggtgatcctggaaccacccacaagcttggaataatatggttgcaaattttatgtatatattaaatgtggtctgtcgttggggcatgtgtaaattttatatagccattgtttcttaagagtaaaataagacaccagttattaaaattctgtgtggaatatcattgtggttattaagctttgaaaatacatagtatattaagaccaaattaatttgctaaatatatcgttgcaggtctaaaatctaatacatcagatctttaatgctaacagccggatataaagaaagtagataaaactaattgaggaacggatgttgtgattaattgaaaagtagatgtaggtggaaaaaattgaatggtgaaagtttgtgattgaccgagaagagaataatggtggagttattatgttttatgacaaattttaaatattagaagttgctatattttaagaagtaccactcaacgatacatttaggagcgtcaagatagacattgtattataagctcctcaaccaaccaatgtaaaagttcgaattaaaggcttcttcacattgctaccacttttaagttttaaccctaataatttttgttctgtaagtatgaattaagagctcttcaccttgcttccacttttaagttttaatgctaataatttttggtgttatcgataacaaactaaacataatattgtatcatcactctaccaaaatttgacatttcaaaagtttcttctcacataaatactagtaattttttttggcacgaatactgtaatttttgataatgctgcaaactaaacatataatgctacaaactaaacatatctaacattgccaaaatttagtaatactaaaatatgccaaaatttatgaatactaacttttggtttggtttattttcgtgacaaactcaaccctgaattccttaacttcacgttgcgcctaggactgacggttttcgttaaccgagggactgcactgcagtccccattaccgttcaccgttaacgggcccgcaattcaatcgatttgttggtcagcccatactgtgccatctcaacgcagcagctcagtagtcaaccaaatgtaactagtctcttcttaccggaatccccacaccttctcgccacggtccgacgcgcaagcgcggcggcgctcgctctcgcggttctcggtgacggcggcctcgtcccactcccgcccggggatgaacggcaccccgttgcgttgccatctctagtcgcgcatgaccacccgcgccggcgcacctctcgccgtcttcctcgtctcgtccctcaagtcggccgccgcacgcctcagccacggcgagcagctccacgcgctcgctgccaagtcgggcctgctcacctccaatcttttcgtccgcaactccctcctcgccttctactcccgcgtcgcccccagcctcgcctaccacctgttcgatgaaatacccccgctcctccgcgacgccaccgcccacaacattctcctctccgcgctcgcccgcgcgggccgcctcgaacgcgcgcagtgcctgctcgcggagatgcctcagagggacgcggtctcgttcaccactgtcatttccgccctctcgcgctccggtcatcctagcgcgccctggccgtcttccgcgatatgctcaccgaggccgtgcagcccaacgaggttcacttgcggaagtgctcacggcgatggcctgtgaccacggggcaccagcaccagttggtgctgcccatggcgttgccgtgcggcgtgggcttgatggatttgtcatcgtggccaccaacctggtccatgcatatggagcagtgtcacaggttccttctgcccgttccatattcgagctaatgccagatagaaacactgtcacttggaatacaatgcttaattgctatgtcaaggcaggaatgattaacatggctgctgaggtgttcggtgtgatcccagagagggatgaggtctcttggttgacaatgatagatggatatatgtgtgcggatttcctactgcaggctctcaggacatatgttgcgatggtgggtacggtgggcataagggccaatgaggtgatacttgttggtttggtcaaggcatgttctcgacattccgctgtctcagaagggcaacaactccacacagtcattctaaagaatggttttgacgctcatgcatttgtacaggctaccctgatccattattacgggtcttgtgattttattgaccatgcccagatgcaattcaaattgtcagacaagtcacacgtagcttcctggaatgcccttatggctagcctactcagaaggaatctagtgcatgaagcaaggcagctgttcgatgacatgcctgagagggacaccatt

SEQ ID NO: 51438 - DNA, 3423 bp, Oryza sativa
ggaaaagtagattagcatcacttatggaggtccccttggcctttgccatgttgtcatttggataattgcatctccgaacttcgatattcagtgttataagtgcttaattgacatgtctgataattaataatcctaggtcagtgatgccagcattcagtcttcggtacatgtttagactcttttactttttaaggtaaatgaatgacatccatgttcaatcgtacaaacattgtagtaatatggccagttctaagtgaatctttctagcattgatagtagttatttggtgcagtttgtatgtgaatacaggactacaaatattaagtaccacacatattttgtgtgcgcacggttttgtttcagttgcaagatgcattttgaatttgtaaaaaattggctcaaacaatctcacttgaaaagtttggagatgtaatgagatgttctgggtacacaaaaagaaaagttaaatttagtgttaagagtgtgattacttgtgttgtacaatagacatgtcaatcatcctatgctcttaaatcttaatccatgcttttttagtccatacacctttatattatttaaatattttgacgatcatgttatcttttgtaggttttagaaatatagctccctcaaggaacaataattcttatagactttgacacagtagggcatatttcggtcttcagcttcacatatgaacattaggttacaagaaactcaattgtcaggtaatatctcattatataatgcatttgttatccaatcttgtatatgctttcttttattctaatacaaagttttgaacttgctgctggtgctactcaaaagcaaataaaatatccaaactattgtcaacaagacagagatgatattttcaattattatggaattttttgcaatttgaaatcttggccggtaagtgttcccttacaacagtcactgtgtaacctttattgtcaaattgatattgcaactgtatatgttcttatcctctccttgttcatatttgtcggacatcgtttaaaatgtttgtcatggtataataacaaaaaataaaagtgattcagtcataaatattatgactgaaagcaatgcacttatttgcagcctagtaaaagagtggagctataacaagtaaggggaaatagaaaaatggaagttcatatgggacacgtgatagagatgattggaatccagaataaacagaatttagaggatgctatattttggatgtaatcttaatattatcatatattaacatggattcactctggaggagaaattaagacatctcattggcacattcatgtgtataggcacgaaattgaactaaaatcatgcccatacatgtggataggcacggtttttgcccatccaaatcctggccttatggaactgacaagtcctgtaaaatgtcatatgcgaatcttgaccttgtggaactggatgtcctgtaaatttttagatgttacatttccaagaagaatatgttctgtagacaaaaattgtttttctaataactagcattatgcctgtgtgttgcaacaggaggaccattatgaaattttctgagatatttagaaattattttgatgtatttcttatagacatttaatgtgtatggatttttagaaacaaaaactattttgaatgaaagtctataagatcttttaggctgaatctggatgttcccatccatccctcaaacccacctgacgccctcttccccagggacctagcccaccttattttccaccagaataagttcactcaggtccctcaatttgtcattgagtctgaaattcatccctgaaccgaaatacagatactatgtgtccctcaactcccaaaaccatttcaaatagggttaaaatgaggggctctggtgtgtgtgcggccagcaggggtgaggggccggttgggaattgagcagcaaaaagtagctgccccaatgttaatgctgcagtgcaaggtgtaccttccccacctcttttctctgtagcaaccttcatttgctgagagccaggcacattaagcagcacacatcctgaagcgcatccaacggtgcagattatgggtgcagatgctccagagttccaaacggcattttcatatattctggtcatccccttgcaaacaattgtgatatgtaatagtcaatttttttcaagaattcctttccgatctgaaataataaaatcataaacatggctcacgcgcagaggatctacccaaccagcagggcgccatcaaaacctggtcttccactactatggaaaggaatcaaccgagaccgagcaaggtgccgagcttatcctccacgccatcatggtaatccctagctcttgtagcctcttcctagggccatagaagctggcgcctccaacaattttggcgaatagcgcccatagccatgcagacccgaggggacattggtcggtcgtggagctcacagtggacatgccatcccaaagctcctctcacccaccttattagcaaaatcgaaccccaagacgctctgtacactcctccattcaataaattggccggagtccccgactatcgccaaagccccgaacctccttgagctcggccatggcgttgccatgccgcaacgctcgcccctgctccgccttgcgccgccaccacaggtggagggccgtcggaacccgttcgcacctcccttggtggtagccgagccatccccggccgagtccgcctcgcaccagccaacgctcatgcgtctacttcccagtccagaggttgaagacgacctcaggccgattttgactagagtcaagcacctgtcatttggtctacaaaattattcttaagagaaataatttggtaaatcagataaataaaccttagaccccacatgtcagccatggtaggttgtggataatgtttcggaataaaaataaatcaattaggaacagtactgtttcacaattattggaattacttcaaatttgaatattgttttgactatatctcactcattttagctctgatttgagtgaaacttgaacctgaattcatctaaatttaggagctttccaatggtatataattaattatttaataaaatttattttataattataaaataactaatgtcaaatggttagataatggcaaacctaaaaatgtgctaataaatgaaaattgtcattgtacagtaaactaggtaggagaataattgtctttaacatgttgtgccactgtagaaaccatgtaaatcaattagaagtattgtttcgaattaattgaagcttaggaaatactagtgccatttattaatatatgtccatatataattatacacatgacttccaaattatataaatgaattttagccttatatttttgtcactaaaaatatgaatacatatagatcagtccttagattgtttgtgagga

SEQ ID NO: 51439 - DNA, 711 bp, Oryza sativa
actgtcattttcattcacccactaaagaatatacaagatggttaatttgttataggccgtcctcttaacatgcaatgtaatttggctttgcaaacgccacagatactggaagggtaaatgatgcacaaagcatccattttccaggagcaacgagccgcactctatgcatttcaacatcggacacgttctcacccagcctcaaatttatcctctgcaattcaaggggtgtgtgtcaatcgataaacagaactatgtatacaacagttctaacttaaagaaaaaaaattttggtaatactcgctgcttacctcatggaagtcatattcaggatcttctgctttggagaatccatacacgtgtatatttggcattacacaagaaggcacagccaaatggtggttccatgagattcctctgaacacatctggggaaacagtgaaatcataaaataattaattggtcctgtgattagcctaactgtcaaaattcccatccaaaaaacatcggctgcatattggccattagaatggacaggtaaggttagaactaaatttcaatgttcaccctttttttgcataaatatactattttttttaaaaataatagaatatacctgatttgccaggtggcatgacaacactgctgttgccgctcggcagcagacggtgtcaccatatggccaggtaaaaccgaccacctgatgtccctaac

SEQ ID NO: 51440 - DNA, 1350 bp, Oryza sativa
ttgggttaaatttatggacgtgacagtgaggatgccacaccctcacaaattaagcccttgacgtttctcatgatgagactgtctggtgatccaagaacccagtacactcaccccattaccttcacaatagccagtttgctctgggtatgaacaaagatctttttagtaatcaaggtgagctagatgcttagcatgaacaattacataaaactagttatactcagccgcgttgctgtggaacattacatgccaaatagctaccattcttttaaagatgcacacactaagaactgggcatgaaaaacataaaagaaagcaaaggcaatgcagatgattgctttatgtaaaactcgatgcatgtttacaaaagaaaaaccgctcagtattagtatgctgcaatggaagattaatcatttaattttttttttgggatcaacttactcaatgtatcgtgagaacagtgaagctacaggagaagcaggcaggttctgctgttctgcgtcgaagatatatacttagggatctcggatcagccatgatccattgttaaattaagggcaagataaaaatatactccatctgtcggcaagataaaaatatactccatccgtcccattttaagttccatccgtcccattttaagtgcaatcataagtttccgtgcttaattttaaccgtttatcttatttaattaatatttttattgttataagatgataaaatatgaatagtaaaatttaaataagacggacagtcaaagttgtgcataaaaaatcatggttacacttaaaggagggagtaagatatatataaagggaaagatttaattgctaaacttattagccaacttgaaaaaagaaaagaatattaacattagctaccaaaaccaagctgacagcagaaggaaaaaatagtgaatctttttttagatgaaagatcattattactccacagattaggggaagcgatgatgactgtggaaaaatcaaactctgatagcaataagaatgagaatgtatcacatagaaaatgttgtgcgacaaaagaaaatccaaggaatgatctgaccttcatgaacactggatgcaaattgactgggacgacggtgtgaactgtgaagtgtctgcggcagcagaggaagtccaaaagccaagctaagaaattgtctgcgagaaggatggaaacctaggcactctatcaagtatattatgtgcgtacgattttagagttacctcacccaccggcaggcaatccaattcgaatgtgcataactcagaccagaagtccagaaccaaaacttgattatagcaaaataatagacatgaatttctccgagcgcccacatacgta

SEQ ID NO: 51441 - DNA, 724 bp, Oryza sativa
atatgcgtgtatctgatctgtacttcaagtcctagagggcagactacctgttagcttcgtacgttgtttcgggccatttatttccctccggaagaatattctttatgagtttcaataactcacaaaatgccttgtcagtcacaccatttttttgccttccattgaagaattccagcgtattacctaactttttatgccctgttcacagcctgggtacaagaacattttgtggtccgttaacatacgctcaaatttcgtgacctccttttcactttcgtagtccttctttgcgtcgtacaacatccgacaaaaatcatctgcactgtcattttctgcaacaggcccgcctgtcgcgcctgttgtattttcttcaaattcaccgaattgagcctaatctggaatgttgttatctttttcttcattttcaaccattggaaactgtcaaggttacgggtagggtataccctctacccttcgatatacgtcacgtatcgatatggtatgctcacgagtatacggacgtgttcgtcatacgttaaggaaattcatcatggagttcacaggtagaaggagtcctattcggtcaaaactgggtcgtcattgtgtcatgttcggtccggcttctccgagtcctacttggagacagttgacctgcgatataaaaggaacccctcggaaggacctaagcatcgaatctcagagccaacacatccaccacagccta

SEQ ID NO: 51442 - DNA, 1010 bp, Oryza sativa
tagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgggttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgggaatcggtcgtccgcgtgccattcaattcgttgatgatgcgggtgtaatcctggaggagcatcaactggagaccaccttggggggcactctcagtgtctatcagaatgccacgggcaagatctgcggtgtctggcgaccagttccccgtgattacaag

SEQ ID NO: 51443 - DNA, 778 bp, Oryza sativa
gcagatggcttcgccatagcaagttcaacttcaaggagacccaagacgccatcttagccgatcaagcccaggggccactgggccagcgttccccagtcggcccactagaagcccatgtacctcaattacactatatacccatgtaaatgtccctttcataagggcaatcatataaattcccctgtaaaacctaaccctaataggggaacctgtaatgggattataaatagacccctagggtcatgtaaaaggggggatcctaagaaaaattctcaatttaatacactttaagcggttgtcatttcgacaatagctggcgccaaccgtggggacctccgagcgaaaccactgagagcgaatgccaccgaagaaggtcgcaaaggagaatgttgcaaggcgtaaggagagtgaagcaggagtggagatggcagccgaggagggagcagaagccttcggcacttggtgccgaagccgatgtggtaccatcgactttggcccctgcgccgcaaccaccaccttcggctcctactgcttcgacggggcaggcaccgaacacagtcgatgcggcgaaggcggtagcagcggcaagggcgctctagaccagggcggagatcctttcgacaagtcaactggtggtgccccaggctgcttcgccgcagcaggctatagcttcgaccgcgcacagcacaccggaccaacctcaaagcgcaagccgaagccaacatgggggccatgcgttagaatatggtgcgactcccggacatgcttcgtcaaatgc

SEQ ID NO: 51444 - DNA, 729 bp, Oryza sativa
ctgtcggggtctcccttgcaattaattaagatagtctgcacgcgcgcacgcactgcacgcacatggttactgcattcaggggaagctcgcacgtgataataacttgttttcatgggtcgcaaatgctctctaaaacttgcagtgcatcataatttaaaattacaaattaattccatctgctatgtataaattaaacccgataaaaattttaaatacataaacatttagggcgcccttcatattgtactgccagtacataaacatttagagcccctttaatttgtagaaaaaatataagaattttagaggatgttaatcctattgaaaaaaaaaaatctatgaagtcctttgaaacaaaggattgaatcctctcgaatcctttaaaattcctatgaaatgggtaattctatatacattttggaggaaagttagcaaaaggtttaacctgttgaaaaattttctccgagtctatctttctaatctgattcctgcgtttttcctatggtccaatcaaacggtcattcctgtgttttgtaattctctgttttacaattgtatttctgtcagaatcctgcgtttttcttattactctgttttttcatttctacgattcaaagaggcccttaagataggtgatttttcatatcactataagaatccagaatttttatgggactacctatccgacatgcaacataaatctaggtaagaaaacagtcaccttccaca

SEQ ID NO: 51445 - DNA, 904 bp, Oryza sativa
ttgacatcgtccgattgatttatcgtctgattcgatgtcgattctcctccactttatggttattctctgtaaaaggttagtaaacctaatactagtggaatattattattctaacatgaatatgcattgcaagcataactagttctcctctattttggtaatattgacggttgaaactaatcgcttacgaccgtcaacaatgagtcagctacggtcttcaacataggtaaatttgggatgcaagttacggggttcaagtttcgtgacttaaaatatgcatgcaactcaatttcacgaaggctagcagcaaccttatcacattctacaaggagctccgaaagaccaagtttcctatgaaatcttttcttgaagacgttattcatactttcgcaactttgagtcgaggtcatatcagttgtaaaagagtcacggaacacaatagcccacttcttcctcaaagcatacagatttgacatccatacgttatcctcaaacttgtattcactcaacaattcatgctacatcttgttgaaatgatactctgatctgtcctgatagacacatctcttaaaatcagttagaaacttgttaggatgcttatgaattacatgaccaagatttttacaaccatttagataaatgtgccacaaacaaagacaatgacttatatccgggagtacaaaagcaattgctgctgcaatggctgcgtcttgatcagtgaaaattgtgctcggatgcttgcctgacattgctattagaaaggtttcaaagagccaaacaaatgattcaatagttagtgtggataatataaggtaaaggaagtttataacaaagggaaatttcagtctatattgtagcttaccttgcatcccaaatctgcattgtttttttcaaagtttctgtg

SEQ ID NO: 51446 - DNA, 1332 bp, Oryza sativa
cctgggaatactcatggaaatggcagatgtttcttcttcacactgcctggacagagcatctgctgccttgttttctaggccctttttatactttatcttgtactgcaaacccatgagcttcaggaaagccttgtgttgtaagctggtggttaacttttgttcactcaaatggctcaaactcctatgatcagtaagtatagtgaacactgaatgctgtaagtaagacctccacttttgtattgccaacagaatagctaaacactccttctcgtatgtggatagggcttgagatttgacccccagtgttttgctgatgaaggcaatgggatggccctcctgcattaatacagctccaatgcccttgtcacttgcatctgtttccaccacaaattctttgctaaagtcaggtagtgccagcactggtgagttgatgagagcttgctttagtgcttccatagctatctgctggggttggagccactggtacttgacattcttctttagcaagtcggtaagtggccttgccagttggccatagttctttataaaccttcggtaataaccagtgaggcctaagaatcctctcagttgtttcaagttttttggaggtggccattgttgcacagctaccaccttagagggatcagttgctaccccttcaaccccaattatatgacctaggtactcaaggtgttacttggcaaatgaacatttactaagcttcagatgtagctgatgttgagccaggacttgcaaaacccctttaagatgctgcacatgcttagccaaggttgggctgtagattagaatgtcatccacaaataccaacacatgctttatgatccagggagcaaaaatagtgttcataagtccttgaaaggtagctggggcattactgagcccaaatggcataactctaaattcgtaatgcccttgatgagttttaaatgcagttttatgttcatccttctcctgtagcctaatttggtgataccctgatctgaggtccaatttagtaaaccatttggcccccgccagttcatctaacaactcctccaccactggcattgggtacttatttttgacagtgatctcatttaatcccctataatcaacacaaaatttctaggtgccatctttcttttttaccaccagtacaggggaagcaaaagggctctcacttggcctaaccactccctactgaatcctttgagctatctgtttctctatttcatccttctgagcacgggaatacctgtagggtttcaaattgactggtttcacccctggttgccgaggaatggcatgatcaaatgccctgtgaggaggtaa

SEQ ID NO: 51447 - DNA, 2203 bp, Oryza sativa
ctctcagacaagaaattgctggaactccctgagtccaccaaaatcaagatatgttgcttttgtattagcccttccaatctgatagttttcctaccagtaaccccagtggctgcacactccgaaattaccaattcttcatcactactggtttcaccttcctcctttactggttctccatcaacttgaagttggaacacctccaacaactcctccagaatgtggagttgtactgattttgggcacttatgacaaggtccaaacttttctccacacttgaagcactctccctagctcttcttgctgccttcaaagattcaaacctgtcttcccactttggcttttcttccacttttttagtttcctctagaactggccccaatatacctttcccttgatatccaatcttcccaggtgccgtattagcctccttgaaactccctctggtggaaacatagaagttcttcttcccagcttcagctatcagctcctcctgtattttggcgagagataacgcagcatcaactattctcggcttatgtagcttaatagcaaatttaatctctccctttagccctccaacaaaatttgtcacaaaataagtttcatcgtaccctttgttatacactagtaccctatgcatcaactcctcaaacctcttatggtactcgtctacacgcccagtttttgtaaaactctctaactcctctaagtggtcctgatatttatctctcccgaacttactatgcacagctacacataactccgcccaaccttctacactgtgcaactcctcataggtctgtaaccacagcgttgcattaccaacaaaatgcagcgttgcaaaggaagcccacgtttcaaacggaacttgatacatgtgaaaatacttctcagaattggactttcacaacttaggattctctccatcaaattttggaactctgtttttcgtaatctagtacccccatgatgctgactcccttgagactgactccgccatctctctgaaccttccctcaaatcgaaatgaatcggagagtggcggaagtgaggcttacccttgaccagggtatgctcctgagccgcagaggcatcagttgcaagaccctggtgattctcgaccttgccttgcccttcgggcggtggtgtcgctgctgttggtgatgccttcggctgggattccagcgccgtgatacgggtggagatcccttccaccgtcttgttcagatcccacatccccgcatccacgttcggaatccacgattccaagccccgcaaggtgcccaggatgttgttgtgactgcttgtgagttccgccaccttctcaccaagcgcctccgtctcgccttctgtcgccaccactctctccgtcagagttgggttccccatcttcctctccgtgttgcgcaaggaccgacggctctggtaccaaagatgtcacgaactgtgatgaatcaccggcgtctcgcctagcgatttggtcgattttggaagtttgggtgattttggggaagaacaagggaagtagttagtacagagtagagagagatagagatagttggtttttgctttcttcttcttcgatgatttagcccccaactcgaaggtctgaacttatagttgtgctttagcacttacatggccagcagccgcatggcccaatagcaacgacccaagtatacagcaaaagtctaaaaggggtacacacatgagtaaaataaaagcagcgtgacaattgggtgatatgggagggactcactctccatggatagattcctctggggtttagtatttcccaagcaaccgaacaaaaccttaaacaaacccatgccactggatgctttaagtttgcctaaccgtcaaccattgcgtgaaaattataaggtgagtcagatattcagaatcggagctgaaaattcttttggaggttaattttgttgcaagagtcagatagtactgttcttggtttgaaaagagaggtggttttcatttcgattgagctgaagacgacgtagtaccaacaaaaggagtatatcaatataatcgataagcccaactattaataacaattccagtttagcttttgcgtatagagaaactaattaattaatacaagacataatttaattaactgatctccaatcaaatacttgttaattcattatatatatattctaacaagaaatttttgagagacatgtac

SEQ ID NO: 51448 - DNA, 796 bp, Oryza sativa
ttgaatcgccctttgcctagcacgtcgtctatttcagccctggtgacctttgatcactgacgatcgtccccaccctaatcgtcgtctctttgcctcttctcccacggctgcagtgggagtctatttgggggcatactattgcagagggacataaatacataactcttgactccgtggatgactacattagtgcccgagctgtgtcatttgcactctagacctttagttatacattaaaccaagattagggatctagatttgcatttttgaggttcatggaactacatgacacctcactccatgtttaaggaccaatagtgtattttatactttgagcaatgaagttttatgcaaaatcctttacaattagtatattgcatgaaattaactgccattggctgctcattaattgtcaagccacagccagaatttgaattttagaacttaattgtagattgattttcaatttttttttattttcaaccttggcttctgaacagctagattgaagtataaaagtctagccctaaaataacttttacttggttcatttgtcttggatgcatcttaacctttaccgtgaaaatctaatgtactaatttatttataattaaccagcaagatttttttttaccaaaatcaacaagcttttttggtacatagaaaatgatacacaaggtcaaaatcatgtttttcactcatctactaatggtatgttgacggaggaagggaaaataaaagataaaatttgagaatgaaggacagggagcagatttcatgagggcaaatgagagaa

SEQ ID NO: 51449 - DNA, 1864 bp, Oryza sativa
atgaccaattcaccctcactgttcctttagaagggagcaaactatggatcaattatatatccgcactaaagcataaaggtggagcatggctgcatccacaattcattgttgatctcattgcgacaagatagaaaattgcaagaacaggagaaggttgaactggatgttaacagtggtcatccatggaaaagctaagccatagtccaattttttttttggacttcatgatggtattgtgcaaatcttcacatttgtgatgataacttgcaacctgctactattattatgataccaaccaaatttactctttctgaaatgtcttgcggaagaagtaatgaattattgtcgtgatgccattaatttttgaaaaatagttgcagttctatgaaatttaatcaatataatattgttattaaatagaagcaaacactttaaatggttgaaaccaaacgactgttgggaaaaagaatgattaccttcttgaccgtccagcaaagcaatgaaccagaacattgccaccagagctgatagattcatcaatgaaactaaagcattcatcaaaatgctttgccaaatcaatgtctgggctgtcaagtactgtatattggtaaacaaataatgatttaggagtgctggggaatttggacaagggcaacacaaaaaagagggtataatcacatcaataggtatttgaaacaccatgacacagtcaagaagtttaagtgctccatgcttatttcatttctcttgacattacagttttccagattgagtgataatctaacatgtctggtaaacttacaacacaacagatgaaaagtacataatttagaagtaaatgcagcacatttcttaaacttgcacacagagttcaaataggtatgtgaacttaagcgatgcgcattattactcctaaatatgcatacttcggttctaacttagttcttactggcaatagatgattgaatggctcattgcttcacttacatgacttcctccctccatccctcctcaccctctctactctctctgcatcctgccacaaccctaatttagttgttgcatccccaaacaacttcctcaaaacatagctggctagctggtaagattgaaccaccatgacaaagtgacctcaggcactgggatacgtgctgtacactacaggcagggagggagggaggtttggaatgttttttctaaatgattaatataacaacctaaaataatgtgtcagatgttcatgtcgaaaccgatggttggatgctttgttttcttatcagaatttttaggattttcattgatttaagataacgacgtaacatcttaagagcgtttataagatgttttttttaaaaaaaaatagatctagtgacctaaaataatgttttatttgattgaaaataatgtgtccatcgatttatgtctaatcctatggttggatgttgtttcccaaaatttctaagaattttctataatttaagaatttcatataccaacttagagttttttcttattagaaaaactaacaaatcgatagtctaatgctttgttcatttttaatatttgctagtattttatttaatttaatagcatcgtatagcatcttaaaagtgtttgtagcatgtttagaatgacagatcaggacctgctagacctagcgggtggagatatgtggtattttaatgtaaaaataatattgattttaatttctcatgaagaaggcttgttggtatgtacttgagagggaggttgtggatatgtgtgttttaaaagaaaaaacgatctaaccttcgaaaatgaaataatagatccaccaatttaattaaaaatcaatgggcaaattatagtatcacttgacgattta

SEQ ID NO: 51450 - DNA, 1022 bp, Oryza sativa
aagatccgctctacttggaggttgaaggcaagtcacgtctccattgaacatattgttgtcccatgattttaaattattgcataaccgctttatttaaattctcgcgttctcattgttttatttagcttttcatattaatccttgttatagccttatcgttgcaatggtttatatcacttcgttcacctaggaaaataaaacccaacaagtgtgtactctatatatggttccaccagtatgaatttagctagatgcttcgctagttaactagacaactttgacttgttttataatcttagactttaggagttatatcatattacttggatattatggagtggttggcttatgttggaatagggcatacaccctttcccctattcaaaaacaccccaaatggtcttaggctaggctcggggtgacgaggtgcatggttttgacttttgagagtagcactttggccatcataaggaccggtctttgggcctttgttgctatgtaataccgtacttctacatgtctaatgggtaaggcttagtttgtagtttagtctagtcatgaacaaaaggacatatagagatggatgaagtcgggtgatggatatctctgaggcaaatgaaggctatatgggcgggtgtccgatagtcgagatgtcatggcacaggacaagcattcgggtggccactctcgaaggatgttctgatgacgtggggcttagccttaacctacctgtcccgggagcctcggccataggcaggcgttgggtcggtgctcttgtgcaaggctaggatgggtgaagaactatgtgacaccctccgctcatttaccatggtggtaagtggcacgtggcaacgcgtgaggaaggcatgtcttgtgggtaaaattgtacacctctaataaaagtataatccattcgaatagccgtgccctcggttgtgggcaagcttaccaatgtacacaagttagtggtttttctcttaaaacttggttgggtttgcttgggatgagctggggcccggtgt

SEQ ID NO: 51451 - DNA, 4807 bp, Oryza sativa
tcattcctctcaagtttagtttagtagtatctagctggtggaatagaaatagaataggagtccggagtccggaagccttcggaagagttcgggtatggctctagcagctttcctttcctcttttgtaagctttgtacttttattagaatactcttctatatacatttatggtattgaaatactttccgagtatatgagtacctactttacattacgttcatgttatactgaatatacggctagcttatctgggagatgctttggtgcgggtatagtgtttgcttatgcaattactctatgtcatgacgatgatattagagtagtatctggtagtttagacgtggtgtctagattatgagatatcattatttggggttatatattgcagatgagagatgggccgctaatggtgacacctcagtacgggtattcctccgcgcctatatataatccgaagttaatttcctgagaagggtattcctccgtatttagccccggttggatggtgatgacgggctgtcgtaagaaactcggcagtcaggggtggcttctcgaagtaccaggagggcatcggatagagggtattagctagtatattagttaactagaatgtatgtatactatgtatattagaagtataggaatagatttgttttctcttttctttccacctagcttagataaattgttatgaggatgagtagaaatgcttgtgtgtcactctacccttggattatcttaacccctgcttagaatatgattatcaaaataatatataaattattagttgagttctctctacatgatcttcccacgggataaaataaatatgatacccttgtaatactctcgggtgaaatgctacaatggtatatccgtgcgcttgcggatgaactctataaccataatataccagaagtgtttctgcgccattgcttggaattatatttctagtaaagtcgttaagaaataccaacaattttgcagctctgagctgtaggcgcttcgcttctgcttcatcctccgggagccagccgttcgagaggtactttaggaacagggttcgccagtcctctgggtcttcatccagctcggcctggtcgattgccatgatattcgggctctctatgggcacacttgatgcgtacaggacctcaaaaaagatgcttggcgaatgcgggcctccacaaccagcagatttcgtcaaggcatatgcttcctcattttggtctctaggtaagtgttcgaccgttatgccggcgaagcacttttccatagattgaacagcctccagatatctcttcattccttcctcttttgcttcaaaggatttgtcaacatgacttgccactagtttagagtcggttcggatgagcaagcaccgaacccccaatgctttcgccttttttaggcccaacagtatagcttcgtactccgatgagttgttggttgtgtcgaactgtagccttgcggcatagcggatcggcacgccccctggcaaagtgagcactgccgtgcgcctgcccctttgtgcaaccacgagccgtcggagtacatcacccaaggttgttcgacaggctcgggttcaggggcgaatgccagtgtccattaggccacaaagtcaactaggacttcagacttgatggcagtgcgggcgacaaaatgcaggtcgaatggagataactctgccactcacttgctgagccagccagtaatttctttgccccggagcacttcgcccaaaggatactgggaaagcaccgtgactttgtgggcctgaaagtagtgtttgagcttgcacgaagccatcactagggcgtaggcaagcttttccatttcgatgtatcgtatcttctccccttgcaaagcttgggagacgaaatactctggtttctggcctgactctgtttcttggacgagggctgcactgatcgacactggcgaagctgctaggtagagtagcagttcgcttcctggtgctgggctgaccaaagcgggtgggctctgcagatatcgctttagctcgtcgaacgctgcttggatttaatttctcaggatttaatttcatacccactacacgtaagttgtcgaaggtctcctgtaagtcggacgcatggtcgaaagccatgcggctttttatgacgatattgtcgacataagcctccacatttcgccccagctgcttataaaggaccttgtacacctgcctggcgaaggttgccccggtgttccttaggccgaaaggcatcctgaatggcaaaaggtgctgaatggtgtgatgaaggctgtcttggggatgtcggccggattcatgtggatctggtggtagccggagtacgcatccaaaaaactcatgagttcgcagccagctgtcgaatccacgagctggtcgatccacggcaaggggaaatcgtccttcgggtacgccttgttgaggtctgtgaaatcgacacacatgcgccatttgccgttcgatttcctcaccagtaccggattcgctagccactcggggtggtcgatctcctggatcaccccagccttgagctgcttttgcacttcggctttcgctgcttcttggcgatcagcggacatcttgcgcagcttctgtttccttagcctggcatccggcttgaccgccagatgatgcatgatgaggtctgtcgaaacacctcccacttcgtcggggccccaggtgaagatgtcaatgtttttcttgagcacctccaggatgttctcaacttctctttcgcccatgtcgccccccagcgatacaaatcttgtggaatcggcatcgttgacctgctccttgatcaccctgccgtggggggcaggcttcggcgcgtgcttcgctcggtcatgcggttcggcctcaacatcgtgcaccgctctgttgatagcggccaaatcgccctttgatgtagccgaaggttgaagccccttgaccacgatcactcctgcagggccaggcatcttgagcttaagataattgtggtgggagatggcttcgaacttgttcaaggttgcgcggccgaagatggcattatagttgtatgggatgtcgacgtcgtcgaacagtatttgctcttcgcgtctgttttcacctgtgccgaaggctaccaccaattgtgcttggcctaggacttgaactgcttctccgccaaaaccacgaagcgaggccggtgcttgggtaagggctagggtaggcaaccccatcttggcgtatgcttcggcgaagatgacgtcggccgaactccctccgttgactaggattcactggatttcgaagccagctacgtcggccgagatcaccagggggtcttgatgtgggaacaacactccttcggcatcttctggcccgaaagagatctgctggttcaaatatcatggggccccttcacccgccgaagtgatgttgtgcaccattcacagctacatcttcttttgccattttgacagttgattcggtgggtcggcccttgtaatcacttggattactctgcgttgtacatcttggcgttgttcggccgggggtgcttgttcttgaatggcttcgcgaggtgcttcgacagctgctccttgttgcggccttggatcttatgcgttgccgctctgccgaatgtttcggcattgctctgtggtgtgcgaagagcgtccgtggaaggcgcagtaaaggtctttcctgaccttcttgcgaacaggctgctgatggctggttgcttgttgggcgtcgaactccttgcggagggcttgaacttcttcaacagccatcacggccttgcctgcactatcggttctgaatttcctccacgtcatgggagcttgacctgacctttgcggttgtccttggttcgccggctgagactggcaaacagcaagaggagttggctcggcgacttgtgcttgtacttgggcttgagcagcgatgacagaggctttatcgtactcagcctggattgcttgccgtcgcttggaatcctcttcgccccttgcgtattcgtcaatgatgcgaagcaggtgctcaaccgtctgcggctccttgttggcgattttccttgtgagttcgccctcgagcagcccggccgaagcggcattgatgatagacgcctcagttatgtcctgaacttggcatcgggcttgcgagaagcgacacatgtactcctttatcgaatccctcggccgctggcgaatgccgagtagatgttgctctgtcttcggctactcataggtgcgtcgaaatttatggacaaagacatcgcgcaattgctcccatgagtaaatgctattagctggtaaattgaagtaccaagaacgggcgaggcagtctagagcaagatgtattacctttgccttggtattttcgtcgccatgagcggcttcgatcgcggactcatagatggacaggaactcttttgggtccgtttcgcccgagtatcgcggaatgggtgggaacttgaactgggatgggattggatgaatcttgattcccccactcagcggcagccccctttcgccccccgccttgctcacggcaacttgctgtagaggcctgtttggatatggcatggcgaagggcgaagtcatggcttgcacgtgcggtttggccacagtgttcggctgcctggccgctaacggtgatgcctgatgagccgccctggatgggtcgaaccaaggctaggtccatgccatggcgacctggtttggcgcctgattccttcccaagcctggtgtccgtgcctgtggtccgatggttggtgcttgagtggcattgctgaactccaattgcgggccttgactccctggcgaagcc

SEQ ID NO: 51452 - DNA, 1140 bp, Oryza sativa
ggcacgtctggtcgaagggtctcataacataccgccaacagttcccatcatgaacttcagccccagtgggctttgggatcttggtttgaggttctgacgacgtgtccgtcaatggtggaggtggccttcctgacatgtttaccgtcttccaccgggcgtgccaaaagcgtgttgatgcgtaaaacaggaggcctgggagatctgcttaactccagtgcaggtccaaaatcttgcctttaggttcgtgagcgtgccaagttcatttgatcctgcaatcaacaagaaataaagacaaagaaaccgcggttaaatttataaatgatagccgatcggctagttgccgatgacatcatttatctctgagccgatgtcatgtttgaatcgatcggcagatataaataagtaacaaaagactaaatctacttgatcggctgtagatattaacaactaataatccttatatcgatatatacttaaatcaagtggttgggatagatcagtcgccataccgagacagtataaatcacttagattgaaatatatattaacaacgagattatagatgctcatagcatagcagatcagatagatctagcatgtatcggctaatactccgataccactctatattaagatattaaagcaagcaaaatatatcaaaacggaagcctaacatactttgttgtactaagatcataatataaaaggcagatctagcatgtcaattaagcatatgaaatataaggctaaatcaggtaagatcgggtgaaaccccgatactaccctaatcggcaaccaaaagcaggctagaggttgagattctaatcacgacttataacgtcaaactcaactgatgcagctataagtatgaaaagaaggacaatatctagacaatcaagcagttggatgtttcatagagtggtgaatatcctgtacgatctaagccaacatagatatttaacctaatcggctgccttccaatgatagatgttagccgattgaaggttagataacgatattatcaaagattatatagaatatatgataacccgacgaattacataaacaagattagagtatcataaagatggaagcactaatcccgagaacacaagccgccacagcaagttttacctctag

SEQ ID NO: 51453 - DNA, 3320 bp, Oryza sativa
atcctcatgaagcacattaactcaacctgacaacgtgtaccacgccatattgttggtatcggctgaatcggccaacctagtccgactcgaactctgccgatcttagtcgtagccgattcagactttagccgatcctcactctgtttccggaacgatttctatcttgaattccacttcgatcctatcttcatctccgatacttggattaccaaatttggttgttaacaggttgtaactcgttgccatctggaccaagatcttcaaccattccctcttgaacaccatcacctttgtcacctaattcaccagcagttactttaccagatgagcttgaaccaacttcatcggcagcaaccactttcagcttgtatttctagacaattgtcccttggcgggtttctttgaatgaattcatgaacttgtccttcacgctgctcatcatctgttcaagctcttgcctatgttcagccatcaatttgtccagtgtgactggaataatatttccttcatgaacttcagatccggttgaatttggaagcttgttttgaggatctgttgacttcgaagcttgcttgttgcccgacatatttatcgtgtcccactgggtgtgccaaaagagtgttgatgcaaaaaacgaggcctgggagatctacttaactgtagtgcaagtccaaaaatctcgcttttaggttcgtgagcgtgccagttgatttgatcctgcaatcaacaagaggcaaagacaaagaaaccgcggttaaatccataaatgatagtcgattggctagttgccgatgacatatcattcatctctgagccgatgtcatatttgaatcgatcagcaaatataaataagtaagtaaggattaaatctactcgatcggctgtagatatctacaatatgtaatccttatgtcgatatatacttaaatcaagtgattgggatagatcggtcgcgatgccgagacagtataaatcacatagatcgaaatatatattaacaacgagattatagatgttcatagcatagccaataagatagatctagcatgtatcggctaatacttcgataccactctatattaagatattaaagcaagcaaaatacatcaaatagaagcctaacatactttgttgtactaagatcattatataaagggcagatctagcatatcaattaagcacatgaaatataaggctaaatcaggtaagatcaactgaaaccccgatactaccctaatcgacaaccgaaaagcaggctagagattgagattctaatcacgacttgtaaggtcaaactcaactgatgcagctataagtatgaaaagaaggacaatatctagacaatcaagctgttggatgtttcataaagtggtgaatatcctatataatctaagccaatgtagatatttaacctgatcggctaccttctagcaacagatattagccgattgaaggttagataacaatattaccagagattatatagaatatatgataactcgacgaattacataacaagattagagtatcataaagatggaagcactaatcccgagaacacaagccgccacagcaagttttactctagttaaagatcgaaatcgatgcagctaaacccgaaagcaagaactcgtcgaaataaaacgaaagtaaagggtggcgatgcgccgagattgtatttgaacgtatgttttttttattacatggggctcggggtctatttatacccgagattacaaaatatgttcgtgtcggacacgactcttatctctaacaaactctaagataccattagtctttgtagcaaactcttgcccaaatatatctctaaggaaattacatgaaatatcctaattaatagatacaattgccttctcaagactcaatccatgcatggcaatcctcatgaagcacattaactcaacccgacaacgtgtaccacatcacattgtcggactgggctcaatcggctaatcttgtccaactcggactctacccatcccagtcgcagcccattcggactttagacgatcctcgctctgaatcccgaaccatttccatcttggtttccgcctcagttttatctccatctccgatactgaaattaccaaatttggttgttaacagcacggaataccgttgtagcacttcaccttcgggtgaccccaaaaggatatcgaactcagggaacgtgtgtaatctacctaaggctaagactatccaaggacaacaactgatgataggtaggctaagctagagaggactttctatgtgttttagttacctacgctaagcaagataattccctatctgttgcttcgggcaccgacccttgctggtctgccagcatggttccggctatagctctatgatgtatccgatcgtggagaattactgggacggaattcagggctgtcaccacctgccgcctacctctgacaaatccgtgggatacacaacaaacaaaggtcacctctaacctagacaccacgtctaagttattaattactactctaatacttgtacaggaacttccttctttatccagagtcctagtactagagcacttagtatgaatactaaacaatgaacccgcaaagatgaaaatctatcttacttagacaaagtaattaaataacataagaaaggaacacgaatgcttactttatagaagaagttctctgaacccggagcagagtgtaccgaggtagaagtcagatgagcgccaaacttccgggcactcctccagagcttcccctccattctctccatctctggctggccatttttggtcgccgcgggtttcctcccaagccctaacccctctcctctctctcctagggtgccgtcgccgcccgtccgtcccttcgcgtcgccgatcatcaccgctgccttcgccttccgctccggccgccatacccgccggtgaggttcccctctcctccctctttccctttcccccgtgtgcaccgccgttctccgcgcgtgcaccgccgtcaccttcggccgacgccgctgccttccgcgctgtccgccgccgcctcccgcgccgccggttgccgtcgccggcgaccgcatgccgccgccgctcgccatgcttagccggtcggcttgaagtcgagccgagccaggctggcgccttcctcctcccctttgaaccaccgcctggtggggcccacccgccaggccacctcctcctcctgttgtgtcgctgacccgtgggtcccgcatgtcccccccccattggatgatgtcagctgggatgatttattgcgcaataaataattaaggtttttctctttacagtgaaaacacagata

SEQ ID NO: 51454 - DNA, 3462 bp, Oryza sativa
cacgtttacttgatatccatcctttgctaaactttggggataattggcttagcttgtgttacttatgtgacctagctagaattatatatgtttagccatgcttaattaccactagctcacataataagataattacgttattagacatctagtattttgacaggctgcgtgctcgagacatccgaccatgtttcattggtcgtaattatccaattaaaatacgacttgatggtgggctgtgagtgtacggtttcgctagtcgcacccatggtaattaaggaccggtttacgggaaaccctggaagacttacagtgcttttaccacaagcgagagtgggtaactacttgacttgtagtatagctcaaccctttcctaggcaccgatggtgagggagggcgtaatggagttgggtcggccgaggtgtccggttgtccagcttctggattcaccacggtgcacgagggaactgcccaactctggggtagggggtgggggtgaaacatcagtgtggtgtggattgttaggggagggttatgtgaagggtcttgccacaatcacttgacatggtgacgtgtctagccaggcacagtgacatgccggtggattatgttttgtgggtacagttgtacacctctgatcagagtaaaactattcgaatagccgtgcccgcggttatgggcgatcgaccagattcactgtgattagtctcacccctagttagctaatgaactggtgtagttcaggtggttggttgggcctgttgcaacgtggtatagtgttggacagtgattggttaatattgattaattactacaactgttttactgctttcaactactgcttttaaatgtctgctttattgcaaatgaacctctagccacagtgggtagtactcagtcttgctctcttttcccctacaccagagcagaagttcttcccagttggagccgtgtcgaagaagttggttttgttgatgccatcaaggatgcctgtggaatggagtcgcccactgcaggagtcaagtcttcaggcttagctcgttttaccttttccgctgcatttgtaatcttttatatttttgtaagacgtggatctgtatgtcaataattatcgtttgtgtaccctgactggtcctggacaggggtttaatgcacattcagcttagaaattctggtttgtgaatttctgggcatgacaataagtttgtgcacctcgagtacaaaactaaaaaaaatactccctccatttcaaaaaattttagaaaaatgtaataatatttaacaaacatattatcaaaatatattcaatattacatttaatgaaactaatatgtaatttggtatggtaatatcgctactatttttttataaacttaggcaaatataaaaataagtttgactaaaaggaaaggtcaatctaacttataatatgaaatgtataattctataaataaaacccgggtagaattatttatagaattctatgaaatatataattctataaataaaaccagcttatgatagcaaactagcagcggggaccgccaggctccaccgctgcatctctagtaccaactgctatatttaccattatcgataccttagaaaaatgatttgtcattggaaaattctattagttgtatagtattgttggctccactattgtaaaccagtaatctatagggtatggtattcatctaatgatgggtacaataagaataaagaataatgtacgtcaaacagtaataattttactcgacaataaattgaacggaggaattagcattgtgtccttcaagcacctccaatctcgctaatatgcaaactaaattagcagttagcaatactgtaatacagtgtaagtataatggtcctatggcatgtgatctgaaacttgtgtaggcttgttcgtttctggcgccggacggggagtggtgtcggtgtatccgatgcccttccttttcgttgggaagagcaagaagacgaacgtcgacatgaacgccatccccaggggcaggttcttgagcagctccttggtgtcgttgccggcgtcggggaagaagcccttggtgagcccgacgtcactgaatgccacggtgaggaacaccaccgccgtgaagaaggagtgcacgaagtccagcggccgtagtcttagctcactgtgactcaatttcttcgcttcctcctcttcccgggacatgttgaacacgttcaatccccgccgtgtcgccacgccgtagtagagcttgccgtcttggccgacgacgctgtccgtgaaggagaagaagagggagaggccggccaggacgccgaccagcacggcggtgagccacttgttggcggcgttgcactcgccgtggttggtgaaggacggcgacagcgcctggtaagccagcaccgtccccgtcggcagcagctgcgccaggttcgccgtgcttgccatcaccttgtcggtcaccgtcttcgtggccacatctgttttcgacgacgtcgtggactcatcgacggccttaggcgtcgacggagctaagttattggtcgtcaccgccgtggactcgccgttggtgttcgatgccatgttgatcacgatggcgcccggaggagatgccgccattgctggagcttttgatgcggcgtcgtagtaattaatcaactggtgaagactgaagagagatatatgtgtggtagctcgagttcctgcgcttatataggtgaaaacatttggaatgattccatgttgtgcgcgttgatttttctatgcttgaaactagatgggtcgtgaccattcatgcatggaattcagatcaactgagcaagtgtggtcagctgttcagcagtaccgatctgcatccactgcagtttttttctacctacatgttactactacatcttactccatcttggagttggagtacttggaaggttggaattctcgagatattttctcaatttacattgtaaccaacttggagcatcgcaatcgccaacgggctaaatttgtcttcactgtaccggtgagaccataagaaaatgacgtttttatcgtgccactgatgcatgccttttttttcctggaaggcgagaaaatgatttttattttcggtctgtgtgaagaactagggagtactctggctatttttttagtacaacttggccgtgcgcgaaaggtttatatccgggagtagagagaccgctttgaacctttcattttagatagaggaagatcatttaacaggaaacccagccacaattttttttttagccttacatgtaaagctcatgtatatattgcaatttatagttaatcgtaaaagacatgtgtattgatcacatgttatattttgcaatttatagtaatcatgtacaacactactcttgatatataggcgtgtacaatactactcttgatatatagtcgtgcagagaaaccatgtcatagaacaattcaatttagttctagta

SEQ ID NO: 51455 - DNA, 1148 bp, Oryza sativa
cctgtttcctgtttgcttgaggtcgtactacgtagatcctcgtaccagcgtaccccaataccctctatattcggtctacgggtatcccccgtcgacagtggcgtgccaggtagggggacttggtgctcaaggttctactactatgacatccagtttcaccgacaacagcgttaacaccaatctcaaccaaggagttcctacttcaacaacactggtgtggactcaagtcggcgaaatcgtctttccggtttacaccatagtgctgatctcagctggtccgccaatggccggaaacgagaacgcagtggctagaacccggggtgactccatgtcgaagaatccagccgccgaagcggagatcggaacgtcgacaacatccgagcccgagaaggatcctagtgcggccaagccttgtctttccaacaggaatcacgagccgatgaggattacttccgaggtgacaaggtcctggtgtcctatccacaaaactaggaaacacaccctgcaagcctggtgggtctttctcaacgttcatgctgaaattcgtgcctgcaaagagtgtggaattcaacatacctctccaactcgtgatgtccattgtcctattcacaagacaaaaaatcacgacctctcgagttgcaaggtctttctcagcgccatgaagacaccacctcctaaggtccagcagtcacgcatccccatcagggatgaagacaaggaacaaggagcgacgccgattttagatcgatttgttggggtaatcgacatcgatccccacgaaccatcagtcttgcacttgctcgaagactatggatcatcgacaacgagtacgccgcgtgaggtattggctattgacgatgtcggcacgtcagtgcgcaccaatgcggaagcggagaatcaagtgactgctccgacccagcacatcagagccatcaacgcaatactgagggaaaccccctacgatcccattctgaacgacgatcaagcacgttggatagaacgactacaggaatcagtgaccaacctcagcaacgtgttcgaagaggccgctaccgcagcacacccagaacagcaccaactggcgatgctaatggtgaaaaccctgaacggcgggaatcgcctcatcgagccacccctccacctcgcgg

SEQ ID NO: 51456 - DNA, 1027 bp, Oryza sativa
  unsure (1)..(1027): unsure at all n locations
agaaagtggagcgtgaagtctgttcgacgtggcagggggctacgccaaagatgaagtggtccgagcagaagatagaattctcggaagaggaccaccccaagattgctgtcatcccagggcgatatccgatcatggtggaacccactattcgtaatatcaaggtcgcacgagtcctgatcgacggcggcagctgaatcaaccttctcttcaccagtgccttggacgcgatggggatcccacgaagcgagttgacacccactgatcaacccttccatggaattactcctcagtcattgtccaaatcattgggcaaaattacgttgcctgtgactttcggccaagcaaatagcttccgaacggaacagatcacctttgatgtcactgaattcgatacagcatataatgccatcattgggagaactgcactcgcgaagttcatggccgcatctcactacgcgtatcaagtgctcaagatgccaggaccgaagggaacaatcactattcaagggaacgctaagctggcagtacaatgcgacaagcggagcctcgacatggtcgagcacacgcctagcccacccgccacagctgaatcacccaagaaagtgagcaaaacaaacaagacgccgaagcccgacggcgcaatcaagatcgttccactattcagtgctaaccccgacaagaccgtcaagatgggggcatcactaggcgagaaataggaactggcactcatcaccttcctccgggacaatgctgaagtgttgccttggcagccgtctgacatgccgggggtacccaaggaggtgattgagcacaaactcatggtgggacccgatgcaaagccagtaaagcaaaaactgcggagatttgcaccagatggaaaacaagccatacgagaagagctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51457 - DNA, 7619 bp, Oryza sativa
gggtaagggtatatatgtgcatcttttttcactgcgatagggtctaaaatataaaagttttaatttagtttattacaagaaataccccaaggaccttcatataaataataaagggttgaaatgcaaaatatatattagggtgcctccactatgggttatgtgattcttgtgtgattttaatccacatggcaccttgagagttgagaccactggtagtgttctccaacgtgcgtgccctaagttttagctcaaccttggcctctggctgtcaccaacacacaccagaggcccttggcctactgcctcggtacaccccatcctgagaagccagctccatgtgtggagaacagaaaagaagacagtgcaccaaaggaaaaaaaaaagaagaagaagaagcaaattatgcatcggatgggttgaaatggtgaaccgtggcaaataaacaagcgtgcacctgaactttagagagcattttagcaatggcaacaaactatgaggcatattagagtatgccatccaacttgtgcccatctgagcaattttccccatgaaaaagaaaaggagaaaacaatgcatccaaacctcagccgcctctccacatgtgcgcgtcggtcggactaagtttgtgggggccgggagaatcggggaatcgatcgatcatgcatgtgaagtgagccgaggcgaacagagtcaggcctgctccgtgacacacgcgctgcttcgctcgtacgtagccctaccagtacgtggcccagcgcaacaaccactcgtttttaatactccacggggccccctacccacacccaccaccaccaccaggaggcggtctcgctcacaaaagctgtaagcaatgtgcccatgattgacctcgctagcccagtgcggcttcggttgctcacaaaaccaaaaaaacaaaagaaaaaccatagtagtagacgagcgcgagtgatgcgggggagaagctgccaaagtgtcggcgcctcggcgcaggcggggcgggctaccgcgaaatacgaacgaacccgcgcacgcacacgcgcgcgcgcgcgcgcaccgcacggaaacgtcggaaaggggaggaaaacgcgtggagacctggccgatttgggtggtgggagcggccgggattaagggacccttcgcctcgcccacggccggcgtggagtactcgtactggactagtggtactgcacgcgctagcaatagctgctgctgctctctcgttggctcgcacttgattacgagatcgatcttctcccacttctgaacagctgcttttcttttttttttttttgttagggttggaaatggatcggattcggaccgttaatagtcctatcatattttaaacataatttttaagtggatctggaacgggtgcgaatagtatgcggatacgaagcggattgcttcagatgtcagaaatggtacaaagtcaatacggacccagtttagaaacgaattaaaaattatcagatgtcacgtatatgtgtaattaatacaacatcaacttagcgatgcaacaaacaacaatacaataataatcaatgaacgatctatcgtatactggagtgctaaacatcatgaatagatgatgtccataattttaaaacacagttacgtaagtataaggtgagacagtaagagcctcaaattaaagtgtctaggttaattgataaattaggctattttattgaacggttcatgttgtattcaacagatggagtggttacgtggattgacaatttcggattatcaggcaaacagcctcctggataatccgatagagatatcggataatccgtatccgtcggattttagataccacatccgtatccgcattagcatccatattcgtcggatttctataaactcatactttatccttgtttcggatcaattcagagcggattggatcgaataatattcgatccgttttcaccactcaattctcgtttccacgagcacatctatctatctattatatactaaaagtccattaaacttcctataaacgctcctaaaccgccacgtggcaccccctacaaatgctcctaagccgccacatggcgttttaatagacgagaaacatctaaccctcaattttcatttaaactggtggatccattattttacaccattagattagattaaaaccaatagtttatcccttcctcttctgtccctgcacgtacatctactcttccctccctccctcagtacacgtactgacgtacatattccaccctccctcacacgtatgtatgtaggcaggtagtacgtactcatcccctttttttttcttcccattcaccctactgttattttttaacctaggatacccctaaatatttttatattacttttttccgctattgacttttgagcatgtgtttgattattcatcttactaataaaaatacgtaattatcatttattttattatgattttacatggatgtcttatattcgctatattttagcacaaaatacattgtggcagatgacatccacatgtattaattaactccacaacaatttttcaaaagtaatcacatcaaactatatactttatggtatcaaatattacttaacaaatatataacggtagtttgaactatgtaaaaatgcaaaccatgtaatttagttgtgtttttaagtagatccaatttaaattttaatttgtgtaagattaacattctcaaatcatttggaatttttcaaaattatttggttggtattttaattgtaataaatcctaaattatacatatatgcaaagaaaattcaccaaaaatattttcaacaggtaaggtatatatcattggttttttcatatttttaataattatttaaatgatatgaaaaaagtcagaatataacaaaaaatacaatatttattttagaagttcaaatatagttaatatgggtcctcgataaaaaaatagttatttattttaaaagattatataaattaggttcatgattaatatatgatgaaaacatgagagacaatacatggggagagggcatgaatgagggcagaggggtgcatgtcgggcgatggtgcacgtatgtacatacatacaatgcccctcgggctatattggtacaatcgatgtttactttatgttttcactgccaatacatatccagaatgacatatttggttaaggtcggcttttgactctagctaccataacaattataattttatatctttatttgtgattgatcgaaaaatgtagttttgccagttagaggaaacaatcgaattcatgaattctctaaaatgtgctcaaataatccaagagtgccaaacgatcttctacataagtgctctagaatatattctatgtaacatttaaattactttattagacggtatttaatagcattttagtatatggtacatatatatacttgccggtggctatgtgcttatattccataccttacgggtatgaaaataaagtatgttttctctatgcacaaacctttaaaaagatcttatcatccatatatatggacattaactttctataaacatgtcaccatgcacatattcacttgaagaattaaattttgaatccatttatgtgttacgatacaccgagacatgaaaagaaagattaactaaacatgatcgaaactgtaaacactactacaatgaatcgtatggtaacctccgtgtctcagcatatatacaagttttacaaccatgcaacatgatgacttggaggtgcaagaaaaccattatcaccaaacaattgtcatctactagacagaaaaaatttacaatgtattgtttagactttggaacccaaaaattttcttgcgcaaactagaatgagacagcaagcaaagcagggagacactgagtagaccagttttaatgagataataatagtgcatcaatagaggataagaggagtgctattgagtccagctaggccttactttttgtcaccatagggcatattgagtagaaagtgcaagtggattgtatagtgaccaaacaaattccatgctacaaatgcaaaaagctttcaaataatttatctgatatttgaaacacatattttctagggtcttttagaacttcatagaatatgtgataattatgacaagtggatagacattataggcttcagataaacgattataaaatctaattgttactaattcatgcccaatgcaagctagctaaacaaaatatttgtgggttggttactttcgattacataattcctaatatttaactaaaaattttattaaaaaatgaaattatgggaacaatcatataaaagctcattccagataatgatatgtttgtagtaatatttaaccatccaataattgtgttctcgctagcctcgcacacttatgggttgtctcctacactgcacaatagaattggactctacaagaatatgtatttaacatagttttgaatcccctcaatccatgaataaataaacaacaggaacctattttagtattagatgtttacacaaaagttgattcatatttataaaaatgttgacatataaagctaactaattagatgtttacccattagcataagcatgcattattttttagttcttagatgattagactgcaataagtatgtaacaaaaagctaactaattagagggcacgagctttattgtgcaaatagaacatgtttattaaacaataatggatttggaaaaaaaacatttcagaaaaaaataacccttaaacaacaattataaaaagttcgtaataaaaatttaagcaacatcaaacaaagtgcccgcgcaactgcgcgggctaccttcctagttttctaaattactgaatgatgtgttatgtataaaatgcttttatacataagtcttttcgaaagttaaataaattattttcaaattataataattaatgctcaattaatcatatggtttactttatctcatttaccgtagaacagctggttcgaatgagtctattctcgaatcacttcatcagagtatgtatgtacttcttccatataaaaagaagtctacttctaacaattggtttaggcaaacacttatctatatacataggtagattttttttttaacggaagttttatgggtgaagtaccatggagtattatggactagttgccgggggtgaaattgcagtggacatcaagtgctgggtatattctgttttgcaactaggaaacgtggttagtccacggcaatgttttgtgtttctttaatcaagtggccgggatgccaactgatcacagagaggatcagaggattccacgcacatgttgtttagacatcttgccggtgccgggtgtctttctcgtcgctacctctttcgcaggacacgctcatactcatagtcataggggcgtacgactacgagctagtaagagtggaatgcggaccgatctagggcagtagcttgctagtagtagaattctgaagctgaggcgaaacgaacacaaaggtggtgtttttttttccctgaaaaagaagaggaagattaagttttttttatgcataacgaggtagtattaatgtacgattgattgagttttaattattacaaacttaaaaaaaatatattaatatgatattttagagcaactttcatatataaagtttttacacgaaacgcatcatttagcagtatgaaaagcgtgccacgaaaatcttaatcttcatccaacttttgtgggagaaaagaacatgaccaaaatataatgacgatgtcaaattgatgcgctctccaattaaagcatatgctaaatgtgtagagtaatggccaaactcgtgaaaccttattcggttaatcttctcttcgagcaatttaatcccctcaactccttccatatttcaacccctttctcttgggattaataatttcgaagcttcgtttatgtgaatataattaaccacacgaaaaataagataagtgattagagcatgattaattaagtattaaatgttataattttgagaaatggatttatctgattttttaagaaactttcatacagaaagattttacaaaacaaaaaatatttagcaattttgaaaagtgtgttcacaatagtccaaggagttgctatcctaaaacagctcaaacaaattgagtttaatcaatgtatctatacgatgttctgcgacatgatgtgattaaaattggtcctttaatcatctgctattaattttaactgttgctatcgaaatctttagtcggatggcacgcaaacaattataaaggtcgcgacgaacgatgaagaacgcatgcgactacaaagatgacgatcacgatggacgaggcgaactcaagcatcggtgacggctgcgacggatgtggaagagggcgaaggtcgtggctgacgatgggcacgaaagacaagggcatcgacggatgaggtggatgcaagcaagttgacggtggcgtagcgtggatgtctagcctacaaacggtcaagcggatcccacaactttaagctacgtgtgccgctaggcgacaagttaatcatccgctctcgttctctctcctctcgtcttttttactcgtcctcacaaaatcctacgtgaataggagtttttatcatcaattattatacctgctctaactattgtgcatattgctgttattaatcccgactcccgaggtgatcaccgcgccgctccaccgaacactcgctcacactcacgtccagcaacaacacacgccacttcactaccgacgatcccaccgactactcgctgtcaaaacaacatggccatcccatacaacctttctttaaccacctctccacctcactaatcatcatcatcatcatcaaatcaatcaatcaacgccccctccccctaatttaatcaacccccccccctctccatccagcctagcatcgttagttagtctcccctggccccacccaccagacattccaccaacccccttcctttctctctccctcttctaaacaaaaacatctcccgtttcagtcgcccacacaccgacactctcctctctctctctctcctcgtgaaaatatttgtcacaaaaaaatttaaaagaaaaaaaaacacacccttcgctgagctagcaacgcggtggttgctgctctgctctctctccaagcaaacaccattattataccaccacctccccttccccccatttcctcctcctcccccacgcggcgcaccagctatcgccgccgccgccgacgaggagggtgcgatggaggcgagcgcggggctggtggcggggtcgcacaaccggaacgagctggtggtgatccggagggatggaggaggagggggaggggttggggggaggagggcggcggaggcgaaggcggcgtgccagatatgcggcgacgacgtcggggaagggcccgacggggagccgttcgtggcgtgcaacgagtgcgccttccccgtctgccgcaactgctacgactacgagcgccgcgagggctcgcaggcttgcccccagtgcaagacccgcttcaagcgcctcaagggtgagctcttcctccgtcgccattgctctctctgctctctgcttatgcttcgctctgacaatgttgacacggcatgatgaagtact

SEQ ID NO: 51458 - DNA, 2680 bp, Oryza sativa
gtgtttccgggtgccccccaggttgacgacatcccgccggagcagcacgcgctggtgccatcctacatggggggcggcggcggcggcgggaagaggatccacccgctccccttcgcagatccgagcgttcctggtgggtgatctggtttctggttggaatctggttagcttctgctgctggtggtgtgagttgctgatcgatgtgcttggtgtttggttgcagtgcaaccgagatccatggacccgtccaaggatctcgccgcctacgggtacgggagtgtggcatggaaggagaggatggagggctggaagcagaagcaggagcggatgcagcagctcaggagtgagggcggcggcgactgggatggcgacggcgatgcagatctgccactgtatgtgaccacctaactttgcttgctcaccaaatgttagttagaacatgtggttacagtgattaaatgaccgtagctgcttcccatggcctgccgttgtctaatgcttagactatctttagaattgctactaattgctatattaacagtacatgaacaaacatatatggaaagtcttgtttgatggaatgctaaaaagaatcttactgtaaaaatgctgacatactactattttttttgccaataacttaatgttttgttacttcgtagaggatactcgtaagcctataattggacagatcccagagaaggaatgcaactatttgtgctagattaacataattgccttacatggtttttacccgcagtacattatttttgttttatcttggctacttcactgtttgaccatgatttgcatttgggcttggttagtttaatattcatggaaaatattatgatgtaatgaaatactaatttttgcatgtcatatgcttggagtttcatcgtcaattctgtatgatgcatagacacaataggttataatttaattattatgtaaggatttgtcttttccttgcaaatattgttactagactctggttgtaaagtgtctctttaatctgttgaccagaatggatgaagctcgacaaccactatctcgcaaagttccaatttcttcaagccgaattaatccctataggatgattataattatccggttggtggttttggggttcttcttccactaccgagtgatgcatcctgtgaatgatgcatttgctttgtggctcatctctgtaatatgtgaaatctggtttgctatgtcttggattcttgatcaatttccaaagtggcttcccatagagagggagacgtacctggaccgcttgtcactgaggttagttaaatccccaaaccaagaaatacttgccctatccttttgctgaaggtttgaaggtaacaaactttttgcttgtctgatcaggtttgacaaggaaggtcagccatctcaacttgctccagtcgacttctttgtcagtacagttgatccatcgaaggaacctcccttagtcacagcaaacaccgtcctttccatcctttctgtggattacccagttgaaaaggtttcctgctatgtttctgatgatggtgctgcaatgctcacatttgaagcactgtcagaaacatctgaatttgcaaagaaatgggtccctttctgcaaaaagttcaatatcgagcctcgtgctccagagtggtacttccagcagaagatagactacctgaaagataaggtagcagcgtcctttgttagggagaggagagcaatgaaggtagatgtcctcatttgttcgtgcttttctactcgattattctttttatattatagctagttacacaagtttaattttcatccagagagattatgaggaattcaaggtgaggatcaacgccttggttgccaaagcccaaaaggttccagaggaaggatggacaatgcaggacggaagcccttggccaggcaacaatgtgcgcgatcatcctggaatgattcaggtaatgcttttgcaattttggtgttttactacacacgtgcgattcttctttctgtgttactttagttcaaagtgttcaattttttgtgtcaataggtcttccttggccaaagtggtggccgtgatgtggaaggaaatgagcttcctcgcttggtttatgtctcaagagaaaagaggccaggctataatcatcataagaaggctggtgctatgaatgcattggtaaaagatccttcacataatgtctcgtatcaatttccatgtagatttacagccttagcaccgtttgacatggttttctctctctttgttgtttgacaggtccgcgtctctgctgttctttcgaatgctccatacctattgaacttggattgtgatcactacatcaacaatagcaaggccataagggaagcgatgtgtttcatgatggatcctttggtggggaagaaagtgtgctatgacagatagatttttaaaccatatgattaacaacacgtagcttacactagacaatataaaacacataaaaccaattaataagattaaaataataagaagttaattagaaaatacatattcccctgtcccaaaatataaaatttttttatggatgcatggacatggatttagattcgtagtactatgatatcctattcaactaaaatcacttatattctgtgccacaataaatatgccattttagaaaaatgccactactattcacgattttgc

SEQ ID NO: 51459 - DNA, 5982 bp, Oryza sativa
atggtggaaccctgaagagtgcaagtccagcttctctactgaaggaagctatacatgttattagctgtggttacgaagacaagacagactgggggaaggaggtaagaaacctagacctgattataaactgatggttaatcaattgaagacgttcctctcacctgtaaatcatgtattcttgcagattggctggatctatggttcaattacagaagatatcttgactgggtttaagatgcactgccatggttggcggtctatttactgcattccaaagcggccagcattcaaaggttctgcacctcttaatctttcggatcgtcttcaccaggtccttcgttgggctcttggatctgttgaaattttcttcagcaaacattgcccactttggtatgggtatggtggtggcctgaaatttttggaaagattttcttatattaactctatcgtatatccctggacatccattccacttctggcttactgtaccttgcctgccatatgcttgctcactgggaagtttatcactccagaggtaagcattattgtgctacataattttgtgatcttctgagtttctgtctgaatcttacatcatttttatttcaaactgcagctcaccaatgttgctagtctatggttcatgtcgcttttcatctgtatttttgtcactggcatccttgaaatgagatggagtggtgtggccatcgatgactggtggaggaatgagcagttttgggtcattggaggtgtttcttcacatctcttcgctgtattccaaggacttctgaaagtccttgctggtgttgataccagcttcactgtgacatcaaaggccggagatgatgaagagttctcagagctatacacgttcaaatggaccaccttgttgatacctccaactacactgctgctgttgaacttcattggggttgtagctggagtttctaatgctatcaacaatggatatgaatcatggggacctctgttcgggaagctcttctttgcattctgggtgattgtccatctatatccgttcctcaagggtttggttggaaggcaaaacaggacaccaacgattgttatcgtctggtccattctactggcttcaatcttctcacttctatgggtccggatcgatcctttccttgcgaagaataatggccctcttctggaggaatgtggtctggattgtaactaagcagcctacactccatatatgcggcgatacgagcttgaagaaattattttgcaggcggcgaatcaagcccaagtttttaaattctttcctgtagatagaaatacagatctccggcatttcttttgttccacagtggtagggcagcttcatctgtgtgtattagggcaaaccagaagctatgtcaattcttgtgcagtgctaccagagaagtcaaatctactcctgtggttgatccaagattatttatttatttggaggggatttccatcatcgctgagcttacttggtggaagctgcagcatgtgtaagctaagttacaaaggcgttgccttgccatttggacagaaggaaggaagatgccaattgtttattttagtaaattaaaattgaattgaattatgcacattccggagttcatttgttccactcaataccatacacagctggctggtggtacatttagcatgaacagatttgtaggtgtttagcaaatgtacctaagttggattcatccggtgtgtggtgttgtacaagtggccatacagtagcgcaagtggtggtgggcacttcactcctgtttgttttgtgtaaccatacagcatacagatgataaaactcttgttcacattttacagagagggaaacttggtgtttattttctccttctaatgcctgatggtttgccagcagtagtagtatctgttgctgtgtatgctgtttttattttcgtttgcaaaatctgttactgcctggatggaagtagaacagacacgtcggcggtgtttgaaaattgaaactgatgatgacgaagatgaagattaaattggtgcactaaaacaataaaacaagaaagctattagcatatgattaattaatttttaattattataaacttgataaatatatttatttgatattttaaaacaatttttggaatatacttttttagtagtttgaaaagcgtggtaacaaaaatcaaatcaagataaaatctgtatctcaacgacgagaaaagaacaccgatgtgtgccagcgtaatggcaaattgtcaatgcagatcattctccgtaatggcaaattgtcaaagctgatcattcccagagatgagcagatatttgcgcagaaatcgtgtgtggccggcctgaaaaagtgtagcctgaatgcgtgtctgatggaaaagtggccagcagctgtgtttacggggaccatgaccatacatgccacggacaccggcagggcaaggcagctagggttggggtcagtcagtacgagacgaaagaaggcactggcaccgaccaaggtgccatggggcctgcggggtgttaaagccgccgtgctgggaagacgagagcagagcagagcagtcgtgcgtgcagaagcagagagagagagagtgtgtgtctcacgcggtggcagcgggcgggttggcaggcagcgttggagctggagggagtgaaagcggaggacggcgcggcgcggcgcggcttttggttttggaccggacgtgtcgtggtgaccgtgacccgtcctgctggactcacgggcgcctcgtcctccggctccgcgttttggctccttgctggtcgtccccgtccctctgccggaattaatggatcatatggaccagacgcgcttcatttttctgtgagtaactgcaactgtatcacatataggcatggtttagttttcaacttttttctttaaactttcaacttttttatcacatcaaaacttttttacacacgtaattctaacttttccatcccatcgttctaatttcaatcaaacttttaattttggcgtgaactaaacatacccataagaatataagatgagaacatatagcctttgtataagatgcaacggcatgtatggggcgtattgttttcttttgttaatcctatctaagtaatttttataaaaccttatccattatggtccaaagttatacaaatcatagatattttaatacatgccacgtaactacaaatatcataaaggttcacaaaacaacggaatactcctatattaaaattttaaaaagtttagtaacatttatatgacggataaataactcataaaattgaaatgtgattgtaaaactcaaaagtgtggtggttcaaaatcaaaatgatcagtagtatggttttgtgaaactctataggtttatctatcatgtgtcaaaacccctgtggttttatacaacttagaccataatacctagggttaggtgaaatttactcatccttttatttcaacttcatgctagtttttggtttggtgccctttcttgacgaggacatcctccactatttcccgctggcaaagacgcaaaagtcaggcggcgactgtgtgagcctctgaataatcccactttgcttagcttgggaggtgaaaaccaccttaaaggggagagccacccttcccccattggactagtcttttagggagattgggcctttccccgagtgggtgtgcctaagaactgttggggtctggacaatcttaagttattgggcctcggccgaccccacctgagccggattgctatcatttggtatcagagctgggcccttgtttaagggggtgggattgatgaggacatcctccactattacccgctggcaaagacacaaaagtcaggcggtgaccgtgtgagcctttgaataatcccaccttgcttagcttgggaggaggaagccaccttaaaggggagaactacccttcccctattggactagtcttttagggagattgggcctttccccgagtgggtgtgactaagaactgttggggtccgggcaaccttaagttattgggcctcggccaaccccacctgggccggattgttatcatttctccctcagtcccaaatgtaccaaattttaaaggatgacatatgtattaaagcatgagcattgcaagctcctctttggccattcataatgctcttgcgtgatgtgtggactcgtctagccacgtagggcactggctgctgtggaggagagagtaggtgaggtccatggctctagtttggttctttgtgtcttgtttgagctacgagagccttgtcctgcaaagcgtcaggcgcagggcccactcagtgagtagacgaggaagagaggagaagcgacggagttgtacaagggagaaggggaagcggctgcgctatgcattgtggttgtcgccattgagggccgtcggggttgccatcgctgagggccaccaggagcagatcaactgccaagtcccctgcccatgaagatacaacgatgatgctacctctgcaagcatttcagtcgctgtagtcgttcaactatgctcgaagttgccattgaactcgttgcattggcacaagcagatctgaagcagcagcaagttcggatcgccacgaccaccgatgtagccaaggccacctcgaccatcggtgcggcctcctagaggagtgctacacatctgtaggcaccgtggttcctcttcttgttggtggtagcatcggcggtggccggtgagaggatgacgatgccggtgtccttgtggagcatgagcccttgggccacaccgtcgatgtcgcggccgtggacaaagaggagcacgagctcggtctgtgccatcggagctcgatttggccccgtcaaagctcggttcgtggaaagggagaggagagggaggttgttgccatcatggcctcctgtcgcccttgctgccttcgtctgctgagccgccgccgctaggttctagggaggagatgcaccgggggaaggggagaagggaacaatggctgttggtgaaatggtaactagggtacccctttccctatggatctagcactcttttcatattaattaagatgaaaaagcttacttagaccatcataaagctaaggcgcataataacggggcttgggacccactgtaagggtgagtcctagggcccctatctcgcgttacaagatggttattgtcgacatttgatgtcgcgattccggtatttgcatagtatggggatcgttggtactaggatatacgcgagaccgaggtaaaagagatggagacgaggatttttatacaggttcggtgtcatgtccgaaaacgactctaaaatatatcctttaaattatgcctagaataattaaaatccgtatgtgaaagcctccaaaaattaaaatgtgcaaagtaaaagtcaaaaagggcttagaggatttttgtatatttcctaaaagcctaaaatgggtaaataaattttagtggaattttcagagcccaaataataattaagaagaaataaacaaagttgaaaaagttttaaaaaaaagaaaaaccctaaaagtcccccttccctcccttgggccggctcggcccatctctcctcccccctctctctctcctctccccgcggcccactcggcccctccccgcgcgcgcgccgctgacgggcgggcccgcctgccaccctcgctgacgggtggggcccacccgtcatccccgacctcccgccgctcccgccgcctcgcccgcaccctagcgccgccgccgccgcgaatccgccgcatcccgccgtccccgcgtgcaataaagtgggggggggaatactccccgtgattccctctccctttccccccatttttccgtctctctctcgcattcaaacgggcggatttgcccccgcaaatctcgccggcgccattgatggtggccgacctcccgcgccggtttccttcctccccggccgctctctcccccttccaaccctatttaaaccctccacgcacctactccgtc

SEQ ID NO: 51460 - DNA, 12394 bp, Oryza sativa
caagtggctgccgcgtggggcccggccgtcagccgcccgcgctctcgggtgcggctgacgtgtggggcccacggcgccggccggtgtgagcccgggtgcgcccggtccaccgtggaccgtgaggctgccgcgtgggccccactcccgtggacccggtccgcgcgcctctccccctcggctgacgcaataaaccctttttaaactaaaatttaaatgaagaaattcgcaaatattcatttaaagagcatataaacttcaaatggccataacttggccatttgaactcagaattagaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctctttgtggaagttgaagccgacgtttgggaaagcgagcaaggcaagtcacatcatccttgaacatattggatcccatttttataaaattattttgatttaaattattgcattatcgctttacttaaactcccgcgttatcactgttttatttagccatgcctatttacctttgttatgaccttattattattgttattgatattattaacttgttcaccctagattaaacaaaaccccaactagtggacactctactcatggtaccactagtatgaatttagttagatgcttcgctggttaattaggcaacattaggtggttttacaactctagactttgggaatattctcatcacctggacactatggaatggatggattattgtggaattggattcacacctccccctctattcaaaatcctcaaaatggttttaggctgggctcggggtgcatggttttgattgtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataacctattcgaatagccgcgccctcggttatgggcaagcctagcaatgtacccaagttagtgttttaattcttaaaaccttcttaacaactaaaatgtggaatggttggcctgggttggcttgggacgagctgggacccagggtcgggttgccagttcggtctgaatcatcgtaggccttgggttaaggtaggttcgtgtgggttcacggccttgattaataatattgtatagctctaggaccatgtttacaaagtagctttgagcaactaagtgacttttaatgttgtttactgcaaaccctaaccccctatattatggctcccttgtactcccttgcatttattctgcacttgtgggtgtgtcttgttgagtatggtggttgtactcagtcttgctcaatttttcccaaacccagaagaggagttcctggaagatgaaggctttggtgtctagctcgtgcttgccgtcaagcgcctgtggtcgtcgccctagtcttccgctgtttcccgtttgtctttgtgtatgctgggccttcgccgcccatgtaataaattaattatttacgcttccgcttgataaactctgaaatgtatcaacttttaggtgtaccttgcctcctgggacaagaaataatacacgcacgtaaggaacgcccgttgggttatttccggtcatgacattcgggcccctgaattgtcaggtaataaccctacatcctgttggccgaagccggtcgttgctcttattcaccataatcacaccagtataatatttggggtagcctatctaactgttgtcgatatggcggtctgaagttctgactcgtagtcgacaacagggtagtcttcctcctcaagtttgtgctcggcgagatcagagacagcgctagatccctacggccggcctctgaaggtaccggatagggtcgatctagacatatctctgatgtcgatatccggcggcttgtcttgacgtatgttggcttgtattggcttgaggctttgtggcgtctatggtgggtgtcttccatgctgggcgttgattgtcctctcctcctagggggtcttgtatttatacccataggtgttcctttgtccaagttgagctagggaaaccaatatggatacaatccgagtagtccttgtcgtttccatgtagaactctggttatccttccttatccggaactcctatatccgcacgttgtttccgtataagacatggtatgtggtgggtactgccgagatttactcaactactattaggtatgtgctatccataaaccctgatagtagccccccacttttatgcaaatgaacgaattcatattctcaaccgtgcgcagaccttggagtatctgagagaggcggctttttctctcctctgtgagtttagagttaacgttagacttcctttatcagcctcgtgcgggcacctaaagggttttgtctgagtcaatctctgacgtcaaccaagaaagtacagaatatacgactatgtctcccatcttgctgtaatcgagaatttggattgaagtcaagaaatcttatctcggcgagtacaccatctcttcattccgtattccttgttgagatccaccaactgttctcgagtgatcgagaaggcacagagcttgcaacgaaaccttgtcaacatttgttgtgctcgccttagtcgatcttggtgtgtagaaccatagagacatggagtcttcgtcaatgtcgaatagaattttcctgaaatcaatactcagaaaagaatattagatagaaatagcccccgagcgaatgctcaaagggtgacatgttataatatgtatagaaaattgaaaatgaattgaattttacagaccaatgttttgtatatgagcgtctactcttttaccgacttcgatcagtcagtttgttgagttatacactctccctagcccctagccttgtcgtcggagaatcgttctcggaagataaggctcttggacctttgacctgcctcggttgaacaagcactgatcctagcccccagtcgtgaagttggaaaacccaatttctgattatacggcttggttaatacgcacggcgagaactcttacacaaccagctcttacatggtcttttgtctctacaggattcgacaaggccttatcggctctgggcgtccctagccgaagttcccttaggttcctcggaggccttgtcaagacagcgtaaagggacatgaggataggtttgaacgctaggtgtcatcgtggtaagggatctctgggtaaaacacttggcaacattgtgtacttgatatcaactttgttgaggtaaaggtagtggaagatctcgctacccttctggtcgaggaccaggtagtagtcgtactcgactacttgaagtggaaatagtgggagaatcgctacaccactggtcgaggaccagatagtagtcgtaactcgaccactagaagtaaatgtacgagagatcgcgacaattgactggttaagaactagtgagtaggtgtctctcgatcatttggagtcgtggtatgagggccgctacgctgccggtcgaagaccagtcgtagctgttcctcaaccatctgaagtcatggtgcgaggaccgctgcgttattgctgtagtcgtacctcgaccatctgaagttaatgtgcgagagattgctacgttttactagttcgagaaccaacgagcgagtagagttatctctcggacaccaatggaagttgcggtgcgagagattgctacgtgctggttcgagaaccagcgagcaagtagagttatctctcgaacaccaatggaggcgctagagttggtttattacatgtgcatctcatgtggccagcatgactcacacacccaacttgtagcatatccggatgtccgttcgcaatcatgtcgggtgatcaagccgacgacgttcgcgaggaattatccgttaacaaccttttctcgagtagtccagccatggccggtactatgagataggtcgtcggtcttcgttggtaggttgggcacgacgactcagcatttgtcgagatcgttttcgataatgcggtgtactcgaccacaacctactcaggtgctcaattgttcctgaagaatattttctagaaggcaagacatatagtagataatatcgagtatgtactcaaaaaactgcatggatcttctagtattatcaggacataatgagcaaatgtaaatatcaggcattatgcaaaccgtaagcaagcatgattcatataggagagaacagagcgagcccccagcgttagaccgtagtcgatttaacatcggggacacccgcgcaacagatattgtataaaaacatgctctaggtaaacaaaataaatcatggatttgacaatgctgtatgatctgaataggtacgataaattgcagataaactattgcgtacctttgtagatacatgccggatgtatctacgaaattagtagatcaatttaaaaaaccaatctaccaattaccttgttgcgtactcgttcgatatcatgcgatctgacatcttttggtacgccgcggagcttgaggcttggatgatctcgatagaccaagttgttgatgacgatgatggttccgatctggttaggttggatctccccctcagctgaagtcgtcgagtagctcgttgtcggagaatccatctcttaaacacatctcgtcgaaaccttgaagcaccaaaagatcccctacttggcgcgccactgtcgacatttgatgtcgcgattccggtatttgcatagtatggggatcgttggtactaggatatacgcgagaccgaggtaaaagagatggagacgaggatttttatacaggttcgggcccctgaattgtcaggtaataaccctacatcctgttggccgaagccggtcgttgctcttattcaccataatcacaccagtacaatatttggggtagcctatctaactgttgttgatatggcggtctaaagttctgactcgtagtagacaacagggtagtcttcctcgtcgagtttgtgctcggcgagatcagagacagcgctagttccctacggtcggcctctgaaggtaccggatagggtcgatctagacatatctctgatgtcgatatccggcggcttgtcttgacgtatgttggcttgtattggcttgtggctttgtggcgtctatggtaggtgtcttccatgctgggcgttgattgtcctctcctcctagggggtcttgtatttatagtcataggtgtccccttgtccaagtaaaactagggaaaccaatatggatacaatccgagtagtctttgtcatttccatgtagaactctggttgtccttccttatccagaactcctcctatatccgcaggttgtttccgtataggacatggtatgtggtgggtcctaccgagatttagtcaactactattagatatgtggtatccataaccctgacagttatatggtttgaagggcacgggtccccagcctgcctagggacctgggcccacctttgctctggtaggttacacgtccctcccaaagaggagcgtagatgcctacaagatctatattttaagaataaggctgagggaagcctggatcctagcttgctctgggacctaggcccatctttgcccttgtatgttactcatccttccttgagaggagcgtggaaacataaaagatctacatcttaagatcataaaccaaggcggagggaagcctggtcccatcctgctctaggaccaatgcttgcctttgcccttgtattttgcatgttcctccttgagaagagtgtggaagcatacaagatctacattttaagattgaagactgagggaggccagggtcccaccctgtcccgggacccgggccctcatttgcccttgtatgttacacattcctccttggtagaagcgtagaaacgtacaagatctacatcttaagatggaaggctgaggaaggccaggaagcctgtatcaggacctaggccctcccttgcccttatagataacacgtccctccttgagaggagtgttgaaacttacaagatatacatcttaagattaaggctgagggaagcctagatcccggcctgcctgggacccggccccacctttgctcatgtatgtttcacctctttcctcaagaagagtgttgagacgtgcaagatttatgtctcaagcaaacaaaccaaggggagcttgaatcctagtccagcttgggatccggtcccccctatgtccttgtaggttacatgctcatctttgagaggagtgtcgagacatataaaatctatatcttaaaattgtaggcaaaggaaactgggtcacagcttggtctgggacttggtccctcctatacccttgtgagatgcatctctttccttgagaggagagttgagacatataagatatacacatttacaacttttcatcaaagacatcttcaagaagctcgtccaaaaataactaaactaccttttctaggacaaggggcacaaccagaaggctttgttgagtagtgaacgtgcccctctaccagctatgggcaaacgtttactgccataaatgaaataggtttaagagggaaactccaagtggcctggggtaaaagacatggaaaagacactaacgctgagtgattagggacaacgggcgtctgtacatgcgtcgcgcatgcccagcgacacacgacttttccaactggacaaaaaggagctgtggcactattttgggtaggttggggatcggtaggcccaccacgagctacatggagctggcccaaaccaatgcccggagagcctggggcaacttaatcacatatttttggtaggtttttcaagaagattggaaggaaaccaactggcagtggcaagacaaccaagagagaacatagaggaaaagcaaaaatggtaatctgagcccctccttggactataaaaggaaggggatatgccactaagaaagggatgcttgagtttagcttgaaaaagtatagtttgtatttttctagatccagatagcaaacacaaaaaattaggagtagtatattacacctccgggtggcctaaacctgtataattcttggtattggttggattgtggggaactcgtgccccatcctaggtgatttccacacatcgattgtagccaacccctggttgaatcttcatcaggggacacgtctgcacttccctgctgctagagaatcgcctctccgatagtggcggtggagaggagagacgccagtggaggggagaagcggcggcgctgtacgaggagtaggggattgggtaagagggagagtttggtggggaggagaaaacgtataggtcaggtctgacatatgggtccggcaataggctagatatatgtgtactcctttttgttgttatagggtgtaaactataaaagttttaatttattcgacaatagaaaatatcatagggattgacaaagaaatgactagggtctgaaatcctgtaccatgggttatgtgctctaaatgaatcttgtgcttatgtggcatttaagggtgcttaaatgacgatcccgcactgtgaatgtgtcaggtaggatgaagccttggattcagattcggtgatattgcgatagcatggcacggtgtgacattggagtgatctggggcgttgaaaactaatccaatggtccgctgcactggcccacctgcaggactccgttttcaccccacgcgcctacccttcttgccaaacgacgtctcctccaatctcgccccaatctcgcgtgctcgcatcgcggcttccccacgccagtctggagaggcgccaggccaccgcgccgccgcgagtgaggaggggactgggcggccgcctcgtcgcttcgcctccccttgcccgtgtcaggccaccgctgtgagctagctgggagccgccaccgcgccaggccggagaggcgcccgccaccgcgccaccgcgactggggaggggactgggcggccttttcgcctcccctcgcccgccttaggctgccgccgcgagctagctggaggccgccgcgccgccgcgagtagggaagggaccgggcggcggctgcacgaggaccctgatgtatctgaactctgtgttggttttggcatatttttgatgtttggagttccatctcgccaattctactgaacatatgctagctaatccaacagctagcactaatagagcaacagagccaaagcacccaactgaaagggaaacacacagcaaaattgatgaagcacaggggcgcgcaggcacctcttccgcaccgggaggcggttggacctcgttgatgtcaggcccggtggctggctgcctccacacgcggcctgccgcggtagcacggcagggccccagccccggcctcacgtggcagccgccagacccctccacactcgcggcgagctcgtcggcctgtcacctctccggtcacggtggcggcgactctcccagattcagcggtgacactcccgctgactcacggacgcgcacgatgagaaattgggggcatcgtgtcacgccccgaaatagtaccgaccggaaatagcccttgacgctccaaattaacctgttaatcgataccagtcccaggaaacagtgctggtatcacaggaagacggattatcacagcaacagaggtctctttattatagagtagaggtacagtcatgttgggctgcggacagatcccgagctcacaactgcattacaaaaggggaacggaagccaggacttggaccaaacaacacaggcgcgacttgggaactaggccgaaaccctaaaactcatcgtagccggcttgctcctggaagaactcctcatcagcaggatctgcttcatcttcttcagcaactggggggattatttatatagagcaagggtgagtacgggagtgctcagcaaaccatgggaaataagtgtttaatgcaggcttcaaggaaatgctgttgtttttacaattgattttattcaaactcttttctaaaaacaactaagtgagtgcttctcaaacgacacggatgagacagtgcgtctcatccagtcggagtatgtgcaatgtatcagtctttagaattgttcaagattggcacccggccaacaactttcaaacggccacccgggccaacaactttcaaacggccacccgggcctagctgatcccatcagctgcagatttttcaaacatcgaacccctttccaccacagcaatctcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaaacggtccttaagtgcgagagcgggaaaccgtacacccggtacgtcccccggtccgcggctttggaaattcatttagttcgcaagtaccgacccaggtgtcgggttttccaagtcttttgtaaaacccgagttttacccaagaagtttttcagattttaagtttgaaggcgtccgtcgatactcgcacagggtgcaggaatatcgagacgcaactagattggttacaagggaacacgatataccatatcaaggaggtcaatgcaacaaattaggtaggtccgccaatctgccttgcagacgggacaacagtttaagcgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaaaagccctattaatgacctctatgcgtgccattagatagatctcgagatttgaggaattttggaagttgaacggagtcaaacggatttacggttgggaagatattgaatttctaagattattggattttttggtctaaaagaaaaggatttaattaaatcctttatgaaaaagaaaagaaaagaaaaggaaagagggagggaatatagacttttctcgggcggctagggcgcggcccaagagaaatggggcggccggccgagctaaatgggccggccggcccaaggcggcccaagacgcgcgcgcgcgggagggaggagagagagagccggtggaccgggctcaccacgcgcggtcccgggtgggacccgcttgtcggtgacacggctcaccatgcggagcgagcatgcggcgtacgcgcgcggcctggggagggacgcggtgcacgccccccgttcgcggaggaacggttgcggcgggcccacgcgcagcctcgcggctcgtggtggaacgcgcgccgggaggggctgaccggggtcggcccgacccgatcttggccgagctggcgccgacgtggcgtctacgtggcgcctacgtggctgccacgcgggctggcgggaggaagacgaaggcgccggccgtgaatggacggcgggcggcggcggtttctccggggcgccttgcgacgatgaggggcgacggggcgtacaccgggatgacgaggaagaaagagagggagcgagccaacggcttggattcgccggagggagtccgtcggcggcggatttcggcggcggcaaccggcggagagcaaaagggggaaacggcgatgaggtcacgaggggccaattcccggcggtgagagcatctacgcggctacgggaatccgttgctagcgtcggattgggcggagctacgccgagcgaggccggcaacgagcgggtgctacggagcacgggcggcgacggcggcgagcacactgcgagcggcggtaacggtcggggcggcgccggctagctacggggaggctactcgagctactaccgaaaactaaggggggaagatggagcgaggagggagaacggagggaggcactatcgagatgaggaggggcgctgtgacgagaggccgacggcgcgggagtaatctctccggcctcgggccggggaagaggaggaagacgagcgcccggagtccccttccgcgtccacgaatgcaccggctttcccggcgcttggcgatgaacggcggaggcgagacagagctcggaaggcggcaacaatggcgatgggagggagaagagagggagggcgcccggggctttaagggcagcaatgtcggtttggaaccgacttgggcggtcaaggcgcgagctggcgctcggcgctcgcgtccaatcggcgacagggtggagggaggataacgccggcgggaggaaaaaggggaaaaggagggagagaaagggggctcgtccctttcttctttgggaaaaaggaggaggggagcgggggcgtcgcggcagagggaggagggctctgcctccgtcccttggcggcttgcgcgcggagtggcggggccgaggcgatgacgacggcgatgacggcggggcggtttggagcggcgcgacgacacgggcgacaggtgcgggctggcgcggcagagggtgacggcggcggcgaccagacggtcggccactcggcacgcacgcgcggcttgcaacgggggggggggggggcggcggatggagtggcgcggctcgggcacgcgcgctggcggcggggccgagcggctgcaggcgcggcagggcagcggggccgggcggcgcaaacgcgacgcgggcgaggaccacgcgggcgcgcgcgcgaacgacgcgcggggagcggcagcgagggagcggaaaggagg

SEQ ID NO: 51461 - DNA, 2370 bp, Oryza sativa
cgatgggccgagagaaatccggcccatcgaccccaggggagccaaaatagacttttgcgaaggaatttgatttggaaggatttggattcggaaacgagctcgacgatagatcggggattgagatattgagatggcacggacactggacgacaatcaaagaaacaaatttcgcaattagggtttttaagagataactttcccgctaggcgccacgacggaacgggcgctacacatcgtctcccgcccgtaagtccccgctacggggatgaaaacggcgatattttttgcatgcgtgcgggcccaactaaagcagacgttggattcgttttggatggctcagatgcatggtatgtcatccggtgacttgccataccaatgtcaccaaagctgaatccgatgccttggggtctatgctaaagtggggaccggcttagttactttcttgagttttgttagcaagttttttaaaccgctaaacaacgtgttttatatgaaaacttcatatataaattttgcttttaaaagatcaaataaatttaggttactcaccttgatgtcaagttcaaattttaggaccctcatctcgacgtcgagttcgaattacatttttgaattgcaataccatatataatatgtctcgggacttaaaatgaacttattccaaattttaataatttatattcaatcatatgctaatcacatttaatcatattcaatcatctgctgcgcgacgccgtccgatgccgacgccttcgcatccccaaacagtgattgcgcgcgtctgccacaacctcgcatcttagggacgcgacgaaggtatattacagcaattaattccttttcaaaccaaaaaaattaaggtggattcagaaaaaaactatatttttaaaaaacatttaacctgtccaagttcaagttgtagaattggtacgagtgctcatattcggtaattattttcttaataataaacaacctaatattcgacaataaagtacccgcgagctaatttaatcaatctcaagatatgttgatgaccataacaagagtgcttatatatagacataagaggagtaatatgtgcgtatgcatgttcctagaggtgtgtagtatgtgcgagtgtatactagcgtccgcttctatattatttttctgatatctggcatacacgtgcatgctcgcatatattttcaaataaacgaagtcacctgtagcatccaagtagttgtgggggtgaatcatgcacatggttcgacctgactgatacagcagcaaatgcgtaggcgaccgaccgaaatacgtggccattattattactgttattttgaaatttcaaacaaatagagagggcgagggcggcatagggcaaacttttatctatcctttcttggaaccttgatgatcagtaccgacgatttgcccatggacagcaagttaaattaagacccaatgctgccagcgagacgaggaagttctagagcaattgttgaatttttgactgcacctgtgaccaagctgattggttaaaactagagccaaaaccgtttgtgcctcgagcatttaatgtcactagccgctcacccgtgtggtgcacggactattattattattagtgtttaattataatagtacatatgacttaataagtttgttaaatatttaagaacgaactaaaatcagtattaaatattaaatcacttagaagtgttgtaacttctaaactgggtatgtatgcaaggtcgaaataattataatattgtttcaaatagacagttttatacttgcattcgacagatatttcacgttttcttatcctacaggactcatgttttattttttttacctttccttacaagatctatagataaatgggatctgtcacttttttcatgattaaggtaataatagaagacatgaaatgcttttagtaattcatcctacatacagtacatgtccacgcgaatgcgcgggctatattcgtagtttctgttaatagataaatcagtctatatatcgttcatccttgaattttttctgtaatctaatagggcatatttttggttattctaccacatcaaatgttaatagtaaatggaataactcataaatcaacagttaagatcattgctatatggaataaagtattatatatggtggcctcatcttttgcattggttttggggtgtttagatccagtggtgtaaaattttaacgtgtcacatcaggtattatatagggtgtcgcatggggtgttcggacactaataaaaaaactaattacataatccgtcagtaaaccgcgagaagaatttattaagcctaattaatccatcattagcaaatatttactgtagcaccacattatcaaatcatg

SEQ ID NO: 51462 - DNA, 5657 bp, Oryza sativa
attcggaattaaaaaataaggaatattagaagaggagactagagtccatatagaaatacaatttagaaatagttgaaattcggaattaaaaaataaggaatattagaagagaagactagagtccatatagaaatacaattaggaaataactgaaattcgtaattaaaaataaggaatattagaagagaagattagagtccgtatagaaatacaattaggaaataactgaaattcggaatttaaaataaaaaatattagaagagaagactagagtccatagaaatacaaatataggaatataatttagaagtaactgaaattcaaaaaattaaaaaattaaagaatattgaaagatgagtttagagtccacatagaaatgcaattagaaataataaaaattaagaaataaaaataaataatattggaagaaaagcatagagtctatatagaaatacaatttatagaaaatttagaattaaaaaaagaaatattaaaagacgagtcttgagtccatataggaatatatataatttacaaacaactaaaatttgatattaaaaataattaataattaacacgtatataaaatataatatgaaatataagaaataaaaataaataatattggaagaagagcatagagtctacatagaaatacaatttacagaaaatttggaattaaaaaaagaaatattaaaagacgagtctaaagtccatataggaatatatataatttacaaataactaaaatttaatattaaaaataattaataactaacacgtatataaaatataatataaaaattaagaaataaatataaataatattggaagaagagcatagagtttatatagaaatacaatttacagaaaattcgaaactaaaaaaagaaatattaaaagacgagtctagaatccatataagaatatatataatttacaaataactaaaatttaatattaaaaataattaataactaacacgtatataaaatataatatgaacattacacattagtagttttgtagagttattgcaaaatttaaaattatattgttattttaatatatttgaataatataatgagaaaacatataaaaatataatgatgctagccgctcaatctgcgtgggccacaatactactttgatatgaaattaaacacaccctcgatcatcttccgagtatagatgtggcgtacgtgaacatggatggatttgtttctcctgattttaccccgtttgcgtgtttcagaacagtgcctgtttctggtagttgtaacatggagaattttgcttgctgtaaatctgtaattctctccggcagcgcgctctagctcctggcatcagcggtctttcttcaccattatggagctcatgaattttttttaaacacatcacattttattaaaagacaaagtttaggggaaatgaattccgaacacatcaccaggagatagataagagttgaaccatctttaacaagagagaggtcaactgaagaaagaaagcaaacttcctaatgaaactagacagcaataaaggagcaaatctacagggtactgcagcaatgccgtgatgactgcatcgtagggcctgtattgatattgatgtgcactccgcttgacaagccgttaaatcccttcgactgcctccaccggaacaacacatatgaaaggtttgttgctgagccgtaaattttggtgtgagttccaaaagtttccatatccatacctgttttcaaaaattttaaggccatataataaacactaaatctcccaaccctatccaaaatagtatactactgtaagacatctcaatttttttcctctggagggggggggggggggctactcattttgaaatggctagagatttctttgagtgaacacaatccaaagtctcccaaccctatccccgatgagatgttatgcttatgatatagggtggtactgttggttactaaaatttggaattttttgttttaaagaaaaattggaagcttagtttgcctaaggttgttagaactgaggggatcacctatacatttgtcgataaaatttctcctaaaaatttgacaaatgtaattacaatatagtcgtagtgtagttacactgtaaattacgtgtaattacactgtaacaacaatgtaatttgtatgtaactttcacataattttaaaccgttagatctaagtcacaacacgtacatgtgagaggatttgttcccatactctattttaccgaaataacatgttacgtagagatttttaaaagttacatacaagttacattgtagttacagtgtaattacactatggctgtactgtaattacatctgtcaaacttttaggagaaaatttatcgataaatatatagcaaaattgatatgtaattatgacacacttacgtcggatatgaatattataaaattatgatacaaaatgggattagaaccgttctatcttggtaggtaagataccatgatttaaatcgacataccactaaccttacttctaaatacccctcatttaacaaggggcatcgatgtcatttttctcttttctactatctcgtaagagtagttattttaaatgttagacttatactactactacatttgtttcatattataagttgttttgagatttttaaatcaatctttttaggtttaaccaagtttataaaaaaatatagaaatatcttcaacacaaaacaaaagaactatcaaaatatgttaatgaaactaatttaatgctttaagtgtgtactacatttttctataaattggttaaattttcaaaaagaattagaaaatcgaagggaacttaggctgtgtttagttcacgctaaaatagaagtttggttgaaattggaacgatgtgacggaaaagttggaagtttatatgtgtagaaaagttttgatgtgatagaaaagttggaagtttaaagaaatattttggaactaaacacggcgttattttgatacggagtgaatagttccagttagcagcttgtgtgtacatggcacagtacataccagctgggtttgcagagaaagtgtgacagtgtgacagatgtgcatcatgtgggtcacaaactcatttcacagtcacacaccagataagcttcctcccctcccctgcatccactccacagtccaccacaccacaaacgtatctgcggactgcggcgatcgatttgggaggagaggattcagacgacgatcgatcgctcagaattcagatgaccagcgtgaggcgagcagacaaacgcagctgattcgacggattcagaatggcatcatcagttgcaggctcagtgactcgtcgtcctcctcccgtgctgctggcttgccgatcgcgaccaaataatcgtcgcctcatcagattgttaccgctcctcttcgccgtcgtcgtcttgcttgctcttcttccaccatgcgttcatggagctcgtgctctgaatgatgccaaagaagccaaaggtcagtcactgttgttaagatttgctgctagttgatctgcttcgtcaggagagtgagattagtgtttgtgtcaagtgtttgatcgtgaattgcagttgcagaggccagcgaccagacgacgacgacgacgcacgccgcggcggcggcggtggctcggtggtctgtcaccgtgagggaaggaggaggtggtggtggtcacggcagcggccatgccggcgccggccacggccacggcagcggccacggcaggccggagccagccgagcaccacacgggcaggcgcagcgcggcggccggatccgtgcgccctcccatggcggcctcctgcgccgccctccttgtcgccgccgtcgtcgctctgcttcgcttctgaatgaatgaattctggacccgaatcgctcccgatttcgcatttgaatttaaatcgattcatcttgctgtgtgtacatagaatgaaatgaaatgaatccaaatgaatcgccaagaatccgcccgattcggggattcccggcgagatttttccgcatcttcaatctgcaattttgtgtgtgcgctttccaagaattcgagattttgttgaatgcgttcttggaatcgtataatccgttgctaaacttaaaaaacgtactcatctttccacgaattgcatttaaatacgtaagctgccccatcctacggtacaccgagcaaaataaaattcaccaaccatggattcaccggtcaggaaacaatggctgctcctcctcgtcttcttcctcctggcctcctcgtgtgttcttgcagccggtgattcgtctgcaattggcagcaacgaattaacgggcaagcaattcaattcattctctccattgatctctctctctgctcgtggttagattgatctgatcccagtggcgtcttgtttgtcttgaatcttgatgatgagcaggagctgaggagaagaagacggcgagcacggcggcggagttggcggtcgtagtaagaagctcccacggcgatcaccatggccgccacggccgcggtggccgcaagcacaagggcaagaaatccggcgccgccgcctccgaccgccgccccggaggtagcacggcgatcgcttgctgcggcgtcgcctcgccgctgctgccaattggctgcttcctctctagttcgatgtacttaggctcaatggtagtagaagattagttgatcaggggttaattttgtttagctatcctttttggtattctttcactatctttttcacattttcatgttagagtgatttcactggtttgtaaggcggcagtgttaatttatggcattgtaacttaacaccgtattgagagatcatcaaaatttaaattagaactgtacctccttaaaagcagtagaaaatctcatttagttaacattctctctgtctatactctaaagaagaatgggtttacgaaagatattgtcatatttttcacttaattttaatcatactctttctactatagtaggtgttatgaaactacaaggtgatctcatgatgggatcgcaaccgaagcaaccgcgtctcttccactcgatgatccgtcgcaacgggcgcgatggttcccaaccttcgcgtctacggttgccaccccttcattgatcaataaagaacatccgattcattcgctcaattctctcttactcgttctcaatcgattctattcactttcaacagtaggtatgctcagatggattcttaacacgtgttttgatgagggctcagcttgaccccttttttttttctaggcttgaaataacccaagacctaaatgtgccatttgagcattgtaagctctagactacgtactacatcgcaaaacttaattacaatataagttgtaaaactgatttaactatttatttttaaaatgtgccgtcgtaaatatagctaaaaaaaataattctagccatgcaactggctagaatggggacatagataatacgtcatatatatgttttgtgtcataatgccgtgctaaaacatgtttttatttttcactcattttttgggtgttgtcgtttttttaggtgtggctgtatacatccctgggatgtaatggcaaggttttatttaaatccattatttaaaaaaaaggtttttaggtccggtctttcttttaaaacgagccaactctccttgatatatcccg

SEQ ID NO: 51463 - DNA, 7490 bp, Oryza sativa
  unsure (1)..(7490): unsure at all n locations
atgaaaccggagtacaaggacccaagaaagaaaaagaagtacagaaactctgcacaaaaagaaacaagtatagaaaacttagcatgattactactttatgctccaaaaggatctaaacaagctaagctaaatatagttttaaacaagaaccattaacaaaaacaccatgccaggccaaaattcaatcccataaaaaaaatggaagactaattgtctgtatggaaggagctaactctgaatgttgctgccaacacaatcattactagttttagttttgtgcctaaagttgatcttacaaaccatttgagcttcctggagaagttgttacaaccatttgaagagtagatgttctactgattcgaggcactgaacaaaacatgctcctcttggatcctttccacactttggggatcaggttttctttagtgagaatacaattctgcagcatcaaccatatgagcaccttaatcttcagaggcaagtttgtgttccacaaatacttgtgtgtgaacgctgcctgagtgatttgatcaaattcaaagcctacctatgcatatttgcctaaacagcacaagttagtgttctacatgacttgttccattctgaatagctctggtccttagtaattattggctgaatagctgaatgatttgtgataatatttcatgggtacaaacaaataaattaactatgataaagttggaaaatggatttaaaatagtataacaagaaattcgcacatatatatttttttctacaaaatcgtaccgtttaggagtttgggaagcattcatgttaattctattcattacaaacgaccaggtcatgacatttcataccatcaattggtacaagacccacatgcgtaattgggcgggccaaacaacacatctaaaatgtgcaataatagtactagtccttaaaaaaaacaacttggtgcatatcttttaaatatgaccaccttttgctgcattgttgcttattagtaggataatgcttttggggaaagaaagctgaggataagaaaaaaaaaaacaggaaacatgtattagtgctggatgttacaaaataaagaaataagaaaaataaacaataaagttggtgtccatagctctggcagtacaagtggaaagttccttgaagaacttattctatctcatttttaaaggatttttaagggaaggatgaagagtgttggtagcagaggcagagtatcagttcagtttacactactactacatcattagctctgctcattgcagccatggagagtgcaaagagatcttgccttgctatctccctcatcctactcctactccttgttccaagtatccatggagcaaggcatgttgctgcagctatcaagggtacaggtacgcagtgttccttctcttctctgcatgtctgtcttagtaggtttcttacaccatagtatccttatatgcatcgtttttttcagctctatgtttctatgaaacaaatgatgacaactcccgtgtatatatgttttgtattgtatctgcatagaactgtatgtttctgaatgtttgtaaagttgttattaacatgatttctatggttctgttggggttggacatgatgttcgactattcaacttaactttcgttccactacttacaatattagttttgtgggaaacacatgaagatttgtttgtttattacaagcattatgcacgatgaattttttgattatgtcaaaagtacaaccaacaccagaagtgggtccctaaaaaagaaaggcaagattatagctgtggttggttccctttggctaattgccataagtttagataagcaaaaccttagaaaatatttgaaatttatctacaccgtgtatttcttgaggaaattatctacaccctattatttgtaaaacgtttctaatttcattttgggtagcctcgcataagttgtcgtcccgtttatctatctatatatcttccttcctcactaatcaaatgcatatccacctgcaaaatgaacaaaagtaattgcaatgtcaagcatggccctactgattaattgtgtccgtcgatggaccgaagaattcagtactaaattaaaatgttcagatctggaagaaatttcttggaaaacaaagcagttgatttccttattgttaaaatattattcagtccaaacatgcctatattagttagtaattaacttattcaaaacatatcaagggtctggctggcctagatacttgaatctccagtcaaaaatcaataaacaagacaataataataataaaaacttgatgaatactcatgtggtgtgtgagcgcgcagatcaggcatcctgcctgaaaaccctgtcaagaacagatgctctgtcctgtccatgtgggggaacacagtataattaatgagatattattcccctgcatttccggagacccttgcactgcacgccgttaatgatacttaattatattcctaactaatgctctcgtgatatcacacaaagtgattattcaccaataataaatataacatggcatcatcacgtcctgtttacaaacaaacaacctgatgatcatgtgtcatgctcgatccagaacaaaccataaaaaagagtagaaaaaaacaattttaaattttgaaggacatataaaatcaagtactcgctctgtactactccctccatttacttttgatagttatatttccaaatctgaaaaatttatttttgatatgtatatttcaatccaacaacctatcaaattaatgatttttttggatttaatgcgtgactcttcattcttccacacaagattagctatataggcatcgagaaatgtaaatattaatgaatcgcttgtttacgaggaatgactagtagcatgtttaaatggatgataagtaggattatttatccttggtctatatgctaagatgaaatatgactattaaaagtagatggaggaagtagaatataaggatttttagggttagacacgtgtaactagataaaattaaatgggattgagaagtggaggtagatgaaaaaatttgaatggtgaagggttgtgattgattgagaatagaattttggtgaagaagttttatattttgagacaaatcttaagggttagaaattgttatattttgtgatggatggagtaattaacttgaatatgttattttatgattatctaaaaaaatatgttattttgtggcacgtgaagaacagaaacttgctgatacaatttcaattgatactatacgtgtgtttttttttatatacaggcgccgacagcgagatggtggtgacggagaggacggccggcggcggcggcggacatggacgcggttacacaagccaccggtcgcacaaccccaacaatcccaacgacggtggctccggcacgccggtggtggacccgcacaatgtcgccaccaggggccaccaccaccgcggcgcggcgacgaggacggccgccggcggcgacccccgcctggcagcctgcatgcttcgtctgggagcgaccttcttcctgctggttcttggctgaattatttattggaggatggatatgtggttatttttcttaagtttttttactgctttttaaatttaatttttctgcgtttttgatatagtgtggtcatagttttgtgacatgttaaataccaagagatgatacaaggtgtatatataccatgtgcatgtgaagttgggatgtgtgtgtgttttgctttgcgtgtatgaagacatatgtatggagtttgtttggcagaatgtgtggtttatatgtccatatcatattgttcaatgtagtactaggacctagagatcagagagcatctcaaatcctagtgctatcagtacagatcttctatacaccttagtgtaatacacccattttggatttgcatttatacacttcagaaaattttatatgcaataaacaggtaaaccatgcttgtgcatactcaaaatttagtgtaataacacaacaatatgtgaatatatataaattgaaagttgcaaacaaatacaaattttgtttttttacgaaacacagtacaagcacacagatgctcatatacacacgcgtgcattgatcccaatgaaagcacacgcagaaatcctagccttaccaattccgagagattgggctggcatattttgaaattgacaaagccaccattgacatcttgttgtcaataacacgtcgtcaccatggaaataataatttgctgtaaatacgatcactcatgccaagtctagcacttcagtgtcagctatcattggcaggttccttaataaaaaacagccgagctaacctcagtttgccaagtttcgtttctttcaagattggggaaatatgtttataaatggattatttcaaagccgtgaacaaattattagttgcatataggagtgtttagaacttgaaagtttcatcaattttggaatgaaaataaattttcttgtaaatatttatttatttggatcaatcaactattttttgtggtttcaatcgtactttgctatgtatgtaggtctcttaatgcaaatgagaaacttttggagaaaaaggtgtaagcactcagaaaatgtttcagccataggctcggccaaatccccaaaactaactaattagatccatgtacgatcagacatggatcgtccctggtttcctttcacaaactagcgtgacctgaattttgcaacctatagtagatgtgctacataagtctagtttgatctagcaataggagatatcaataagtacgaaacgaagaaagaacaaaaaattaactgtatttaataagtaaaagaaatacattgctttggaccagctattggccactcaacacacattttaatggaaaaacagatagatttttaaaccatatgattaacaacacgtagcttacactagacaatataaaacacataaaaccaattaataagattaaaataataagaagttaattagaaaatacatattcccctgtcccaaaatataaaatttttttatggatgcatggacatggatttagattcgtagtactatgatatcctattcaactaaaatcacttatattctgtgccacaataaatatgccattttagaaaaatgccactactattcacgattttgcggatggcgtcaaggatggcggcagcggcggcactcgagacctcccnnnnnnnnnnnnnnnnnnnnnnnnnacggcggcggcggctcccgagccctcccacgcggatggcatcaaggatagtggcggcggcggcggctgcaggttccgagccctcccgtcgcggatggggtcgaggatagtgacggcggccggggctcctgagcccttccgcgtggatggcgttgaggacggctgctcccgagcctcctgccacagacggcagtggcagcaacggctcctaagtctcccgccgcagatagggccgacgatagtggcgacggtagtggctcctgaggccttcacggaggtggccgatgacagcagcagtgacggtggtggtcgacgacagtggtggagagagaggaaggggaaagagaagagaggggagggaagtgaagatgaaactaacagctaggtccctcgtgcagttggggttagcggagatttttgacggaaaacgtgatggagtggtatggttctaattttttcaaattccaatggcacgtagccaatattgtgaatagtaatgatatttttctaaaatggcatattttgtagtggcatgatccaattaacccttaaaaaaatatcacttcatactgcatgcacgcaactggccctcctcgccttctcttccctttcctttaatcttttctttatagtagttgagataatatttgttatttatcatattaaattctaatcaactacaaattcaaaattacacataaaatttttacatacatataatgtaatagttgagataggcttaaagtggtgttgacatattttaaattataataaataaaaatgttttttgggtcatataatgacccttttcatcatatatgacaaacaaatggcgacatatattattttattatatatcacttttacaaacatgcataactaaattcgctctacaattgaaaacgaagtttagaccatcatattatttaccattaaattaatattttactatctgttttgaatatatttcaacttataaaataaaattatatttcaggttgcattttgattcttttcatataatccaaacagacatgaaaattatataacaaatgacaatataaagcatatcattatatatctgttatcagttgacaaatatttatgactaaataggatgacaaaatccaaaaatgctattgacaaacgcccaatttcaaccaatgtcatcaacaattttatttataaatactctacacaaactaatttcatttatataattgctctcttatttcaattttaaattcatttttccaagaacatagtaagtatatgaaaaaaggaggtagcagaagtaaatataaatttgttataattggacaaaattttcctcttaccatatatatcttaatagaaagttttttccattaaaatatcctaaattccataaagatatctatagtacacaagaaaagctattacttaaagtttagaaactccaaaaatatgatatactaaatattaaaaacacatatagtacaaatgataggtccatacgaatcaactccatttccacgacacgatattttctcataaactcaagattttatgaattccaataaataattttaatgtagaatttatatgttgatagggtagttagaagaaaatcatgaccaacatttaaagcagcgatcctaaacaaattatggacaaaaacatatttagaatataataaaaacatattacaaaaaaatcacccacatgttaatattattcataaaatttcaagcaacattaaacaaggtgtcagtaatgtgcctgcggctaccttttctagttacaaatataaagacgggacaagtttttctggagctacctaattaagattcggcaatctccattattcgttgttgaagcactctacataagagttatgctccctgccttgatcaggtagttaatatgtactctcttcttggtgatttttctccggtcgggaagatgaaccctaataaaacctttatgtagcatcctgagtttgactcctttacttaaaaacgctttttattacgttttaaatttcaaaattttgaaatctcgtgccattaatgatttcaaatttgatcaatatatccctccatctaatgttccctccaaaattcatcaagttttaaattcataataaaatcctgaataaaaaaaataaaaactgtactccaattccaatcccttaataatctatatacttactgctataaaaagcaccagttcatcgaacacttatctttttcgacccttagatctattcatccaacggattatatcaagagttggatca

SEQ ID NO: 51464 - DNA, 4140 bp, Oryza sativa
tccccacgccgagcgcggacgcttccctccccttctgtcgacgcgtgatctcctcccccaccacgagccacttccctcgatccctcccgtcgaccgcgcgccgcctccgcctcggcgagaacccagccacgggcatgcagggagggaatcgctcctcctcgccgaccgtctcccatgcctccttccatcgcatatgcgcctcaccggtctctgccctcccattcgccgttgcagcacctcgccggcctccacccccggttgaaatcccgtttttttttttgttttccatcggttacctgcaaatttgagcctacattgttttattgaaacgtggtctgtggatttggttgtttcagccaacgtggtttatggattttcaagtgatctgtggatttagtgagttgcattgtaatatggtattgtagatcatgtattttaggactgacttttacattaaacatgccccatggtccatggatctgtgcatcgtaatatggcctttacttatctgaaaattgcttgtgaattttgcttctttatattcatcagaattttacttatctgaaaactacttgtgaattttactttattatttactaataatagcttatttgtatcctgaatcatttgaatagcttttagatataagggaagaaaaatggaggagctgttggcctgtgcttggctaacaaaattggtggagaggtatcatgtaaccaaatcaagcacataatcccttttcccttttaacatttatagtttctaatataaagtgttctaattggggtgagactgttgactggcttaccatcttggcccctcttagtacaagagaatatatcacatcgaagttttccttctggacttcatgaaggaattaatttttcacaagtatctttggcctaatcactaatcatcacactttgtgcgaagaagtcgagcatttctttgtcggtcatctcacaagtatcgttggcatggatgtcatgctggcctaccccctgaatggtgctgcttcagtatttggtggacttcaatttcagaatgatgtggtgctctaaattttttttccttttttttatctcaggtttgacctttggattgcatcttaggcttttgcatggtcttcgactggtaataatcttcagaatattcacatttcctgtgaccaatacatacctaaagtctagaatgtcactatactttggcatggtgcaaactttggcgagttctgaaataaatattcatgaatcatgagctaacctctggttaataagttttaacattaagatcattgatttactacatccaacattgatgttttaatttgttgggataaaaatacatgaattgctggttgatcaaaataaaagttattgcttagggagcaaccatagaatttgctccagggaatttttttttgtcctaatgacacattgattttcaaattctatcaatccttttgtgtgtgctgtgcaaatctaattcattggaaaagatgttagaaaaaggttttccgaaaatgattgataggttttgtgcaaatctaccccacaaattggatttgaaaggctggttgcttagttagatccaaaaatcaaacttttctatggccttgggccctaatagtcaaccttttttcagaaaccaaatcttcatttcgccggcacaaggattgctgcacctttacatttactaataacactcttattccatatagtccatgcaccgctgccaaccttgatccacatcaagcctccgcctccaaagctacaggagaagatggttgcatcaaactcctgccttctttctcttcaagtaacatcttatctgtgttttgatggaattttggaacatgcatggataattttggtccgtgttttgatgatttctctaatttctaagtattgaccatccagagaaaattcaggtcttctgttactcatagtaaatatcatgatgataataatagtttactcctaatggttctctttgttccgctagaaagaagtggacgattgtttgaggaagtaggggagagagtgaagcatgtgatttttcaggcaagtttgtcaaagccatttgaatgagaggctcaggatagctggtggtaaagcacagaacagcattggcgctgctaaggaggctgatctccgggcaacctaatgttcattcatttgcgacatcagatttgggctgcaactgtgagttcttttcaatcttataatcaaactcgatgcattcttgaatgtggtgcaacagtttttcttttataatcatactatattatataaattcatattgtgaatataatctagatatagactaatataaaaagcacgagttgtttagttgcaattagcgcttaaccctccaattagcgcttaaccgtcgccaaatcgaaaaaaaccgcgccccgcacccctcgcctcgcctccgcctcctccgctcgtgcgcgcgtgaagaagaaagaggaacgaggagagaagaaatcgagaagaggagaaatcgagaagagaagaaaagggacactgtcaggtgggacccatgttcctttaattaatcttgcacagtaatcatcctcttaatcctgcattattatctcattgacacgtgggtccggttgcacaaattcttgattaaatctatatctatactctatactaatctactaatataaaaagtaccagttcattaccaatcccgcaatcttctagacccactctcacgtgggtcccacctgtcatccctaagaaagaaaccgcaccgcgcacgaaaaaaagaatcgctgcgaaaggaagaaactgcaccacacgcgccatccccatgccgccgctccgccctcctcacctcaccggcaaatcaatccaccgcatccactggccgctgccgccgttgccgcgatcccagaagattatgcgggcaccaccacatccatccccgacgacgtgttcttctcccacatcttcgtgaacctcccagtaacatccctcgcatgtttcagggcagtttgccgctcgtggcacgccgccgtcgacgaccccgccttggtccgctgccaactcgagcggttgcgcgcgaggcagctgccaacgtcatccttgcttgctgtcgcgagcacggaagatatatgggacgagaaagcacactctccaacttcgaggttgtcagcttcaccggctaaggcttaccctgcgggcggcggctagaccaggagcgagagcggtggcggcgccgccgctagacatcaccgccgagactgatccgatgcaccacaagtctatccctaacggcggccgtatcacccgccatatcatccccacccactgcgacggccttgtcgccttcgccacctacggcagggccatgctcgtgtgcaacccggccacccaggagctcgttgtgctgccgcccggcaacggcagcggcccatgcccacggtctacagaatcaacggcggcggttggcttcgacccgtggcggaacaggtacgtcgtcgtcaggtgcttctactgcaagtcccacaacgatccgccggtctacaacatcggacacgagatcttcacgctcgacacaggcgccggcgatggatggcagcgcatgcaagacccgtcgcgtgccatcagtcccggcgggaggagacccgccgcctgcacgcgtgggggttccttctactggttcatcaacgagtctcagccatgcgagctgctgtgattcaacctgcgagatgaggcgttcgacgcggtcccgtcctctctgggctgcacggcctgacacaacgacgaccgtctctcggacctcgccggtgagctgtgctacgtgcatcacgtccgcacgagcgtggccacccacgaagtttggatggcggcggcagtcgatgacgatgactaggagtggtggctgcgataccgagtggacctgtgacacaacccgtggggcgcggcggcggcggcaacggccaacgctggttccacaacttcggcaccacggtggccggcgacgatggcgtggaggaggaggcgacgttggtggccatgttgtacaaggagctgtggtggcacagggagcggagcaaaccggtggtgaaaaacgtggacatgcaggggaagccggtgcagttgtgagtcggctcatcttgaa

SEQ ID NO: 51465 - DNA, 1619 bp, Oryza sativa
tcacctctctctcaggccgggctagccttctctctcctatccttttatttttcagcccatcagtaagccggcccagtccactccctcctctttttttcctacgcggcccagctagcacgggccagaccgaccaacacgtgcccacgcacgcagcttgctcgacgcatgccgcgccacacctcacctcgggtcggccctgcctgctgcagcctgcatccctttagggcaagcttcacagtggagatgatagtctcccttaattcagttcacatcattaactcattaatgaaaatgtactactccctccgtattttaatgtatgacgccgttgactttataatcaacatttgaccatttgtcttattcaaaatttttgtataaatataaaaatatttatagcatgtttaaagaacatttgatgataaatcaagtcaagataaaataaatgataataacataaattttttgaataagacaaatggtcaaacgttgattaaaaagtcaacagcgtcatacattaaagtacggagggagtatatactacaacaaattacctctagcacacttaccataatacatcatattaattttgatttatttgtttgctatcaattcattggtctcttgttcttatatctcttaaagtttgtatagaggttgttccttatatgagaggtgtctctttctctctcctttcatctctctcatccacctcatcatgtgagcttacatggcacctaggggtaagtgtgtagaggcttagaccattcccaacccaatgattaggatggtgtctatagcattaaataagctgtcacctaggatgaaagatgatgcggcaagtgaataaatgagtaaagagaagggaaacaagtttggtacgagacatggtttctacacaacatccaatacatcatatgagataagcagcattaaatttaagtatggaaaaattgtgtttgcgttgaaagagtagtgtagtttattgattatgtgaagtttatgtaaactatgtctagtgttttgggttgagactggccttatactactggccactatccacttctccccaccgtcacaaagaagacatacgcatgcattagagtaagttggtttaatagtgtagccaactactagctccaaatcatctatggccaaattaatagccaatttgtataatacttactcactacgctattaatatctggtcccacctgtcatacacattatgtcttggagtccatgctgtaggcctgtagctggctatagatctgtagcccactgtttttctctcatcttttatctctttaaaatatgattatatctgatttataataatgctattgtacctgctcttgtatcgaagaacacggcaagatcacactttctgattcactttcttgtatgattttattagatacaagagaaaggtactactgcttttaaaagtaacgagctaaaaacaatcacctagactcattaaagtacttgactccttaattacctaactgactcttcgattatctgaaaaaaaaaatccttggttacttaattgactgctgtatattattacctccggattgataatacttatcgttttagaaaggatgaggtcaaac

SEQ ID NO: 51466 - DNA, 1630 bp, Oryza sativa
tttattctcctactcattctctctaccgcacctttcctctcctactcttgttatacactcctacttcctctcatcccttcctctcccccatcccactctagcagctaaggcggatgcggtgggagcgggcaggcggcgtcgacggcgaccactactacgatgaccgacgacaacttccgcgacgaccggcggcattggtggagggctggatctgctagtgccaggccttgggtgagcgggatccgctgccaccaggccttgggacgcacggatctatcgttgccgggcctcggcaacttggaccatgtcggtagtgatggtggcggcctcgagcgacaaccacgacggtggatcctggcacgacgacggcaacggatcctacgtgacacgaccgcggattagggtttctgtgttatatagatctagggtttttgttttcggaattgttttgtcgccaaaattatttttacatgcagacggcttaagcatctgcttgcgaaaatcggattttcgcatgccgttttgctagtgggccacccgtctgcatgcaaaaatcacttttggccgcatcggaaaacgatttccctatcaactacgagcacaagagccacgccgccgcaccaccttggtctccccatccagcgctgcttagcgcccccatctgaagatgcgtcctcctggatccagacgccaccacttctgctgccaccaccaactggagccggcccgcgtcaagctcctccatggcctgtactgctgctcgtcgaagccgtagcccgctgcccaagttcatgtcgacaaaccacgctgcccacgaaattcttgcccttgccttgtgatttgctcgatcgattgctttggttgtagcaatccgatggaatccatgctgattttattgggtttgagttcaactcatgactatctcagaatcctcgttcttcccaatacgtgtacggctaggtttcctccttgattgtttggtatgcgtgtctaagggtctgtatgggaaagcttctaactgctgcagtttctttcagaatcagaagctcctccaaacagttcagattttgatccagattctaagaaactgtagttgtagaatctagtaaatgaactagaagccaaaagctaaacccagcttttccagattctcagaagctggctcaaccagttgcttctcagaatcttatgctccccaaacagaccctgagtgtagctccacgtccaagtaatctccatcgcaactgggcacacagaatacgaatcccacacgatctaggcttctctgaagcctgccacgaccgacatcgtccctggtcactttctcggctcagcctcgacatagatcgcacacaccgccttaaattgggtgaccacctgagcctcatgtacatcctgcagccttgagcaccttcacaagtaccttccgtcaactccgccatcgacgaagccatcgatctgtagaattctgtgcatgtcgcatgctgctggtacactgtcttcatagcaatccatcgtttaaaaaacttagtcgacaacacctccatcagcactctagggtccatctgttccgacgtccgattgaatgccatcaatctagtcacgagccgagacagacaaatcacatgtc

SEQ ID NO: 51467 - DNA, 1128 bp, Oryza sativa
tcctgtaggctctaatactacttattatagagcaagcccgaaattaccatcgaaaaccaaacgtggcagaaacgccataggagatccaaaacagatgacgttaccgaggcacgatatgtgataacgaatttcagctgaagtctacatcttctgggtactgattacaggtgctcctctctcatccagcatattatagcttatcagagttacaatgaccctcgaccagataccgatggtagtcgctacctctcgcttatgtgaagttgccattgtcgtcatgcagttacaacaggtctgctctctatttaagagtgatcctcgggtagagtctgactcttaccctatttcgatatccagtacaactccaaattctaaactgtaatcaattttatacacatatttgaacaaacactaacaaaatgttagagtttactactgtggagataccttgtccggccaatacagaagttgagactttactaccgtggagcggctttttctaaaagatgagagggaaactagtgtcaatggtctatatctgcagtaataaaaggggtagtgtataaggtctaaaagtggatagattgtagggacaaatgatttagacaggtttaggccttataccaagtgtactgctcccgctagaaaatcatctcctgatgcctccccatgcatcgcagatctgcaccaactcgatttccttcctttccatttccaacttattaacctaagcaacatggaagacttgcgtattattcgcgtcttgttgcccaggaaagctagctgctatacacaatgctaaacagccttcgatcgagtaaaaagactaaacggtgcactaattcacatggaaggctgtgttcttccccctattttcccaactcagctctctcgttttccgcaagcacgcttttcgaactgctaaatggtgtgatttataaaaaaatttctactccctccatctacttttgatagtcatatttcatcttaacacacagaccaaggataagtaattctacttatcatccatttaaacatgctactagtcattcctcgtaaagaagcaattcattaatatttatatttctcaatacccatgtagccaatcatgtgtggaagaatggagag

SEQ ID NO: 51468 - DNA, 4048 bp, Oryza sativa
ttctcagttaaatctgttctaatatccacggtacactaattcacatgaatggagtcatggttgcaccgggtgctctgagatacacctacaaagctaggtataaacttaatttcctcatgttattatgccatccatcaacgacgtcacatacgcataggagtgagaggcatcaggagtattttgcaaagcactgcacaatggatcagcatgggtgtttcagcgcatttatagtaccagtttatattagcaaaggagcaagtcgcttcaaattaaattacctgcaccaacgtctgaagcactagtcgccgcaggattgtcttatctggctacgtcttgttacacgatgatcactatgtcagccgaaaaatgactggagaaaccattatacatatatttctctatatatatcagtcagcaaaattggccaactgacaagtcagtatgtcttctgttagtgagcgtgccctttgttcgacgacagtgagaaaattaaccagtaactaatcctgttttccccagccaaaacattgctaggtggaaggggaaaacagatccaacagtaattgtgtcgaaggaaatgttgaggattaatagtaagtttgttcactgggtactggaaagaatcatatcatcggatatccgtctctagaaacaatcaaccttattattattattttagatgtttaattttactaaggtttacattggatatctatctatctattatatacaaaaagtccattaaacttcctacaaacgctcttaagccgccacgtggcactcctacaaacgctcctaagtcgccatatggcacaatttaatctcaccgtcgattttcacttaaattggtggacccgttattgtagaccattagatcagatctattattaaaaaataataacttttgtattgtttataacataggagcgctgtccgtatgtatgattttgtacgatacaaatactactgctgttcttcccgtatgtatacaaacgtacatgattgtgaaaacaaaacgataaaatttcctaatcttcgctggaagaaaacaaatacacatgtatacataaaaaagacagagaatttatatatgcattcataaaaatcaacggtctttttaaaatatgattttctacaatataaagataaaatatattacttcacaaatatcagtatgtttagttaaactaagatctataataaatatttaatcaatgttcctttaaaccatcttctaaatcaatctattatatactaaaagtatattatacgaatgcttttacatcgctgtatattatacgaatgcttttacatcgctatgtggctctcaaataaattagagaaatcattgaaatcttttatatactaaaaatctattatatacctgcaaatgctcttacattgtcacgtggcgctctaataaaattaaaattaaagaaatccaaaatatttagagtaaaaaaagaaaagcatcacccttattttttcacttaaattagtagacccattattttaaacattggattaaaggttcttaaaattcccatgcggctaatctctatcccggaaagaaaatataaagtgcttgtgtcgtacgatcgtctccctcccaaaaaaaaacaaaacttaaatacctgcaccatatacgatcgaaaaaacagttaaagccaaaaaaaataaaaaaagaaaacatgcactagaatcagaaagaaatactaataaggaaaaatcataagtgccggcactgatttgttgtcaacagcctttaatctacgattttaataaaataatactacacagttaaaattaatcataaacttattgtagtgataaatatatcatcacaaatgacaccagcatgtaatagcaaatgtgataataatgtttcaaataatttcatatcatattttatggtgtcaaatatcacaaatataaagcgttatcttgaatctacatatgtaataattaaaataacaaaacctagcatttttttaagtacatctatttaggtttatttaattttggagagattgagattctcaaagtatttggaattttttcaaaacttttcttatttgagctgtgagaagcataattaatagattgatgagaaacattaaattaaattttagccagtgataataaaacaacataatttagatgtgatttttaagtggatctttttaagtttattttgggtgagattgagattctaaaagtatctgaaatttttcaaaacttttttattgctctttgagagtgagaagcatacatgatagatagttaatttgctacaatacaacccttaattcatcacaagaattatgtattttctttgccaagtagtattggaaaaacatgaataatccaataaaatacgcataaaactacttatgttatattttttatagttgatagagattcttatataccgggtataattgatggacaaatgttatacaccactaaacccaactgtaagtgcactctagcgaattagttattgtaaataagtttgtgaaaataagtacattcttagtattagtaaatgagtctcgtattcttagtattagtaaatgagtctcgtatggttgcttacaacatatggtggaaacaaatttggtgctaaagtataaatctttatcaaaatataaataatgatatggtgttttgcatattctcatggtggtatgtctttttagctatagtttttattaagtattgtcaaatgattaaccccactcatttgaaatacataatattgtatgtattccattaaaatttgagaagtacttattactaacttcatatgaaaaaaatgcattttcatcaactcctcctttctgtccctctgtccttgaatgcagggtgcagtacttgctatgccatcgtaaatattgcatgggtatgtacatggtttagttaaaggtagtgtccgtgaaaggtcaccataggcagtgccgccacagtgtaactaaagtgacatacttaccatataatcatttgtgagtgtactgatagtaaactaagtgttaaaattgcactctaggatggtttttaggggtatggctacatcgacgtggaacctatatgtttcaaggcattacatacaaaagccttctttcgcagatacagtcgacttcatccattagagaggcatttatgtttattttaaacagtgttatcgtattattcggtagatatagtatatttagactatttatatatagatgcgaaaataagtgatgaacaccgggctatgcaggtagatgaattttttagtgtattaataatgtattatttgttttagtggtactaatacagtttcatttattaaaagttgacctaactcttaaaacaatgatagtaagtagtgatgacaaacgaccagtttatatatgaccaggacaaaggtatttttgtttaaatctaagaaacattcttatcatgttagaagtattttaaaatataccatctattttatggtaaatatatttctttttttttcttattgtagggtaatctaacttctcttacagtgtgtgtctctagcatatgattccttttagcattatatgattattaagatatatgattccttttagcattatttttttaataacaaataagatgcctgtgcatctgtgtgaatttcctttccgatttatattccacaaatcaaatgttctccggttcatatcctgtcgttatagcgtttgaaacacaaactataatacatgcccacgcgaatgcgcgggctaccttcctagttggtattataattagtctaaatcgcgcgtgcattttttctactcccttcgctccaaaatataacaacttttagcctttagaatttgtcccaaaatataacaacttatttaccaacattttcttctcaaccaatcacaacccttcaccattcaatttccccacctacctccacttctcaaccaaatacaatctttcaccatttaattctacctattttcttaataattgtgtccaactctagaactttcttatattatgggacggaggtaataatgct

SEQ ID NO: 51469 - DNA, 8843 bp, Oryza sativa
  unsure (1)..(8843): unsure at all n locations
cctgcaaaaattgtacctaccaaaaaaatctaactccttatcttctcctccaccccctccccaccactcatttccctctctctccctcaacggcacttctccccaccggccaggccgggccgtcccctcccctcccctccctccctccactggcggcgcggacgtggcggcggcggcggcggcggctcccctcccctcccagatctggccggagggaggccgggggagggcggcggcggcgaggcatgtggtcggcggggcacagggcagcgacgacaacggctccggtgcggcggcggcggcggccctcccctcccctcccagatccggccgggaggaggccgggggagggccgcggcggcgaggcacgtggctggcggggcgcgggggtgcgacgacgacggctccggcgtggggcggcggcgcgggtcgggtggcggcggctcccggcgtgggccagcgattttttttgttcgtttcttccattttcgcaagcgggccgttgccccgactatattatagagtctattttacggactggtaatatgccatacgtagttatacttatacatgcagggggctaagagctattctataccttccaggtatgaacaaaaatttatattttttctgcgcacaacatggaaacatccatgtgtcagtatctaaacaaattttacaaccctgcggcatgattactaggaggtgcaagaaaaccattgttaacaaaagagagcttttacgatgtttgcattccaaaaaaagtaaacatccaacgcttctcaataacatatatatatatatatatgatgtaaaaagtatttaagtattagtgtaggtacttaggtatcaaagtttgaatataaatttgctagtaaagagaaaagggcagaattgtcctcaaatttaaatcggtaccgcataggtaccacttaagtcatttgcctggtactagcgtacatgttttcttttgcgtcgtttcgtgtagatttacattgtgttctttgaggttcttattcgtgtgattttctctagatttacattttgttctaagaacacattactaacgtaaagattctcatttgcgtggtcttctatagatttatgttttgttcaaaagaacacatgactgtgccagagcttctcccttgttcatgtctccttgctggtccacatgttcgaaccctattagaagaacagaggagatctcattccaatctctcatacgaaggaatttgtaaactatctaaataactaatcaattgacatcaaggagatctcacccgatgggctccacctatgccattgactggtcaatctcgtctcatgttgaatcctcaacaattccgacggttctccctctgttccttttgggtgaatttaggtcaaatcctagagcaagaacgaaccaatgtggaagaagaaagaagacggatctgatatctttttcccgtgaagatctattcaatgcataaatcaatgcctgatttatgtttttcctactgattggtactggttcagtccagccaaatattccatccacttaaaatgcccatgttttactatttaattacttcactaccatcggttacaataaattttattccgttccttacacctctctcgatcaacagtccacattactccacctctcaatacttctaaataccttgcaaacacagtaaaagctaaagattgtcatatattagacatacacaaaatttataatgaatttgtttataccttgaaacctaaagattttcttgcgcgaactaggatgagagagagaagcatggagagagtgagtagaccaatcttaatgatcttacctagaccttactttattggaaaatatcatgcaaatccactttaaccaccaagtcccacagctgaagatactccacgatgacttggacagggagggctccttcgatttctgtagtccatatctatgaatttctaaatcctgtgcgacagtacggtttttaataacctttttatatgaaccaaattgataagattaggggccacctctgttatggtcctgtattgtatccatcgatcggaccaaaacaagatggattgactattcccaaccattgcttccacggccatattgaaaatagcatgagcattgcttggaaattgaaggtccaatccttaccaagctcgagcaccattgatcttttgcaaccaaacccaccgaatgcgaaggtcccgattcatgagctcgtgaattcctaaatcaccatacataagggggtcgacaaatccgctaccatgcaaccaaacaattaccacagttagccctttcatgcccgacccataggaaaaacctcttcgccttttatctatttcacaccttgatcacccatttagggatatccattgtgatcatcaaataaatcgggatggcccatagaactactttcagtgtggtgagtctcccagctctattcatgagggaagctttccaaatagaaggtgttggccaccttatccaccaagaattgtagctcagctttgctaggtttcataatattgagaggcaaccacacgtaggtgcagggaaactcttttactccactagtcactagcccagaagcatgactgaacacatctaacagttgcttgatgatagttatgtcattcactgttggccttaggaacatatatataaccgcatcgtcaacataaaaagagcatctatgttgagcatgctgaatagataggagctgcaaccaaccttcaagagaagcatgactgaacattgagttcaagacatccatgaccaaatacatggtaattatgtcaagtggatagacattataagcatcagctaaatgtttatataatcttattgtacttaattcatgcccagtgcaatctagctaatcaaaaagtttgtagagtgattggtatcgagtacatacttcctaatatttaattataaatttcatacaaaaatttaaatcacggaaacaataaaaaaatcatattccaaacataatgatgccttcgcagttatatttagccttccaatcatgttctctctaggctgggtggagccttgcacacttgcaagaaatgatccaacctcgaatcctccccccaccttccccaaatccatcaataaataaataatgagaacctatttagccttagatgtttacacaaaagttgattgagttttcacagaaaatggttgatacataaggtataacgctctatcattaatattttatcatctcaagttaaaataaagttgtataaaataaaataggaaatacaaaagggagcaaagtgaactaattatagaaaaaaaatataaaactcttacattaaaaagttcttagcattcacttaagtaggatacccatctatctatctatctattatatactaaaagtccattaaactttctataaacgctcccaaaccgccaagtggcaccctataaacgctatcaagtcgccaagtggcacaccataataattaagagaaatctgaccatctatttttatttaaattggtggacccattattttggatggttagatttacttagatctattttatctatctatctcctatatatatatatatatactacgttcaagatgtttccttcgtccgtaaataaaaaaatataaaaaaaagtccgatcgtaattaagaaaagcccagggcgaaaaaaaaagtgtggaaaaaaaaactgaccgattcctatccttacttaaaaaagcggaaaaaaaagtgctgaaaaaacgattgtataaaaaggaagcccgtcacggcaaaaataaaataaatttttttgtccgtttcccttttctttttccttttccgttttattttattttttaccgcttttttctttcaccgttttttcgggttttttcgtccgttttattttgtttgcgccgttttttctttcaccgtttttctggtttcgctttttttgtgtggttttttcgtcgggccgaaccctagcgccgccgccatatcgatttgcatctttatgtatttccttatccaatagattgaaaaaccgattctccactactctttcatcattttccgcttgaattttcctttcagttcgtcatttttttccaagttttgcggattgctttgattttggtaaaaaaacgaaaaaggggatcgagtggatcaaaatctctcgataattttggagatcgagaaagattcgaccgtatttgacggagaggattgccatcgtacggacactgaactatgtgagctcgaccagattaccggatttgatgggaggatcggctccgtcatggtacgggcacgagactgttcaagctaggcctacagctgcacatgtgggctgagccgaaaagaggtaggccaggcacggaaatgttcgagctaagactacagtttcacttgtgggctgagccaaaaagagatagaccgagcagcttagagttagcggactactctaggactagagctaaaaagaaaggaaggaatgaacgtccggtccaaaaacaaagaagcatccggtccaaaaccaagggaatataatgtataggataaaaaacgttttttcccgtagcaacgcacgagcatttttctagtaaagaaaaaagaacatccggaaccatcatacgaaaccaacgtacaaacctacgtaatagtcgaacgtacgtacatatgtactgtatacgtacttcccttctgtcctcattcatgtgttattttctatttaatgagaaaataaaaacaaaaatacttttacaggtaaaaaaacacaaatagaccaactacagctctctccctgcttttaaatcgctatgtggtaaaattttaaaaaatacaaagcaacggactattgatttctaattaaattgatgaatttaggttgttagattttttaataaaaatattccaaacctctctccctcccaccccactcccgtgcagtgttaaaatccattaaacattttataaacacctctaaactactatgtcacatgacatacttagattaaagaaaatcttagaaatttcaaaanaagacaattatatattaaatgttcattaaacatccctacgaatactcttaattcgccaagtggtaccttacaaacgctccagggttgccaagtggccaatctaatccaaccgcgatttttatttaanaatcggtggatccattatttttatattagaaggttagatcttttttttttaaaaagcacacattccgaacgtcctgtcacatacgtgccaacgagctatgttcatgagaaataataatcaaaattatttttacattaaaaagatcacaaagagacctccacctgtgaggtctatcagctctcactctgtgactctaaatatcctactaatgcttctcactgctacgtggagctattaaattaaataaaatactagaaaatattaaaaaagaataaaacatttggctattgatttgttagttttttaataagaaaaaacccaaacctctctctgtccctccccatcccagtgcggtgttaaaatccattaaatatcttataaatgcctctaagctgctatatggcattcttaaattagagaaaaatcttagaaattttggaaaagaaaaacacccaaccattagatatgacataaattgatggacacattattttaggtcattagatatatttttctttaaaaaagagcaccctaaaccttcttccctccttcttttgcggcatacggtgttaaaagtctattacagatattataaatgctcttaagatgttacgtcattctcttaaatcaaagaaaatcctaataaaattctgacaagaaaacaaaacatccgaccatcagtttcaacataaacatctgacacattattttttgttagattaatcatttagagaaacctcccaaacctccttccttctcggcccatgtacaacgtgcgccattcttttctctatatttttttatctccttgacaattaaaattaaaattatctatatggttaaaaaacacaaatggacctccatctattaattatatccttttgggcatctaacaactttctgccaacttaattaatttctcttgacatgcctatacaaattgaccttgatacttttaatatgatgtttttaggacataaataagtagttataagaaagatgatcatagcctctgaattacacatatgatctacgaagtcactaatcatagtaggtattcatctagcaatatagacaatagggtgaaaataaaggtgtggttggttgaacatcataccgataagcatatgggttgtacccaaggattttaacagtggaacaaccttgcagtggccttagcaataaatcaagtcaattccatataggaattattgactatgcccttttttatttttttattaaacttgctacaatacattgtaaagtcttgacgtagaacaatctagaaacatgtatttgttataaaacaatacactttagtggtgattcgctaaatacattatgaccattacttcaatatttcaggagagaaaatttagaacgtatgccctttatcccatactaggttatgtgttcttatattttttgcccaaaattgcaaagatcaaatcatttcaaggatgaatcatagaatgaaactatcccaaagaaaaaaatggacatggaataaatttaaaattgaacaaatgttgctggatttaaaaccaatacttgatagaaaaattcaaacattttacaaggatggttagaatgaaaaaatatatatatatgtaattttaaaatacaatcaaacaaaaaaatgatattattggatttcttttgaggttgtaagatatcctttttggtgagttaaaataccctaaattttattataggaaccacctccattgtttcgacacaatattttctcaacaattcaaaaccacatggtctcaattaattttattttagaatttatatattgcaagggtagttataaaaatataactagctttcaaagcacacaaaataagtttaattttagtttagaacataatacaagatattttaataaaaagccacctgcacataatatattcataataaaatttcactcacattatataagaaggtgcccgcgtatgtgcgcgggctacctttctagttatcataacaatcgcatcatttttcagtgcttagatgctacatataagtatacaacaaatagcattaatatgaactaattagagggcgatagtttgattgtacaaataaagcaaatttattgaacaataggtttttaaagatttggttaaaaaactgaatccgtaaacaatcagttataaaaaaagaaaacactttacttttaatttacacttaatttgtgaaacctgtttcggaaacaaactaagcctatcttcttcttttaaagatgattaagcatgcaaattctagataattcctggtaaattatatattatataatatagagataacaaatagactgaaagaagttttttaagcaataccagtgaacaatatatttttttgaaatcgtacttttgaactgcattacgaataatacagttgatacttttctcttatagattctaatgcaattggtttaatctatttatttggctagagtattcaccacacacataccgtgcttattgccggctatattttctctttaaaaggaacaattgatcagtcttgactctctccgtgtcaactggaaccactgagagcatttttagctctgaaaattgtgaaaacatgtcttcgaaataaaataggagacgactatttgcggactatttggtaagttctattgaaagatatttggcatcaaggattagttctaatgacattactatggtattagtactcgtagagctaattttaagtcaactgagatgtaatttttgtttgtgtacggcaaaacagtaaacatatgttgccttgttttggtgtttatgagaggttggaagccttcttttgtatctcaaaacagatgttattttcttatctagctacatctacatgaacattaatactatataagagaatccattatgtcactgactttgtcacacgtctacaatttgccattgactttatcacattctataatatgtcatcaacttttgtttaacttctacgatttaccatcaccgtccggttagcctcctttagcaccgtacaatgttttccaaatgaccaaaatacccctaggacaaaaacttctaaaatttggacaaaaatatcatattataaacataatattgtaaacatccaaaatttggacaaaaacttaaaatctgatatttcagaatttttatccaaattttgaaagttttgtcccaggggtatgttggtcagtttgacaaatttgtacagtactaacggagactaaccagacggcgatggtaaatcgtagaagttaagcaaaagtcgatggcatattatagaacgtgataaagtcagtggcatataatggtttctctctatttatatacgtatataatttgatggttatcacccatgtgctgtgtaaccaccccccctccttccctcccgctttatttgtgaggtatgacccatcaatccatcatatatttgcatcatatgaaggtgaaagttcaagagccagtagaatttgtttcgagcactatttgatcaataaggctcaatggaaaagggaggcagcaggaatcaaagctaaacagacggtctggatatctgttccaagtgctgatgtatttcattaggaaacaattaattgcagcttacaagtatcaaaatgagtgaaacagatctggatgctcgtgattacttggggagtag

SEQ ID NO: 51470 - DNA, 2382 bp, Oryza sativa
agcccaaatttgaaggatggaatgaagaaatttgaaaagagacaaaagtaaccctatttaatgcagctccatgaataaaacatatgacacaaaacttgcattcacacacattcatacgttcaaatttcatgcacacacattcaaactgtcaaatggcatgcccttggcacatgacaattgaagagctcacatccacgccatgcacatatgcaaaaaaaataggaccaaaaccaatccttacaaataattgtcatacaagtttaaattacacaagtccgtagataaacttgtgaaaaattacattgcaacggttggagctcacatgttgctagttcagttgaaaattgtcagaaagtactccccaaacactagacacccatgactatgccttggggaaaaaatgttttctaacttcccaggtaccagccagaggtccttccattatacaggaagagatttccaaccttcccaatttccaccaccctttcatgggggtacattaaggccatgccaaaccaagtgcaaatacaaataaatgagagaacaagtttatggaacctagggttgaaatggctcatgctcgatgcaacaactcgagggcaagtgtatcacgaaatgcattcatatgttcacattgtaagtaactaggagcctcgtcctccggtggctgatcttcataggcctcaggaggaacataattctcatctcggtcgcaacgaccaaagtgtttatcccttaaaccagcaagccttatgtaattatggagagccatgcaagcaactatgatatgtgtttgaatttcacggggataacaaggcacatatttcaatatgcgccatttctgcttgagtactccaaatgatcgctcaatgacatttctaagggaggaatgtgcgtagttaaatacctcctctttaccttctggttctggcgcgttttgaaactcggtgatatggtacttcgtgcccttgtacggcgccaggtacccaatccggtttgcgtatcccgagtccactagatagtacttccctgcagcggtaatcacctgtaagttacacgttatggaagttagacattgcaaaattacaacaggtagctgtgtacctggaggtggatgagggaaaacatgactgtatgtactcattgcattgtggaacaccctcatgtcatgcactgaacccggccacccaacaagcaaaaaagtgaatatcatgtcaaagtcacaacatgccatcacattctgagttgtaatgtggtgtcggcacatgtgctgaaccaacagatctttcgaaacctgaacaggaatgtgggttccatctattgccccaatgcagtcgttgaaataaggatagaacctagggttccttagtcttccatgcaaagttgtgaactgtgggtcgcgtggtttaattatgtcagcagctagcttcaaaaggcttgccaaaactttgtgaaaacatgttgtgcattgttcctagagagcactcaaatctgtcctcagcttgcctaaccaactgtggagccccacacatccaaaggaacattcctaacacctcaatacttgtagattttgtgctagacttgagttcatatttgtcgaccaacagatcatgaagactatagaacatatcaggggtcattctaaacatgttgtaacaccgcttcctatctgcaagcttatgctctacccattccaaaccactcatagttgtgctatgatctctataatcagagcggttgcagtacttgtcaatgtgagtagcgataaaatacgcaccgtacaggaacgtggtgtccgcagaatcgtccatgaagtattccaccagaattatttccaaatctttgtcggaaacttcttcgcttgtatccgcaggatcaggccgcacgtcctcctgtaaaaatttacaacaacaacggtaactttcatacatagtcataagtaagaaatgaatttggaacgacagacatactacaacttacatttaattgccaacattacgcatgacatagttcgaaacacaacagtagcccacattacttgaaggacaatgctaacggacatagcaccactaacacagaaagcacctcacagcccaaaagacacaactaaggctgatacattaacatgtaaagcaagcatgagaaggtctagttgtcgacccgtgcgaggtgctcaaggagggtcttttttccttcaggattggacagctcaaaaacattgattggattttgatcttcaacaggtttgacatggcaacccccaaaggcggggttgcctttgggaccctgcaattcctacaaaaggccaataaggggttggcccttttccgggggggaagggtaatcctaatccctcttttggtttaaacggccaaatagggt

SEQ ID NO: 51471 - DNA, 17928 bp, Oryza sativa
tgagcagtttgacttgatcttgcacgcatggcactaacgtggcaattcaatcagcaaaaagaatccatgggcccacatgtcatgtctcttcctacccggtcgctcgctcgctctctctctctcccgtgaacgcgctcgagcaagtggctgcgaacgggcggtgggcggcggcgggtggacggcggcgcgcggggagagagagagagagagggcagaagagatagggccaaggcgtgttgaccggaagtggcgtccgtcagccgcataggaggcacatggcgacggaggctggtcccctcagggagccggcggtggagttcaatcggtgcctgtggccgaggaggagatccgcgccggtggccgaggaggagatccacgcatgtggccgagaaggagatccacgtcggtggccgcctcctcgagcatgagctctgcaacttcctgcataggaggtcgtggaggtcagggggacggggagaagcggcgaaggttggcgacaagacgtccgtgcagcttccagggatgaggccgacctagcagcgtcgaaggaggcagatcaagatggaggtggagacgacgacgaggccgtggcgccttcgagctctcgaccggcaaccgacacgacaccttctcctcaattcgcgagcgtgataaggggatcgagctcctcaccgtggctcctcaacaacgacggtctccggcaactgccttcgagagtggcgacttggtggtgtgcttgttgtgccgaggaggaaaaagcccggccggcaagctcgacggtcggccgctgtcgcatgctttagcgaggagaggaattcaagagaagagatagagagggatacggattgagaaagacaagaggatagaggtgagggatagatatgacaagtgggcccaccgaacttttttaaagaattgctgactggactgtcacgcgtatgccacgtaggatcaaaaccactccagattgggttaggggggttatttgtctagttttagtagttgagggtgtcaaatgtctagttttaaagtctaagggggtaattcagacgacctaaatagttcagggggataattcgtactttttttttcttaaggtaatttatcatccgaacattttcattatagttggataaaggacattatgactttgtggttttagctgcaggacactgcataaagtgacttttggggaaatacactctttaaagtttgatatttaccggtggacaccgcacgctttaaaataataatttgtggttggagaggagagagaaatcacgtgaaagttttgaaatgcctttgggcctgcatgttagctctcctatctctcttctctctctatccccttcttccggctagggaggatgccgtgataggtcgccacagtaggtcgatagctgtagtgggtgagcagccactggctgaagtttcgctgcttcgtgggctgcaccctggcgtgccgtctcagctctggggctgcatcgaggtgaggtcgacggcgaacttgtcgcccttggatgcggcgatggaggactccaccaaggggacagcgtggtcgacgccgggaaggagaaggtcaaagcagtagtcgaggctgtttgaggcgcctgccctgccacgctcgcaccaacactcgaggcggccccatggctctcacaacctgttatcgatggggcggaggttgagctatgtgctcgggttggagcgactcacccggtctgtccccggcaaggccacgaacgttgtcaccatcaatgccagtaccatatccgaggcgtacaccggcaccttcagcattggccggccgtgttatgaccaacaacaaaaccaggaacaacttccacccaaaaccactccaaatccgcttggacagatgaaacgcgtccgtcagcgtccctgacggcgtctgctcgctgccattcgtgacacaccaatggcgccgcggtgacctgccatggcatcctcccattgccagatattgacggccatcagcatgggccatcaacacggttggtgatgcgcaccacttcttcttggtggtggtggtggtgacgctggagggagggagggagggaggagggggcggggggagggggctgggagtccgcgtcaatggagggggcgacggcgaggcagggaggagcaggcattgggcgaggttggggtcgagctcgagctcccggcggaggtggtcgcagagctcgccaatcagaaaggagcggaaggaggaggcagcagcgctggccatggcatcctccctagtcaaatggaggggatagagatagaaaagagatgggagagctgacatgtgggcccaaggcatttcaaaactttcacgtgatttctctctcctcttcaaccgaatattattagtgtccaccaataaatatccaacttgtaaagtgtcttccccaaatgatgtcctatatctaaaacctctaaaaccgtaaagtcacggtgttatgtagagaaaaaaaagcttttaatgtgtattccccaaaagttacttcgtgtgatgttctatatttaaaaccgtaaaatcacgatgttttgtaggaaaaagatttgtcttaaaataataatatgatcacgaatatgtcaggacatacatcagctctattttaactctgctattttctaggaataacgtgtattaagtcattaggaattgctggattaagcagaaattgcaaactctcatagtaaaaagcgagaaaaaaaatgaaacgtaaccataaaacaggttgcccatgcggatccacaggttaaagtctagtataaattctctgcaccaaactaagaattaacaaattaacaccatgtccttgtttctaagtttttagtatgaactcaaaagaaaatgtggtcaccatcattcatcaatactgcccggccctaattagtcagaaaaatgcactcccaacaccagaaggttgcaatcaaaattagatgcacctacatcatgcaggaggcagccacattgtaaatctgctctctacaactgatagagaagaagcgtccaacaagaaattagtaccatttctacacttgagtaacaaaatgttcaatagcttatttgtaaatgatatgagcacacttgcgttgttccataatgtatacacaagcaatttcttcatgttatggctggataacagatgctcatagctttgcatggaaaatctgttaaaagacaatcaccacgcaagttcatgatagaagtattaacaactacagagcattgttaagcaaaacaaaaacccaaaggagacgcctcatttcgttcacaaacctagaactataattataatacagtaaacagaacaaaattcaatccagtgcattccccctcagctcccacaatttcactgtgccatcatcacttgctgatgccaacatcctcgggtcctaaaacatatttgagaagattagtacatttatctgaagtttaaaagataaacagaaccacgaaatgggtggtaattggtagaaacataagtattccattgcactaacttaatataacaatacttatatttttgttaattccctgatattacctgaggacataagtattccattgcactaacttaatataacaatacttatatttttgttaattccctgatattacctgaggacaccagcggacacagtttatatccatgtcatgtgccttctctttctttaaaattaatctgtatgaaggtccctcaacctgcagcaatgaaggtaaggaattagcatccttcttcagctttcgcaaaataaaatggcattatggtagagggaataataattgtacagttttttggagaaaatagtcatacataatttgccaataatcaaaacaaatggcacagcactggttaccaaaaaatgatacaacagtttatcgattggtcatgttcacattttactcctaggaaaattttgacaaccaggaaattatggaatccctatcagaacattgcactccattatttattattaaatatttaccaagatataactttgacaaacaggcaggctaagcacagaatgcaaagaccaaaaatcttgagaatatgaatgtgctaggaagggtatgataccatactactcttgtcctcagcaaataagcagattgcatcatcacctgcgccactggctataatatcctcgctgtcatgccaagaatgaacaggaaaatgtcaaagaatagtaaatacactattctattcattttaacatcttgattcatatgggctgaggtaatattggaaaactacaataatgattaaaagagaagaaattacatcagataaaccaccatcagtgcccacagaatttctggtagtaaaatttcttccttaaaatgggcatccaacatttaagaatgcagcaatggtactaagagacacagataaataaataacaagaataggaaaaagaaagaaagaatggactgcaaggttagtactttaaacagccctgttttgcttgaataggtatcttgatgtatataaagtttatcagcataaaatcataaacacaacaagtgcatccttttaaagaacatatagcgctctcaaatagaatcaataaactaataattataaaattcatattgacgtactgaattaatagagcgaacttaaaattttttaaaaagcaaggtattgaggcattagtaaacacaaccatagtttcacgaatttgtggtttcgtgacactagtagaagcaaaccataggtcttgttagttggcttgaatttatctactaacctccaagcataatgtggacttgagcaagtctaacttcctgctttctattattcattcgatcactttgccactgacaccgttgagggttattgttgttatttttggcatattattatttggcatgaaactagatgggtaaaaatccagcatgctatgaacaaaataaatgtttataaaattccatatgttctgcagtaaaaaaaaaatccatatgttcatgaatttccttatattgaaaattttaggatataaaactggaaccctatggtgagaattgagttgctttgacagtttggtggactccaaatacaacagggcttgtaacagcatgagaactcgtagttttgtgaaaactggtgttactagtgccccgaaaaccttgggtttatgaaatatacttgttgataaatcatgctcacagtttagctgaggaacagagttaacttgttagttctctatgataaaaatcatgtgtatcaaggatatcttggtgcttagagatcacctcaccttgaccaatgggctgaaaaaatggtccggttatgatatcccgtgagagtagaaagatgtcgcctgaaatcaaataacaaccatcctgttaaggagacatggtatggaaaagagatatttttgacacttcactgctgtgatgtaacagcagtatcaattgaactagggcaattacactgaagtcattattattcagtgatgcacggaactacctctgtttcatattgtgagtcacgttgacttctttttctagtcaaactttttaaaatttgaccaagtttatagaaaaatataacaatattttcaacacaaaacaaacatattatcaagattcaagatattttctagaaaacttacttggttttgtagatgttgctaaatttttctataaactttgtccaccctaaagaagtttgactaggaaaaaagtaaaagcgacttataatatgaaatggagggagttacaagtatgtcttatccaaaaggaaatagccaccatacatgttagttcaccccagtataaagcagggcagcagaagtttaatcgatattgatcttactggtaaattagatctttccgttatagcactaaaatatagtacagctaaattagcatgttctgcaatagaaaagaatttatgctagccggagaccaaacaattctactctctgaaggacatgcctatcctcatttattggtgtacgttgatcacagcctcacagaactacactagagaatacaaaaatataaattacaaaaataagattgtataaaagcaatattggcattaatagatttgctatagtagtggcatagctgtttccagggaattataactaagttttagcttagcttttaggcagagctacgatatttcaaagctatcaaactttatacagcaaatatgagtcaataaattcaagaataagccaagtagagaaaataggtattaatagcacgctcttaccatgattcctggttgtcactagtttttggttgagacaaatcagcacttgtgtcccatattttcaatgtatggtcatcactgaataacagctgtatgacattagtaacttttcgggtgacctgtttggaacgcaggaatttcacaatcgacaagaagccggggaaaccccacattccataagaggccttgaatatcatttaaaacagagagtagctattacaaaacagacctgcatgtgaccatcctatcacctttctggttaaaagataatgcccatactgttgacgagtgaccactggaattaaaaagaacgagatcaattagacaaggaaaagatacaacaattagtcgagcactgaaagtaggaagaacatataagtattaacatgccaaacagagaaaaatgagttcatcaacaattgaagtgaacattgaaaaggagaaaaaaaaacgtatgtttaactaattacaaagcaggatggcagcaaagtgatcttattagttattatcgaggaaagttgaagaagatccctaattgtctattgtaagataacacaaacacattattgtgacatagaagccaaaatattgctgtagcaaagtagaaacagcacaaaatatcaaataactaatgtctaatggagaaaggaaagtagggaaagtcaaataactaatggccatggagcagaagttacattattttaattataataaagagcatcatgccagctgaaatttgatgatttggtaacattatacagtgatgcatgttacatgctaaataagtcaaacagattataccacaacctagtaccagctctatgaaacatgggatgaaaaaaaggccacagggataccaaggctagttaccagttattagcttcagttaatgtctgtacacagtgccactcatcatcaccgtcatcagcccagaccttcgccacagaaaatttgaaatcagccattattacacttgaacactaccaaatgaaataagcaaacgcatcacagctacaaagcataggggaacagcaagaaatgcttgtgtgcgatctaggcatttgtttgaaattaacagcgttcatactctgattgaattgtcgtagctgacagaaaccaggacatcaaggatagggtgccactgcaccatcttcacgtcttgtgtgtggccttgctgcaccgagacacactcgtattcgtttcctggctgcatctcccatatccacaccgacttgtcccggctgcacgtcgcgagcagcgacccggacgcgctccacgacacgctcttcacctcattctcatggccctgcacacacccccacaacagaagtagtaaattcaacacgcacaaccaaacgatcacaatgcaccacaacaacaaacagtcttaaccccatatctgaaactcccgagagccattttcaacctccaaggtggcgacgcactcgaagtcgccgccggagtactcccatatcgcggtggtggagtcgaagctcgcggtggccagcagcttcccgtcgggggaccatgcgcacgacctcaccgtgcggttgtgcgtgtcctccagcacatcctacccaaaccgaaccccaagtcaatcaacacgcgttgcagctgcagcagcatcagctcgaacgaggaggggatcgggcgtgatagttaccgagcactgccatgcgccgtcggcggcgcgcttccagatccggacggccttgtcgccgccgcaggaggcgaggacggggccggcgccggcgccgggggaagggttccacgcgagggaccacacgcggtcggtgtgccccgtcaggcggtgggcctcgcgcagcaccgccgccgcgccgccgtccatggccatggcccccgactccgactccgactccgccgcccccgcgcaccggcgatcgctgttgccctagggtttttggcggagggccgcgatggctcgccggagtggtggtggggtgggaggggagagggcgaagaggaggtgaggtgggaggcggcggcggccggcgacggcgaggtgggggaggtgagaggtagggggaggagtcaaccgcgcgtggtgggcacgtgtgcgagcgtgacggtgataggctataggtgctcgggaggacggatccaaaccgttggttttgaggaagggcgattcccccaaccgtcggatggccgccaattggtcatccaattagtaatattttactaagcatttttatcaaaatcgccttaaaaggggatgatttgaggagcgtttacaaaaatgcctttaaatgtcattccacttgtagtgcaatgtatttcccttttcttcctcttttgtgaacttttcctctctacgtctataaacaaattagcaaaccccatccttagtccaagatttcatctcataccacttcatcaaatctagtgacggaaataatcattccctctctagtcccgcatgtcttggaaaattcagtcttacgagacgtacacacatcattttgctaaaatgattacttcaatgcgagagcggcaccgatgcgaggcgatgcaaatgttgagcctaacatagtccatttcaattcatacccttttggtcctatatttaaaggtatgcatgtctcaactccctttgatttagctataatcattattctttaaaaaatggaacgaccgaaagtgaaatcagggctaaccctctcatctactagaggttgcaatgctcaatggaggcggccttgatgggtgttgttgccaacagtgccatgggtctctcaccaaaacgacacctacgagagcgcaatcttggcaagatcgctactagtgacactaggattaatcgtgggcgcgatgcatgttgttctcatctttttggggactttagccagcatgaagcgggaggtgttgtgagggtggttgggatttgggtgtagagcgaggaaagaagacgagcgtgaggaaattcgatgagtatggtgacatgatgaccttgatcatcgtgatgtcacgtgatggccgtagggacctcgatgaccttgatcatcgtgatgtcacgtgatggccgtagggacctcgaggattctagtggccgagtgtttgtgggtgacataatgtttaccttccttctgttaaatacggagtaggtaaaaaatttaggttctggggctaatatttttactatctccgttctttaacctaaattaaggctaaaactatcgtgccctccataaatcaaggctaaattgattgtacaaactaaaaagtgtgacctccataaaactaccaacagaaaatatgttttcctcctcccacacgtgctcccctcgcccaaaagtcgattcctcctgcacgcacccaccgacctctccctccctcccttgccacaagcaaacagcctttgaattatctagcagcatatcagatcagctatcattcatatcaacagcaacaacaccatttagctctagcatttcagcaacattcaacgtacacctcaaagtatatcagcagcaaacaaacaacaacccgcttcaattaaccgcacctgtagcaacatcacaatggcccgcttagtctgggatgagcttattagtgatgctacttggagaacttgaggatggtgttggtcgcgacctctgcgaggtactctctctgtccataaatattcgacgttgttgacttttttaaacacgtttaaccgttcgtcttattcaattttttttaaaatatacaaaactatatgtatacataaaagcatatctatctattatatactaaaagtccattaatctccctacaaacgctcctaagccatcatgtgacgttcctacaaacgctcctaaatcgccacatggctattttcaatctaaccgtcgagtttcacttaaattggtagccccattattttacaccattagattagatctacttgaaaagtcattgctactcccttaacgtataagctttatacatgagaaagttttacgagaaaaattaaagtatattccgatcggatataaacccatacgtactgctcgcttaaaaaaaaactaatatacgtgcagctataaagccaaaaaaagtactacattgtatattgaagccgtatataccggaaaatcatgtccatacgagtgaaaccgcttagaccgaaaaatctacatacgtacgcacaattaaaaaaacagaaactttagaaacgaacgtacatatgcgtagacaaaaccaagaaaaaaatgtacgtatgcgtagacaaaaaaacagatggttttttaaaatagtattttctatagtagaaaaacaaaacttattacttcacaaatatggtaaaaaacgtacaataaaaaatatatgatttgaaaatatatgttttcagctacacgggcattctttaaaaagttgatctaacagtatatacagtgactgactttatttatgcgtgcaagtgaagtggtactggaagaaacaatatatagtcactttctttttataatttttcatatacgtttgaatgacatgcataggatagtaaatggaacatggaagaataaacattttatgagtgaagtagataacttacgtatgaattctaattgtgatttttatcataaataacacaatggtccaaatagataaaaaaataaaggtatgatttaaaagttaaaaattataatgagttaaaatatattgttacaaataaatatataattcagaaggttgtggttatttaaaaattattgttgcaaatattttcataaagagaaaaagggagaaaatgtaatcaagaggataaacttcctacaaacgcttctaatccgaacatagtaccctataaatgctcatagaccaccatgtggcactctaataaatcatagaaattgtataaaataaaaaaaatcccgaccaatcggttttcatttaatttggtggacccattattttcaactattagatctatcttaaaactacaaaatagatttacttgtaaaaaggcccatgtcgtattggcacgaccggccaatatacatgcacgtaggtatgtaggtattccttcttaagaaaagtacgtacctacgtagagtatgtacacagctattcctataaacagtgcgtatacacaccgcgtcccacatccttatttttttttcttctcatcatttggattagatggaaaaccaaactaataatttaaactaatatcaactatgctttgcgttgtaaaaatatatgctatttcgagttgtattcaaattaggcgcatgtcattgaaacacccataaaaaatataaataaattgaaagtatagattatgtgatagttaaattagacttacattttccaaaataaaacaacttcaagtgtgtgtagaatttcaaaaattactcactctctcttgtaaaaaatactgatatggaaaaatgatgttataaatttatcataaatattttttatgtattatgtgtttactctattcatatattattagaaaattgaagatcaaatatattcatttgacaccacgtcaatatctttttctcctacttagccttcgttcgatctagctcattgacttagcgtatccagggcacacgaaaagtcacaagtcattagcacaagattaatcgagtattaaatattgaaagcttgaaaatggatttatttgtatttttagaaaacttctataataaaaaatattttgtaaaatatgcaccgtttaacaattcggtaaacatggtcatgataaataatgaagtagccactctgataagcactttagaacttaaccataaatttattacatatgcactaaaacttaatatgtagtgtataatatactttgtgaatctaggatagtataatatatcaatcgtatgtccccgataaattctatgtaataagttctatatacaaaccagtgtcaacaatcgtcgagttatattgtttatgatacatccatgcacaatgcacttaataattagttgacatccaataagcacgtgcgtcatcaagcaccgaagatatatgatgatacttagtgggaacccattaataaaaaaaatgatatataagtagaggatgacacaaaatcacaacaaacagtagttgactacaagtagactgtgagtttaagcaatagcgttcctatacttctacaaacacttgtgagatgtcatgtgatgctctaataaataggaggaaatttaagaaaaaatataaggagaaaacaaaacatctacccatcgatttgcacttcaaccgatgaatccattattttcaaccattaaattagatttattcaggtaagcccttgcttctataaactagctaatccctctctatgcacgtacatatataagagatgacaaaaataaaaaaagaagtgtgtgtatatatatgcacgtacatatacgcaatgtcaaaaataaaaaagaagtgtgtgtatatggttcaccccatctggtagttttcaatttctttctttgtagccctaaggttctcccaaattatacatatatgtagcgaccactctttgcgatgttgtcaaagaagccacgctgccatggcgccgcttcatgtcaccctcgccaattttcttgaaaatattttttttgactaacaatgtaaaacgcaatcataggtggtcatttaaacgtgtgtgcacccaccctatgaatacacatacgcacaccctacctcctatgagagagaaatatttgtcaaaaaaacatgaaaaagaacgaacatacgagagactaccattcgagaaaaaaaacttacgtacatacgtacaataaaaaatgtcatatggaatcatattttatcccttttaattatgtcgttctcatataaattgtgttaacaattagtacaaataattttgacaatatagagtatttctttgtacattacccatgaacatgcgtaagtgaattacatgtataataaaagaaaaaaaacatcaaaactcatattatgtttgcaaagaatgatgataggtaagtttacatataaccgaaacaaagtgattttttgtttgaatatgatagacactatcatttaccttatcaaattcacggtataaatatttccttcttttatggtaaggttacgaggtaatctactgttcttatagttaatatgatgatatatgactttttttcagatttttttatataaacataaaataaattgcccgcgcatctgcgcgggctaccttcctagtttaacaataaatcaaatgataggaaaagaattaataattacttaaatttttgaataagacgaacgatcaaacatgtttaaaaagtcaacggcgtaaaatatttagggaatgagggagtagctgtcgacgagcttggccactgttctaatccgtggcatgagctcgccggaggatgcgtcaaccacctagccttcgtcctatatctgtggcgagacggaccggtgaacgtacaccgacgagttcgtgaactgtgacgatgaactgctccagcatccgctccatgcagtccacgtcatagagcgtctccacaaagttgccagtgttggggatcaggaggtcctcatgcgttgcctccttgagctgtttgctggctctcatctccaacgcgtctcggcacgccacgccagtgtgcaggatcatgtcggtgcggagaagtccgagcacgaacctcgtcgtggcgacggccctctcgacggggagtagtgtgacgatctcctccatgaggaccctctgctccatgtccaagagcacagatccctacgtgttgtggtggtcgccatcgatataactgaattggcgccggctcagtctagaggtggtgcttggcgtacagcatgtcttctgaaaattattcggagtttcagacaaaacagaacaactaacagtgttgatgttgattcagtaacctctgagatatggaatccctaattgcgtgcagcttggcagccacctcctgcatactgatgcgctcattgggggatgacttggtgcagcaaagtccaatgttcagtacagaaagaaggcagtgtgctgcattttcatcggtagcaactggatcttcttggttgaggctcaactcttgtaccagctgaggatcaacaatctgcagcaacctgtcagggatgttgatatctgcatattttgcaatgctcaatccatccttaaacatgtcatctgttggcctcttccttatgaatatctctaagagaacaactccgaagctgtatacatctgcagcagttgaaacttgaccacctatggcacattctacatatcgtatgcaggaagagagttcattttagatgtcatataaacaaattatgaaactgttgtcttcaattaattgttaagaaaatactgtgtgaaatggatcatatatacctggagcaacatatcctatggttccatttattgtgaatgaagaagttgaaactgagttacccaaagatgttttagaatcaattttgaaccttgcaagtccaaagtctccaacatgagctgtcatactatcatccaaaagaatgttgctaggcttgagatcacaatgaataattggcccttgatggttgtggtgtagatatgccaatgcatcagatacatcaaccacaatgtttaacctttgagctagtgaaatagagcacaaatttgaagatctatcatcatgtggagttgagtacagtaatttatgcaaatctccccgtggcatgaatttatataccaatgctttgaagtcattcccacttgaatcaatgcttgagcacgccgttaagataggaactagattacgatgccgcacatttcttaaagcattacactatgcaatgaagcttttttgtgctccccttgtctctagactgaaaaccttgatagcaactacggttatgccctgaaatgactgtccttggtatacagaactgtatcttccttcgccaatcaaattggatgttgaaaacccatttgttgctctggcaagatccctataagaaactttgggaaattcactaccaaatgagggcaaagacattgagtttttcttttgttttcccttacagataaacaagaccaatatcaccaatgcaagtgtcaccatactagctaatggaatcactatggctagtacagatggcttgcgtttagtcgtatttgatggcgtaataggacattcaggtaggtgtaactctagtgcacctccacaaagccctagatttccatcaatttgtatggcacttgaattcttgaagatacctttagttgggacctcacctctaagatggttgaatgacaaatctatctgttcaagaagctgaagatcaccaagtaacattggtattgatccagttaacttgttgtgtgataggttgagaaactttaggctaattaatttgccaaacgaagggggaatacctccacttaaattattatgatccagctcaatatgttgcaaattttcgcagctgcccaaagtattaggaagatctccagacaacatattggatgaaagctgcaaatacatgagctgcttggcattccctacttctgcaggaagttccccactgagattattgaatcttaaccaaacttgctctattgttggaattctgaagatttactctggcacactaccatgaagattgttattggaaatgtcgattgttgtaaggaactgaaggtttccaaggcttggaggtatgttcccaatgaactgatttgactctagaaaaagctccatcaaatgtgatagattggaaagggaggaggggacataccctgtaaaattgttgtaggacactgttaggctctgcaatgttttgagacctccaagccattgtggtacagaacctgtaaaccagttgtcatccagtgccagaattatcaggtttggaaggtttgcaatgccagaaggaaaactccctgacaatctattgagccccaggtaaagatactgaagttgaactgaaaaattgcctagtgaacttggtacctgtccttccatttgattcttctcaagagagagtacttgtagctcggtgcaattagctaggttatccatgaactcccattcttgcttgctacgagcatggagctgattcatctcaaggttcaataatgtaagcttggcaagcttgccaatggaggcaggcaccacaccggtgaagttattgtcagacataccaagcttgaaaagattcgaagcatttgctaaggaagaagggatattcccttggaagaagttgccgccgatggtgagctgccggagcttgggcaggaagccgccgatgccggacggcagctcgccggtgaagccgttggtgctgaggccgagcacggcgagccccgacatgttcatgactgccaccggaaacccacccgacagccggtttccgtcgacggccagcacctccatcccgcgcagcgcggcgagctcgccggggatgccgccgccgacgccgttgttcatgcaggcaagcttcctcagcgtcgtgacgttgccgagcgagggagggatcgtcccggcgagacggttcgacgagagcaccagcgcctcgatgccgacgggcaggtcgccggcgccggggagtcctccggcgagctcattgccgtcgaggaacagcgccctgagctcggagcagttcgcgaagctcggtatggtcccttgcagcgtgttattgctgaggtagagtgaccggaggcggcggaggcggccgagggacgccggaatctggccggtgaatctgttcgtcgccagggagaggttcctgaggaatgttaggttcccgagcgaaggagagatgcgacctactagacctactagatcaatggcggtgacgcgtggtgggttcttggagctgcacgagacgccctcccagctgcacaggtggttgctgctgttccatgagatgagggattgctctggatcgagactgatcgcgttcttgaattcaagcagcgaagacagctgatcggtttcgtttccgagagctgagcagatgactgaatgggagatggtggacgccaagaacaccaagaggaaatgtgcagttgcagtggtaaccttcatggtcatggcgagcttgtttgctcgaatttcgatcgatcttggttgtgttcatacattgaaacggatcggaaagtttaaattttcaatgttgtataaaatgttcggacactcagttggtagtagttgaaatacctgaagaatggtttagcttaattaggctaagattatctgaaaactagcttcctttcagcgctgtacagagttgagagttttcttcataaaaatcctgcacacaagaaagctactagtcatcatctctttcagctcaaggatacattacacccaattcaagctgccactactagaaaaattattttttatagcattacccttttatttttactgtcgggtttgatgaaaatacgattgtgaaaataattggagggattccggttatcaaccgcttgcaaaaatttgattttcgctggcggtcacttaagaggtctgcttgcaaaaatagagatctttttataggttaccgacaactaaaataggattttcgctagcggctaccaaggatccgccgccacagcaacgggggaggccaacggagtgggaagcgatggtggtaggagggtgggcgcggatccgccggcggtggtgctcaagcggtcctccacggcggtgaaggaggtggatcc

SEQ ID NO: 51472 - DNA, 8524 bp, Oryza sativa
aaactcaattttcactggcggccagcattattttcacttgcctttagtcactggcggcacatctagccgctagcgaaaatccattttgactgtcagcgaaaactattttttagtagtgtgccttttctaattaaactattcactactcgacgcatacatgaaaacattagttgactaattataggctccttcctggttaccgaacgttgtattgcataatttagtccatgcttacatgagacaccagtggcagttcctatggctagtccatgaccagtgatattacttttgacttccccttttctttttgttgcagagatcctttcgactttccaccagggtttacaattttgatttcggtaggaccgaaattttaccaaatttcatgattttcggcacttttcggaccattatttttttgaaattttgaaagattttgatcgaatttgagtaaatttgaccaaattccacaaaaaaaagagaaaatctgaaaatttctatcggtatattgatttgccggtggggaccaaaattatcgaaatttcgaaccaaaattgtaaacgctgctttccatgtgcaagaaaataaatttaaagggatttgctaggtttaaaaaattgtggattactaagcctcaaattacaattctatgcaatgtgtttattgcatgcagtgttttccttccatgtttaaattaatacatggctcacattttaatcccctcctatagatatataccgcccaatccattatagactgttcgattataagcaatcaacggaccatatgacttccaatcgaattctcgtttatttgagtggagtgtcgagatctgtcccgtcgccctattctgtttttttctaatttagcaatgctcttttatgtctatagtctatataccctatggcaaaaactagatatgtaaacgatttacattatctttttttttttaaaaaaactaactagatatggaaggacgaggccaagaacgtacacaagactcacagtagtaaccttcgtagtgagcttgtttgatcaacgtacggacccatcgtttcgtttatttgtggaataagcgaaacaacatatttgtaatttgtaaataaaacttttatatacgtgtgcttagcaatctaaatgcaaaggctgaaaaataaacttttatatacgtgtgcttagcaatctaaatgcgtctgatgaacacggtttgagatgggatcgttttgactagcttttgatcgaggtagaaccatacatatgaggtgcatggcttgtagaactacacaagtgatagtgttttggattcaaattttaaaatatttttatacgatgatgattctggttgttaatgatgtcctttgaaacaaataaattgtcaaaatataataatgaagaccacgttaaaaccatatatatatatacggcttatattttgtaatgaactagctgtagataattcatacagccatcaacatttggatatttagaaaagatgcgaatgcttaacttaagaataacatgacatgttcctacttcccatgataacaagtgaaagtagactacagaagagaagcttacagctcgcggtagctgggcactcgaagcccgaacttgatgccggcagaatggtactagtatgatatattgatatgtgcacatatgcgagtttgcagtgtgtttgcaggtatggttaccttaatttataggcacggctggtaaatgcatgcaatgaatcgatgattagtcggggccagcttaaatgtgaatacacgatgtaccacttgcatgttgacttgactctagctagcttcgtcggtcttttggaaaacagacagcatcgtcgccccttgtatagggagtacgcggtaactattactcacttcgtatatgtatgacgtcgtcgacttttgaacaatgtttgatcattcattttatttaaaattttttatgtaaatatgaaaatatttatatcatgcttaaaaaacatttgatgatgaatcaagtcataataaaataaatgataattatataattttttaataagacgaatggttaaacgttggataaaaaattaacggtatcatatattaaaatatggaggtattattttttttttcaagttagggaagtgaagaattccggagctctttacgtcatctaagaatatgcacataattggtgaaggagctccgatccgtagcgttgacgatgatgactcaaggcgctacttcacatgacagtgtcgcaacgcttacgtacgtcccgttcttttcagcttattggtcgatcataataatagtatggattatcgtaggcatactttgcaaattggcacttttaatttatcagttttttctcttagagaactttaatttctgtatcaccttatcaacttactaatattcaatttattcgtttcgaccctccgataattacttcctccgtcctataatataagggattttgagtttttcttgcaacgtttgaccactcgttttattcaaatttttttaaaattattatttattttatttgtgacttactttattatctacagtattttaagcacaactttttgttttttatatttgcaaaaaaatttttgaatgagacacgtgatcaaacattgcaatcaaaaacttaaaatcccttatatcgtgggacggagggaggatactatatcattcaccatacatcacgggctggaccaacgcggcaattcataggtgcgaagggatgaccaataatcgataagccatcttccagtcatgatatgctagcagatcgagcccattgatttcagcacttcgatcagtcaaaggcatcccatcgagtgtcaattcttttgctgccatgttgatcccgaattcgcgatcgtcactgctcattagctagctagctataggtatcgatcagaatggagtcctgagtcaattctcatttgtctccatctagcttcacccgacgcaacttgtcggagggacgaccaaacgatcgatgcacactaccggagaagtgctcatctctcccaggtcgtaacccctttactcccgtgtagcgaaccgggaggaagaatccgggactaaagatgacagtctttagtcccgattcaaatacccggaagtaaagctccatctttaatctcagttggtaacaccaaccaggaatcaggactaaagattttatttatttatttttaatttggttgtgctgcctgcttcacacacacatatatatagagatatttatggtacatacatacatacatacatacatacatatatatatacatgttggactttgcactaggatcacctaggttagatctagtcgggtggttctatttgggattgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcctggcgatgaggtgtggcgcggcggtggcgcttcccgtcactggctgcgccccctctcgatcggattagggtttgtagggtggagttggcggcggcggtgaatctcgtacctcgtgccgtgccggcctccacccctcttttatatggcgcagtgtgacggggcccaccagccattaagctggacgcccccgatcagggcgcggtcaaggccctcttgagccgttgggctcaaggggagggagatcaatctaacattctcccccttgatctcactttttcttttagctttttctattccatcacagatttgtaaatagagcatgtttcatcgtcacggtcaatcaccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagtcagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacacatatggctttgttttcatttcattgagctcatactgatttatgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgtggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttttttattgtcccatcaaacttcaagtaccactgtctcgaagcttgctttaatccataaatggatctctttagacgacatcccatattttcgtttcctttcatgaaaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttgccacatcctgtacctgaggctcttgatgagtctcctgtactggcacattatctatttgaggctgttgtagctcctcctctggtgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgtaggactcccccacacacggaggtgagttagcgagggtactcttcctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactccccccacggtcagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccatacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggggaaagaatttcattcttaactagtctctcaattctccccctcgaaatatggcccaaacgacagtgccataatttcgatgagacattggaagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtgtgaagccattcgcgagctctagcggaagatctccaacagcttcaactttttcttcaactccattggcaactctaatggagctttctcttccttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcagaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaacacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaaattagacataacacttataaccataactataataatgcaattaacaacgttggtcagaaaattacaacatcatagcacataattaatgttcctaaaattaaattctcccgttggttcgaaatttaattttagaaacactaattttcatcaattacatctatttgcagcggaaaactatataaaaatcatatggacagtagcaaaatctctgtaattctctctctgggaaaattctcccgttggttcaaatttaaacagaggtaaaacatgcaaaaatctattcaaaattctattgaaattcgcatgaaaaatcgacaa

SEQ ID NO: 51473 - DNA, 17479 bp, Oryza sativa
  unsure (1)..(17479): unsure at all n locations
ccaaaaaaagtatacacacatatcgatcacactgcacagtaacacacgctatgctatttgcttgttgaaaaaaaattaaaagtatatactttttttctacctgattttacgagaatatatatacatgttcgaaaagaattgacaagaatataccatcgtcgtagagcaaatgtgcgaacttgcgcgccgctttgctgcgcctagcgaactgggcttctgatgagatgctaatgattcaattaattaattattaatttctaactaggaagataacccgcgcatttgcacgggcatacgcattagtttgtttcgaaaatagttctaacaaaataaattaaaattaaagtaacgtattttctattttgaattgagtgttctttatatctctctttcgtgaagaaatctcaacaactttcattggttttttttaccatcctgctagccctctctttaattacatgcaattagttatgcatgtgaatcaatatagatagaaaaaatcatttaaaaaatatttattgtagtagttataattattgggttcacctatttaaaggaaaatcaatggtttgttttttatcataatttttaggatttttaatttatttgagcgccatatgacatcttaagagtgtttctagcacaccacgcatgcgataggttgagcccgtttgtagggagtttatttgatttttactatataatagatacttcctccgttttataatgtaagtcattttagtatttcctacatttatattgatgttgatgttaatgaatctacatagatatatatgtctagattcattaacatcaatatgaatgtggaaaatgttagaatgacttacgttgtgaaacggagggaatagttaatatagcatttcttatattattgtttatgtactgagctgctagctagaaaatttggataaaaaagtgagcaggtgagataacaggagataaaatgatgggtctactatattaaatattaagtgaaaatcaatgatatgatgtttttctttttttctcagaactttttagatttctctaatttactagagcgccaagtgacggcttagtagtatttgtaggagtcacgtgacggattaagagagtttctataaagtttagttagtggacttttatatataacctggttttttcagctttatcctttttaatttcggttcatacgatcgtacgttacgttgatataaacgtaacatgtaattattttttttaggtagtacatttatacgtacattcctctccatccacatatgcataggataggaaggatgttttttgtttttttttctatttatgaatagtacatcgtacctttatctccatccatttgcatcagatccatattagaaggaatgattttaatatatttaatctaatggcctgaaatatcggacccactaatttaagtgaaaattaagggccatatgttttactttttttctcagaatttgtaggattttctctaatttattagagtgccactgtagcacaccacacaatgataggttgagagtgtttgtagagagtttatttgatatttactatataatagatagttaatatagcatttcttattatttatgtactgagctgctagctagaaaatttgggtaaaatagtgagcaggtgatgtaataggagataaaatgatgggtccaccatattaagtgaaaattaattatatgatgtttttctttttttctcggaattttttagatttctctaatttattagagcgccatgtgatggcttagtagtgtttgtaggagtcatgtagcggtttaagagcgtttataaaaagtttagtgacttttatatataacctggtttttttggctttatctttataatttccgatcttacgatcgtacgtgaagttcatacgaacgtaacatgtaatttgttttttttttgtgttttaggtagtacatacgtacattcctctccatccatatgcatcggataggaaggatcttttttggttttttctctgtttacgaatagtacatcgtaccttcctctccatccatttgcattagatccatattagaatgaatgattttaatagatttaatctaatgacccgaaatatcgggtcctctaatttaagttaaaattaagggctagatgttttgttttttttctcagaatttgtaggattttctctaatttattagagtgccacgtggcggcttgagagcatttttagaaagccacgtgggtgcttcatagcgtttttagtaagattaatggatttttagtatataatagatagatagatagatgatgttgcgagagatgccaatatgagagctgcaaaattttgcgagatctttagggatattgttggagctagtcttttacttgtaaaaatggtaaattttgatgtggggaatgattttgcaacacttgctaagccaagctacgactcaaagcacaacttgaatccctcaactagtcatgtttgtttcggcttaagattaattactataatctagattattaagtcagattactattaactgaattataataagccgacatagaataagttgttagctgtttgtttctgtggattattagttgtttgttagttgttagccacctaataattaaaaaagcacttttaaagtggattaccatattatagtaagctgtctgtttgtttcagcttactccgaataatttggattataataatcctaagctgaatcaaacagggccttaagttagtcacatagataaccagacacagactatgtgttcttgcagttcctttttccacattcctacttggggaaaaaaatcaggatttttgaaatttaaataccattaggccaaaagtaaatatttttggaccaatttgttaaaacaaaattccgaggctgaaagtttcgaaaatgctcaaaatcgggcgcccgaacagtgcaaaaaatcgggcgcctcccactcgtgcctctgcctcgcctcccacacgtgcgtgtcgcccccaccatatgtccccaccactcgcgctccgttgcaacaaccacccgatataacggaaacgcactatcaaggggatttgttttatttttttccaccaacaatatttcaggtagtgtactcgtgatgtttcactatgtatggatgaaatgttgcagtggattttggtactatttcataatttcatcttaatggacatgtgatttgttgatgtatacgtggtttaagtgttgcaatggctttaaattgtttgctgcatacgttgaaccaaattattttatctagtgatcttaatgtttttcatattttttaagaattgaaacattctttcgctatttgctgaaacattgtttttatatagggtgaaacaacgcccaattttttttggaaaccgttgtttcatacatcttctattatatactaaaagtccatttgtcagggttacgggttaggtatatcctttacccttcgatatacgtcgcatatcggtatggcatacctacgcgtatatggatactctctgcatacactaaggaaatcctttacggagtttatagaaggaaagaatcctactcggacaagactgggtcgtcagtgtatcatgtagggtctgatgtctccgagttctacttggaaaccgcctgacctgcgatataaaagggaccccccggggaggacctaaggcatcgaatctcagagccagcacaacccccacagcctacgaagtcggagcctgcaggagccaaaccgccggagatctagtcgaaccaactcgattacgatcttgccggatccatcgagttccatcgttccttttgtaacctgtgttttccatcatataatcccacatcaactggatttgggctattacttattaaggggcctgaaccagtataatcttcgtcttctgtttgcttgatgtcgtattacgtagacccttgtaccaacgtaccccaataccctctatatccggtctacgggtatcacccgtcgacagtggcgcgccaggtaggggaacatggtgctcaaggttctactactatgtcatccagcttcgccgacaaccgcgtcaacaccaacctccaccggggatttcctgcttcaataatgctggtgtggactcaagtcgacgaaatcgtcttcccggtttacaccacgatcccgatctcagccgacccatcaatgatcagaaacgagaacgcaatggctacaacccaggacgactccatgtcgaaggatcctcccgccgaagcggagaacggaacatcgacgacatccgagctcgagaaggattctaatgcgaccaaaccttgtcgtttagacaagagccacgagccaacgagaatgacttccgaagcgacaaggtcctggtgtcctatccacaaaaccatgaaacacactttgcaagcctgctgggtttttctcaacgtccgcgctgaaattcgcgcctgcaaagagcgtggaattcagcgtatttctccaactcgtgatgtctattgtcctattcacaagacaaagaatcacgacctctcaagctgcaaggtcttcctcagcgccacgaagacgtcatctcctaaggtccagcagtcaggcatatcccttagagatgaagacaaggaacaaggaacgacgctggtttcagatcgattcgtaggcgtaatcgacatcagctcacccgaaccatcagtcctgcatctactcgaggactatggctcatcgccagcaagtacgccgcgcgaggtattagctatcgacggaaccagcacgtcagcacacgctaatgcggaaacacaaaatcaaatggctacaccggcccagcacatcaggaccatcaacgcaatactgagggagaccccttacgatcccgttctaaacgatgatctcgcacaatggacagaacggctacgggaatcaagaaccaacctcaactacgcgttcgaagaagccgctgctgcggcgcacccggaacagccactaactggcggtgccaatggcgaaaatcccaaacagcaggagtcaccgcatcgagctaccccccacctcgcggcaccggcgatctccgcaaccacctcaatggccgccgagaggcacgacgcacatgagacaacggggatcgctcccgataccgcgtctcttcacgatgtcgcgataatgaaagacaggaaggccgctcgaacgaagaccgagactgtgttaatcgccacgatcgtgagaggcggacgcagggcgacgctggtcgaggacaccgccataatgacgaggacgacagagatcggcgccagaacaagaccggagggcggcgacaagattctcgagaacctagccgacgtcctcgtaatcctacactggaaccaagtgatccatcgtcatcgtcgtcttcttcttcatcctcatcattagacagacatccacgaaggacacacgatcgccgacaacccaccgcccctagcgctgggtgtagagctttcagtcgttccttgcgtgatgtccgatggcctgagagattccgacccagagcaatagagaagtacgatgggagcaccgacccagaagagttccttcaagtttactccacagtactctacgctgccggagcagacaacaacgcattggtgaattatttgccaactgcgttaaaaggctctgcacgttcatggctgatgcatctcccgccctactcaatcacttcgtgggcagacctgtggtagcagttcgtcaccaacttccaaggaacttacaagcgccacgcgatcgaagacgacctacatgcgttgacacagaactcgggtgaatccttgagggaatatgttcggcgcttcaacgagtgcagaaatacaatccccgaaatcaccgatgcttctgtaattcgcgccttcaagtccggtgtcagagatcgctatactacccaggagttggcgacaagacgcatcacaactactcggagattgttcgagatcgttgagcgatgcacccacgcaaatgatgcgctgagacgcaagaacgataagccgaagaccgggggagagaagaaaccagccatggacgcacctgagtcaagcaagaagaaaaatcgcaaaaatgggaaaagaaaagctcaagcggaagttctcgcagcagaatacgcgaaccctcccaagcgcccagatccacaaggtagcgacgtgaagaaagcatggtgccccatacacaagacggacatacattctttggaagattgtcttgttttcaaaaagtcgctcgagaagcacatggcatttgaaaaaggcaagcgagtacgcgtggtcgagaaggatgcggaggcggctcctcaggaatcggactcaacatatccagactctgacatccacgtttcacacattttcggaggttccacagcgtactcctcaaagcgagaatacaagaaagtggaacgtgaagtctgtttgacatggcagggggctgcacccaagatgaagtggtctgaacagaagatagaattttcggaagaagaccatcccaagactgccatcatcccaggatgctatccgatcatggtcgaatccactattcggaacatcaaggtcgcgcgggttctcatcgacggtggcagctcaatcaaccttctcttcgccagcacttaagacgtgatgggaattccacgaagcgagttgacacccaccgatcaacccttccatggaattactccctagtcctcgtccaaaccattgggcaaaattacattgcctgtgacttttggccaagcaaacaacttccgaatagagcagatcacctttgatgtcgctgaattcgatacagcgtataacgccatcatcgggagaactgcacttgcgaagttcatggccgcatctcactacgcgtatcaagtgctcaagatgccaggaccgaagggaacaatcactattcaaaggaacgcaaagctggcggtacaatgcgacaagcttagcctcgacaaggttaagcaaacgcctagcccacccgccacaactgagccacccaagaaagtgagaaggacaaacaagacgccaaaaccggacggcgcgatcaagatcgttccactctctagtgccaaccccgataagaacgtcaagatcggggcatcactaagcgagaaataggaattcacgctcatcaccttcctccgcgacaatgctgacgtgttcgcttggcagccgtccgacatgccgggggtccccagggaggtgattgagcacaaactcatggtgcgacccgatgccaagccagtaaagcaaaaactgcggagatttgcaccagaccgaaaacaagccatacaagaagagctcgagaaacttctcaaagctggcttcatcagagaagtacttcatccagagtggctagccaatccagtcatggtgcggaaggccaacgggaaatggagaatgtgcgtcgatttcaccgacctcaacaaggcgtgtcccaaggatcaatgccctcttcctcgaatagatcaattggtggactcaacagccggctgtgagctgttgagcttcctcgacgcttactctggctgccaccaaatcagcatggcgaaagaggacgaagagaagacagcattcatcacgccattcggggtattttgctttgttaagatgccattcggactgataaccacagggaatactttccagcgcacggtacagggcgcacttagcgaccaactcggcaacaatgttgaggcatacgtcgacgacattgttgtcaaaaccaagacaagtgactcattgattgaggacctgcgggaaacgttcgacaacctccgacgatatcgcctcatgctcaatccaaagaagtgcacgttcggagtaccgtcgggcaagctgctcggtttccttgtctctggcagaggaatagaagcaaatcccgagaagatcaaggcaatcgagaacatgaagtcacccacaagactcaaggaagtacaaaagctaaccggatgcatggcagcactaagcaggttcgtcgctaggatgggagaacgaggacaacccttcttcgctctgcggaagaagcaagacaaatttgtatggacacaggaagctgaagaggcattcgttgcactcaaggactacctatcaaacccccctgtacttgttgctccccaacctaatgaagaattattcctctatattgccgccatgccatattccgttagcaccgtcattgttgtcgagagagagaaagtacaacgaccagtctactacatcagcgaagctctccatgacgcaaagacaagatatccacagatccaaaagctgctttacgcggtaatcatgacatcaagaaagctacgccactactttcaagcccacagagtcacagttgtctcctccttccctctcggtgaagttgtgagaaacaaagactttgtcggctgcattgcgaaatgggtagtcgagctgagccagtttgatgtccactttgtgccacgaacagccatcaaagtcccaggtactcgccgacttcgtagccgattggactatgcctgataacaaatcagacaaccaaatcgataacgaaacatggacaatggcgttcgatggtgcactcaacagccaaggagcaggggcaggattcatcttgacatctccttccggagaccaattcaagcacgcaatccacctcaacttcagggcgaccaataacacagccgaatacaaaggactactcgccgggataagagctgcagccgcacttggggtcaagcgactgatcgtgaaaggggactccgagctagtcgcgaaccaggtgcacaaagattataaatgctctaaccccgagttatccaagtatctcgcagaagtcaggaagctggagaaaaggttcgatgggatcgaggttcgacacgtataccgcaaggacaacatcgagccagatgacctagcacgacatgcgtccagacgagaaccgctcgagcccggcacttttctggacatcctgacaaagccatcagtgaaagaggttatcgacgaagttagcccagccgcccccgacattagctcggaggccacagaggcagaacgcgccgttgtcgatatcgagaccacagacgactggcgcaccccactgatcaaattcatcaactgcgaagagttgcccgaggacgatgcagaggccgagaaaataacccgtaaagcaaaaatctactgcatgatcgggaacgatctatacaagaaagcaccaaacgggatacttctcaaatgcgtctcgtccgacgacggcagacaccttctccttgatatacatgaaggcatctgtgggtcacacgccgccggacggacattggtcgggaaagctcttcggcaagggtttctctggccaaccgccctcaaagatacatgcgacatggtccagcgatgtgaatcctgtcaattccatagtaaacacacaaagctacccgcgcaagcgctccagactatccctcttacttggccgttctcgtgctgagtgctagacatactcgggccattcccacgaggacagggcggctacaggttcctattcatgacgatcgacaaattcactaaatagatcgaagcaatacccacgggggaaatcaaggccgacaacgccatctaattcatcaagggggtattttgcagatacggactaccgcaccgcatcataaccgacaacggctcccagttcatcagcgccgatttccaggattactgcatcggactgggagtcaagatatgcttcgcctcggtctctcaccctcaaagcaacggacaagtcgagagggcaaacagcatagtactacaagggatcaagacccgcgtctacgatagactcatgtcacatgacaaaaaatgggtcgaagaactcccatcagtactatgggccgtacgcaccacaacgacaacgtctaacaaggaaacacccttcttcctcgtgtacagctccgaggccatgctccctagtgagctacgacatcatagtacacgagtacagaagtattccgacgagggancaggagagcaaggaaacgtcgatgtgaatctactcgaggaacatcgcgaacgagttgccgtcagtgcagccagttaccaacaagccctccgccgctaccacgagaagcgcatccgagcacgcatactttcgatcggtgactacgtcctctgacgggttcaaagccaagcagggcgaaacaagctctcacccaaatgggaaggaccttacacgatcacacaagttttgcggccaggcgcattcaaaatagcagacggtgatggttgcgagttggcaaactcttggaatattgaccaactacgtaaattctatgtatgagtcaatatcatccacacctgtaagacgccttacaacatcaatggagcctatttttaggtgcatattacaatcaaagtgttcctgcccgatgatcccttacccagatgacacctagcgttgaaacctatcctcatgtccctttacgccgtcttaacaaggccttcgaggaacctaagggatcttcggctggggacgcccagagccgataaggccttgtcagatcctatagggacgaaagaccatgtaagacctggtcgtgtaagagttctcgccgtgcgtattaaccaagctgcgtaatcggaaattcactttccaacttcacggctgggggctaggatcagtgcttattcaaccaaggcaggtcaaaggtccaagagccttaccctccgagaagaatcctccgacgacaaggctgggggctggggagagtgtatgactcaaacgattaactaaagttgtgaattgagaacacactcttacacacggtacccagaacatccatcatagggtacaaagactaccaagaaggccaacgccagttcatagactggaagaccttctccgccaacggcgccatcgacttcgctaggtggtctatctccgtcggagtcctcctagaacgagcgaaaccttcatggagaaactcaaggtccagtcgcggacgatgatttcgtaggcaagccaacacgtgccctccggcatatcggctcgatcgacgacattcctgcttcaagggttcgtcaatgcgtttgccgacgccttcgagctgagtacacgccccattcagccacgagatgtatccggccgccgactcttcgggatccccacggggtactcggagctctctacaaaccttggccatggacgtgcagcaactcttcaagtacgagttgaaccacacctcacgacctcagagcgtttccacagcttgctctttctttacttccagcatagttctctcgagttccgctacttcaaatttcgtcttccaatattggatacgacgatcttggccagcaagagcactctcgagatctgttcaatatggaaacaactaagtcaagctgcacccttctttcgggaacacggctgatcaagtcggaggagcaaaaagggatgaagggaccactaacctaaggaagtcgtcgccatcttcgtcctcgcggctaaaatctgatctacatcgtccggcgacgcgtgtggctcaaacgcaagagccggaatgatcgccggcgacttaggctgcccacgctgctggacatcctcgtcatcaacatctctacaaaggacaaaaaagtactcgagatcaaaatgctaaagaaaactaaggtgatgactgcatgcacaaaggcggttggaacccattggagttttacacagcatgtctaaggaatacaagagagtcaaaatcctactctttaaaaagggggagaacatattcccccaggtcaccgacttcttccatcacctccttacgcgtgtcgctagccgccccctgatccaagatctcgcgcagatcgagttcagggtgcgtcagcctcaaacacgcaaggacgtggcacgccccggtgtagatcccgttggatgtctcctctccgatgctggccgcatgcttggagggaatctcctccatcaccgccgccagctccgcaagagaagatgtcagcaagaactcatcgggattcgccgggatagtagacttgataccgcattccccagcgagttggtgcagaccagtataggtgacccgcaacgagccacggatttccgacaagttgttcccgagctccgacatgcggtgctcaagcccctgccgttgtcgctcattgccagccaccaactcccttatcttcttgaggtcctcacgagcctccgccaagtcgtgcgccagccggtcggcgcgctcgttcgccgatgccgccgccgacctcgcctccataatctcgtgaccaatgccgcgagcactagcctcgaggaggcgccccatttcaacctggagctcctcccaggtgaggacggcagccggtggaccacgaccagccgcgagatcgctggctgggccgcttggtgtcgcctcgcggcttccgggcacgaccacgacatccgtcgaggttacagaaggaggcgcgccggaagtccctccagactcgtcttgcgccgccttcgcccgcgccgccctacgagaaggctgtggtttagacaaagttcgacgaaatcacgaaaactcaaattcattcacttacttctcgccgagtgtcacaagccgctgccgtcgtggaggcgggggagacgcgtccgaggcctggagtataatcgatatgaagtcaggtggaagtattctgactacgtgatcaaatgacaggagaacttaccgagggggtaggtgcctttcgacgatgtccgattacagaggagaatttcctcccctttgttggaacgtcgccaccacttgttgtggcagcaacagcagcagcatcggacacctccttggcgactttctctttcagtgacgccgccacctgatggtccgcgagcggctcgatgatatcagtcagaggaacaacctacgctttattaagtcgtaaggcgatctcggaagaaaaacgcagaaggcccactgagtacacttacattgatggcagcgttgcgtttggccgcccccttctcgcaaaggggaacggggacattgctcgccgtcgtcgggccactgatcatcacctggccgacacgatgtctcacggcttcgccgctcagacctgtgaatcgagaaccaaagttcgataatgtcacgaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggggttataccataaaggggttagggttgcagtaaacagcatttaaagatatttagttgctcagggctattttgtaaacacgattctagaactaaacaatattctttatcaaggccgtgaacccacacgaacctgccttaacccaaggcctacgatgattcagaccgaactggcaacccgaccctgggtcccagctcgtcccaagccaacccagaccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgggcccagcctaaaaccatttttggggattttgaatagagggggcggtgtgaatccaattccacaatactccaacaattccacagtgtccaggtgatatgaacattcccaaagtctagagttgtaaaaccgcctaatgttacctaattaaaagcgaagcatctacctataatcatactagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttgcgccggccggcgccgtgggtcccacgcgttagccgcactcgagggcgcgggcggctgacggccgggccccacatggcagccgcggggcgcgcccgaaggcggcctcgccggcacggccgacgggaggcggcgcgcccgcgccccgatggtcgccggcggcgacctccggcgcgacggagcggcgcccgagagaggggagggaagggggaagcgagatggcggtcctcggctcaccctgggtcgacggcgacgacgggaacggcgaccgaagcggagagaggcggcggcgcggctcgggtcgacgaggacggcggcgttccggcggtcggcgggcgaaacgaaggggtggacgaggtcgacgaggacgcggcgaagccgaaggaggcgatgccgaagcgggaggaggtccggggcgacgacggcggcgaaccgaagctcggcggcgacggcggagagagaggacgacggcgcgagctcgattccgacggggagagaaagcggcaagggtcggaaacggaggagggaggcatggggagtgcttaaatagtgttgggagtgagagagggcggccggaggggaaggaaaccggcgcggcgatctcggctccatcaatgacgccggcgaagtttgcgggaggatttccaaacgaatccgagagagagagagagggaaaagtggggggaaagggggagggaatcacggggagtgatttccccctctttattgcgcgcgggggcggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcgacgcgcgcgcgggggaaggccgatgggccgcgggggagaggagagagagggagggagtgggccgagccggcccaagagaggaaaggggggggaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttagctttgcacatttaattgttggaggctttcacatggattttacttattctttgcataatttcgaggatgtattttagagtcaatttgggacgcgacagataagtcaggagaaacgcgcacacaagtaagtcagggtaaatgcaagaaagataccccgaggagaaacccgggtcgtgtcctccggtccagaatagtcaaaggctggatgggctcgagcctggagcggctggatccgtctaccaatgaagtcagcagcgacttcataccccgacaaacctcgtactcggagatcgtcgacaacatcgatgaaggactaaagggaaggggtcaaggtgggctttgcggtccaagacgaaatcttgtctggttgttcctcaggaacaacgaagataggatccgaattttctatctgaagatagaaccacctcctccgccatttgctgcgagaggaagggcactggaaggggatataacgcgacttcaggccatcccgaagtcggaatccaacgcatccagacaccctgttggattctatccaacgcaactcgtagtagaagcgaaagagatcaagaaagggctctacgccaatgtaggcctcacaaagatgtgaaaaaatactaaggaaggcaatagagttggggttcagatagagcaaagaaaggccgtagaagttcaaaaccaagagaagaaattcagaaggcggagggagaaaaccgcagagaatgtagtcctcgatcgcaaccatgtgacctaggacaggttggggttcagtacctcctgcttctctttccatggtcccgcgaccaggaagggcgccatcctcctaaagcttcttcagtgacgcgctggtggaggaagatttgccgagatccatcgctgactggagatcgccggaggaaggactgagattgacgagctagggttttgcgggagcggagaagacgagaaacgcttggaggctggaggttttcttcacaacaggcggacttcaaaatggatccccaaaattcccttaaatagacgcacttccgacggtgcgaattccaaggaaaggagagagatagccgccggaaatttctgggtccgttacgcgtggaaatctttcggacttcagtttaaattcactcatgaccgttgggcttcacatggtgttctcgactatgtcctgtctctacggttttcacaccgggaatgacaacagcctcgacactagaagtcgcgaatggttacacgagttcatttaagcagaagtcgggggctactatcagggttacgggttagttacaccctttacccttcgatatatgtcgaatatcggtatggcataccta

SEQ ID NO: 51474 - DNA, 11341 bp, Oryza sativa
ccaggttatatataaaagtccactaaactttttataaacccccttaaagccgttacatgactcctacaaacgctactaacccgtcacgtggcgctctaataaattagagaaatctaaaaaattctgagaaaaaaagaaaaacatcatatcattgttacatcacctgctcactattttatccaaattttctagctagcagctcagcacataaataataagaaatgctatattaactatctattatatagtaaatatcaaataaactccctacaaacgctctcaacctatcactatgttgtgtgctatagtggcactctaataaattagagaaaatcctataaattctgagaaaaaagtaaaacatatagcccttaatttttacttaaattagtgagtccgatatttcaggccattaaattaaatctattaaaatcattccttctaatatggatctgatgcgaatggatggagagaaaggtacgatgtactgttcataaatagaaaaaaaaacaaaaaagatccttcctatcctatgcatatggatggagaggaatgtacgtatatatgtactacctaaaaaaaattattacatgttacgtttatatgaacgtaacgtacgatcgtatgaacagaaattaaaaaggataaagctgaaaaaaccaggttatatataaaagttcattaaacttgatagaaactctcttaagcggtcacgtgactcctacaaacattactaagccgtcacgtggcgctctaataaattagagaaatctaaaaatttctgagaaaaaaaggaaaacatcgtatcattgattttcacttaatatggtggacccatcattttatctcctattatctcacctgctcacttttttatccaaattttctagctagcagctcagtacataaacaataatataagaaatgttgtattaactactccctctgtttcataatgtaagtcattctaacatttcccacattcatattgatgttaatgaatctagacatatatatctatgtagattcattaacatcaacatcactatgaatgtggaaaatgctaaaatgacttacattgtgaaacggaggaaatatctattatatagtaaaaatcaaataaactccctgcaaacgctctcaacctgtcgcatgcgtggtgtgctacaaacactcttaagatgtcatatggcgctcaaataaattaaaaatcctaaaaattatgataaaaaacaaaccattcattttcttttaaataggtgaacccaataattataactactacaataaatattttttaaaagattttttctatctatattgattcacatgcataactaattgtacatatatgagaaataattaaagagagggctagcatgatggtaaaaaaaccaacgaaagttgttgagatttcttcacgaaagagagatataaagaacactcaattcaaaatagaaactcaattcaaaatagaaaatacgttactttaattttaatttattttgttagaactattttcgaaacaaactaatgggtatgcccgtgcaaatgcgcagagttgtagaaaaatatttcatgaggtaatttggttgtcttttagctttttatataattgaaacattttcgatttactaaaaatatgttcgatctactcggtgaaacttgatattttttcccgattcgggaatgttttcatgccgcggggtctgaagttcctgaattttcggaaatacgggaagtttcgaaccgaaatttcagggctgacggaaccaagctgccgcctgttcaattcctatttcagcgccaccttccctcccatcctcggcgtctcctcgaccatcatcgccgccgccgccgccgccgccggcggctcgcctcatcctttctccggccagccggtcgacctctccgtcagtttctccgcgccctgtcctactcgctggggtaaccaccgccatcgtcttgctactcctcttcgttccctacaaaatcctacgagccatttttcgttttggggttttggggttgggcaagggggaatttgagggctgtgatgataatgatgctttttcgttggtgatgccgctgatccagttttgcaatgggggatcgatcgacgccgttttctggatgaatccgtccttgaaatcggccattttacttttccttttttgggatcaaagaggtaaaggggttcttaatcttgtagaagaaatggccttggcaaagcagttgttaagtgttgtcgattaggtttccagcaatctgcggaggtggaatgatttggggactaatgtggttttgttatttgaggcctcaaagtctttagattggtgggtgaacataacggaaatttgtgtgattgataaatcaggtattgggatttgtggattggaggaactgggtgtgataggttatttttatcaacgtccgcaagggatttatggttcttttaggtatggtggcactggcaccagttaattaagggttcttgttgaggttgatcatttcttgtgctccttgttgaactgattcccgatttataatggaaatataggagaaaaaaatgtggaagagtggtgaaaattggtcttgttgcttttagtgaatggtaggagcacatgctttgcatctttcatataatcatattgcttcaaggaaataattgtgccctacccgtgagaaggaattggttgcatgttttagttgtattggcatatatctctgatgtctatgttgtaatagttcagagcatgagtgcatgacagcattgtgttttctttgcggatgtgcctgttgtagtggtagtggtagatgattcttttcctctttagaaacatgcagtccgtatatcttttaggaagtcatataacagtggaaattcatcatattgttctctagcccatttttcacttcgattcttcactaaactttcaatagttccagtgtgttttattgtttaaagcacaaaaacttgatgtttgattcttctgatgtagaagtaacaatctaatgttagttagtttgatgatattgggtgccttgaaattgtcgattccgttggattaatatattaatcaaagtatggtgagtgtgtggattacatacagcagccagactcttatatttctggaaactccgatccagcgttaagactagcgaattactctgttgtagaaaccagactgtaatttttaccgagtcaagtatttttttttggcgtaaactgggaagcttctttctaattacttaaacaagttttttgatccagccatttgaatatccatgtattggatgtgtattctgttacatattcagttagatccttgattttccatcctgcagatctgttcctttcatataatcccctcaatttcaaattcttgttccaaactttatcttttattatggagttttatcatataataatagtaattttgataggtttgtggtgacaactttgttcttattaaggtttgcagcatgtgtacgctctgacatgatgtagggtctgaataggaagagctagcacctgtgtggaactgcataataattttgtaatctgaaaaatgttacttacatgctaaattgtaattttctacttctcttgtgctttctatttccaccttatattaactgaaatctcattcttgttaccaaaagcgagctaacctatctcatgccatatctgaacatgcttgatcaggtccatccaagcttcaagatgacaacatgcaaattcatcacttccttcgcaccgggaaggcgcagcatcggaacgcagcctcccatggctgcgccacgaagcctttccacccgcgtgatcagctaccccgaccgccgttccgcgaccccgaccccgaaagccggcctgaggaagctctgagtccctgcggtggatctctacaaggtgaagctcgtctcgccgaaaggggtggagcacgagttcgacgccccgggtgacgcctgcatcctggactccgctgagacggcggggctggagctgccctactcgtgccgcgccggggattgctccacctgcgccggcaggatcgaggatggcgtcgtcgatcagcccaacgggtcgtacctcgacgatgcgcagcgggctgatggctatgtcctcacttgtgtttcctacccgaggtccaactgcgtcatccacactcacaagggaagagaagtgtagtggccggccgcgaacgagtcatatcacgttcgtgtccagatctcagatgttgagagacggtcttacaaactatagcttctgttagatagttgtccggaattaatgcagtatttgccctttttgccgttgatgatagattagcttgagttggggatgttggtgcattgaactgaattatttacatgctgatattactgggttttatggagggaaataatactacctccgtttcaggttataagactttctagcatttcccacattcgtacagatattaatgaatctagacatacatatattcattaacatatatatgaatgtggacaatgcaagaggaagtagaatacagtaaatgaactgaaaaatgctgagcggctgaatgcaatgcatagttttggaactcagctatatataattttattttttaactaatttctgggatcgtttcatcaggatatttgtaatttcccttgggtattttatccttatgcactactcactaaggccctgtactttggttcctgcttaagccatacatggaaaactatgtttttctataaatttggtcaaatttaaacaaaattaactattaaaaatttaaaatgctttataacataaaatggaggaagtagctaaactgtttcccccttcgatgttgattggtaaaaatcctgtcgaatatttttcttgtcagaattgctgctgcttcgaaggaggcatgcccggctgcctttttttcttttcagtttatggaccttgcattattagcaggagtttttcgaaaaatattctttattagcatttcttagaaaagattttaaggacaacttttcaactttctcaaataattgtcataacactactatgaaaacatttgtacatgtcttaggcttttattttcacatccggcctaaaatgaaaagcacccgttaaattggggcttagaagcgtcagagggtgataaaccaacctatttttatagacaattttttttaaaaaaaatctgatcatgaaaatagatctttcacgagtggtttccctaagtaactacatgtgaaaatcaggacatttatataaatagagtgattttatagactgttcttataaggaaagatgtctattaaaatacaaattttttttgttattttcatcatgactacaaaaagaaaaatgggaaaatcattttcatgggtggtagtggaatttgaacacgcaaaatcttgatgtctataggcccttagttgtacacggtttgataaataggtgtatgggttaccgaccacttgcaaaaatgtgttatgtattattataaacataatttcttccgttagctgctaactgctcctataatctctttaaggagattccatttgttattattctgtacattatgcagctttaatgtaaatttaggtatgtgaagaagctgaaaagtgtaaatttaggttacattcttttcggcttcttcatatactacatgcatctaaaaacataatttctcaaaaactttcttccgttgtcattgatttgagcacttattttggtttatttttaaaaatatttaatttatgcctataattaaatagataatctgtggctatatatatatatctatctatctattatctattctatacttaaaaatccgttatacttcatataaacgcttccagaccgctaagtggtacgctacgaacgctcttaagtcgccaagtcttaaattaatggacccatttgttttagatggttagatagaaaagaacatccggaaccaacgtcgtacaaacgtacgtatgaactgtacgtacttccctactgtccttccatattttcattcatgtgttattttctatttacaggcaaaaaaaaatcacaaatagactaactactaggtctagcacctctcgctgtttctaaatcactacgtggtactattaaattagagaaagtactagaaaatcttaaaaaatacaaagcaaccgaccatcaataccagctataattagtgacttcatagatcatatgtgtaattcggacgttatgagaaaaagatcattttaaaagtatcacggtcgattcgtataggaaagtagccctcaactgcatgttaaaagaaataaattaagttggtagaaagtcattagatgtctaatgggatataagtaatagatggaggtccatttgtatttttttcctatatagataattttaattttaattgtcaaggagataaaaaacagagagaagaatggcgcacactgtacacgagcagggagggagggaggtttgggatgtttttctaaatcattcatctaacaacctaagataatgtgccagatgtttatgtcaaaacctaagagaatgacgttacatcttagggcatttataagatgtgtacctaatggacttttaacaccacttgccacaaaggagggagggaagaaggtttagggtattctttaaaaaaaagatccaatgacctaaaataatgtgtcaattaatccatgaaaataatgtgtccatcgatttatgtcaaatatgatggttggattttttttccaaagtttctaagaattttcctctaatttaagaatgtcatatagttgcctagatgcatttataagatatataatggattttaataccgcatggggatagggagggacggagagaggtttggattttttcttattaaaaaactaacaaatagatagccaaatgttttatcctttttaaagattttctagtattttctttaatttaatagcaccacgtagcagtttagaagcattcataggatatttagagtgacgtagcgagagctgctagacctaataggtggaggtttctttgtgggttttttaatgtaaaaataattttgattttaatttatcatgaagatagctcattggtatgcacgtgacgggaggttccgaatgtgtgctttttctaaaagaaaagatctaatatataaaaataatggatcacctatttaagtaaacaatcaatggttagattagtgtgccacttgacgacctaggagcatttgtaaggtacaagttggcggcttaagagtatttgtaggatgtttaatgaacttttagtatataattgtctgttttaaaaaaaattcaaagattttctttaatttaagtatgtcatatagtaggttgggggtgttaataaaatggttaatggattttaacagtgcatgggtttggaaggaaggagaaaggtttgaatttttttattaaaaaatctaccaacctaaatccatcattttaaatagaaatcgatcgacggtggcgccgatggcgtggccacgcgggtgacggagagcgccgcggcgaggttcctgctggtggcggcgcggccgcacggtgagtccgcctcctctcatctcgcgtgccgccgcctcgcctcgtgtcgcctccgtttctcacgccagcgccgatcaccccagctcgggccccgtaacgttcagcctcggcgcagcggcgtcctccactgccgacaccatcatcgacgacgaggccgtctttggggaaggtgatgcgtccgacgaggccacggcgggtgcgcagacctgcgtcgtcttcgttggcgacgacggtggtgccgacggcgtggccgcgcgggcgacggagcgcgccatggtgaggttcctgttggtggcggcgcagccacacggcgaggctgcctcctcctcatctcgtgccaccgcctcgatttcccgcgccggcgccgaccgccccagctcggcctccacggcgtgcagcctccgtgcggcggtgccttccaccgctggcagatgccggtgctgcgtcttctccagcccactgtccatccccatgtcgccgcgcacctcctcgcccctgcgcgctgcccaataagagagaaagaagacataggagagatgaagagtatgacaggtgggacccacatgttttaaataaataaaatgctgactgaattgccatgcatacgtcatgtaggataaaaccgctctggattggaccgaggggggtaattcatcgggtattgaaagttcagggtaagtaatgtctggtttttgggttcatggtgtaattcggtcgaccacgatagtttaggggggtaattcgtattttttccatgtattaattaactcgtggatgaatttgtgaatgtataaatttattgaggttctatgatgtgaacttatcaatgaatatttgattttgtgatccttgaacatctataaacttataaacttattggttctctgattttctgattccttgatatgaacttgtttcatttttcattagatttccgatttatcgtttgtggttttgaggcatcggctcgtatttagccaaaccaagcctttttttttttacaaaccatactccctcactactagaaaactgatctttgctcggtcgccccaaaaccacaatagtcctggttaaaaaagaaccgggactaaagaggatctttagtcctggtttaaaaccccagagccattctatgatctttagtcccggttggttcatctttagtcccggttcatcccctgtcaccttgtcagaggggcggggatctttagtcccagttggtgtcacaaaccgggactaaagatcactttactaaagatctcctagatctttactcccagttggtaaaatcacgtgtagtatataatccctattccctatcctctcaccaacaaccggcctctcctctcatcagatccatctccctctcctcttcctcctcccatcccggcactctccttccccctcccttcccatctgatctctcctcagatccatctccctctcctcctcctcctccccttcctcctcccatcccggccctctcctccccctcctcccttcccatccgacgcccagcaagggccgcctcctccccctcctcccttcccgtgcccagcgggaccacacttggcaggcggccggcggggccgcgcccagcggggccgcacgcagcaggcgccgcgcatgggccgagtagcgagcggctacaggcagcgctaccgacatccatttttttcttttttttttacaatttgtgattctctgatatgtataattttgtgatttgttgtatggatctgagatgtataatatgtgatgtatttggtttgtgtgtaatttttttaaagatttgtgatgtatttgatttgtgtgtacaagtaacttaagatttgtgatgtgaatgttttggatattactttgatttggggtttgatttaggactatgcatcccactcgattggggagaaaatatagggtttaatctctggctaagaaacaatgaaaaaaaagaaaatgagacctaatgggactgctgctaccctatctttagtccgggactaaagataccaaccgggactaaagatctatttttagtcccgattatttcaaccgggactaaagatgggcatctttagtcccggattgctagtcccggttggaaaacgggactaaaggggttaccaaccgggagtataaatggtttctccaccagtgcctccggtttcattttaattgacgttttggacaatgacacggtctacaagatacatctttgaccttattttttctattataatatatataataaataaatgcatgtttacttttattatagtactttaaaagacaaatctatatatgttgttctagttcctttatactaaatatttttaaagttattgataatctaagttataaaagtttgacctcaactttatcccaaacgtcaattaatatagaattggagggagtatataccttagaggaaccgacaccattaacataactcctcgttagcacctgctcgatcgatgccggttaccaaatccgacaccatgtgaagttgataaccagcacataaaggcttttcgtaagtagtgcgtgcgtgcagttacagagctaatccgtgaccgtgatcgtctccacttcgatcgaccgtttcgtcgcggccacgaaatcgccatcaaaactgctgcatccgactgggaaaaggacacccccgtacacgagcccgactcgtacaccacactaccccgccccacgctataaataccagctctcgtcgtcctcctcgatcgtatcccaccaccaccaccaccagagctagcgcagcaaccgcgagttcagttcagttcagtttttgttacgtcgtcgttcgagtcgtcgtcggctagcttcgattcgaagaagggcaacaatgaggttcgtggcggcgtacctgatggccaccattggcggcaacgcgagcccgaccaaggacgacgtgcgcgccatcctcggcgccgtcggcgccgacgtcgacgaggacaagctcggctacctcttcgaccaggtcgccggcaaggacctctccgagatcttggccgccgggagcgagatgctcgccttcggcggtgtcggcgccgctccggcagccgccgccactgccggtggtggcgccgcggcagctggtgagaaggagaaggaggaggagaaggttgaggaggaggaggaggacgacatcgtgttcagcctcttcgacgacgaatgagctatcgaccttcgtcttcagccctgcatctacgtgccgtagtccacatgtcgtccgtctaagtttagtcgtagtagtatatatatctatttaatttgtttatttagtgtatctgcgcgtctagatatataatggatgattttataagtacgctaattaataccttcatcttatctgggtttgatgttgctgtgatctccatcgtatgacttccttctataaatgcaccagtatatatatgcacagtgccttgtatgaaaatatggcgcgtacgcgtgtatattttatatacatgtacatacaaatagtatagaattaaaaaaaaggaacttctatggataattagacgacgttaacccatttatcattctataaaagggagtagtggtggtggttctgctattatcctcactaccaattcctaacttatggggctacagagggatcacatgtcaatactcacacaaactcagtatggaactaacaaggtctacgtgtgagcacaaatatgtaaacaattaagagatattaataatatgttaatgataatactaccttcgttttttaatagatgac

SEQ ID NO: 51475 - DNA, 9303 bp, Oryza sativa
  unsure (1)..(9303): unsure at all n locations
gtcaaacatgtgagaaaaagtcancggcgtcatctattaaaaaacggaaggagtatattgcaatgcacatacactatgctttttatacagacgtgatccctcctcacaccctatctcgtgcactgcttcggcgcccaacacacgacgtccagcaaaacctttctcccatgaactggtctgtcagccaattaaacttcacctaccctcttcctcttgatccctctcaagcaactcccactagcccacggttttcacccccagcccacatcaagaccgtatgttgagaattgagatgcccttggagagtggagaccgccatagtgagaagtcgagtatgcatggttccactactaaaccctagctcgcctcgatctcctcatgccactcccgagcctctggatccctcccttgtctcctcgtgcatattcatcggttttattttcttttcccacgactgctgagatgactcctcgttgtcggctcttgatttcttttttttttcaggtgttccttcacagatcgtctgcaaagattgcaagggcatctaccatgccaataagaagtgtatgttattattcgtgacatatttatttttatgtaatggcagaaaatactcaaactttatttctttaatttattgcaaagagtatatatgtagtactcaaatttgttaattttgtatatactacttcctccgtttcacaatgtaagtcattctacaatttcccatattcattttgatgatatgtctagattcattaacatcaatatgaatatgagaaatggtacaatgacttacatttacttacattgtgaaacggagggagtagaaaaaataaccgtgtgttgcaatgggagataactagatggaaggagaggacttccctggtaagaggtgggtgcatcggtagttagggataggatctggagttccgttccgtggcattagttggtaatttttgtcagaatctgaaaatattttttttgagagaatagaatctgaaaatatgatgaggagcgtctgatggaacatggaagtagaaagatcatcaagccagccatgggcattggatcgaacactggacaaaaataggcgggcggaaacttgcatgtagagtgcatttggttgtaaattaagagaactgtccatttttgtagataatggaatgaaacatcgatcctggccttttcttaggtacaaccaattattataaaaagtagcacactaaaaaggtgttgtccaaaataaaacaaacacaccaaccaaaattaaaagaagacctaacatgacaaggaaaatattattctagtctattggtgaatccccgttcatggttggcaaaaagttacataaccgttgtcttaagattacgacatgcaacattcaggaattctccatctccctcacacttttgtagttgagcccatagccaaaaccaatatgttgccctgaaaattacctatatataggaaacagatggtgatttgtcaaaaaccctatcatttctacacaaccacagagcccaacataaggccgaggcactaacaagtatcagtttactctttttcttgtccacaccctaaagccaaccataaaaattataatatatgcttctagaaagaaggtataatccaaaagaaaattgaacaactctccaaacaaactttgcataatgacaatccataaacaaatgttgaatagtcttatttttcataaaaaaaacaacatcttaaacacccattccaattccgtcttgctagattatagaggattgcccattggcttgcgtgttgtgcctttcatatcgcgtttattttatgataattatgaaaatagctttaccctagaaagttctcgaatgattagtatgaaaagttttctaaatttagctatatgccacactgttgtcttatccattaacttttttatttttatttatttatggtgataataggaaaacggacatatttatatttgaccaacatgatggatcaattactctactgttccgaaaatggaacggtgcagccacacatgcaggtcatctccatctgaccttcccagcaggctcacggtgcacaccttcgttccatcgctacagagagagaatcagagcacagatgcgctatgaactgagaagaaaaaaagaaacgatgcgataagctggaaagaaaagaacggaagctatttttggtcttttggatcacaaaacctattgtgaaccgcatcccgggtaacgggatagattataatgagttaacgacgagtcgttgcccccaccaatcgtgcggatgtgtctccatgggtctatatctcttcctcccacgcacacgtatcgctctcccatacctttcatgtgtcaactgcactcccccacgcatgcatgcgctcgtattgagtcgccacacaggtatcagatctgatgtggtgtcagattcaatagttaatacttgagataccagatttggttggaatccgtatcagattcgatacttgatacctgaggtaccagatctggttggtacccgtatcagatcgggttggtacccgaggtaccagtctgctaccaaaggtatcagatccgatatttgggatatcagattcggtacttggggtatcagacctgataccatcgtactaaggtggatagtacctggtctgatatccacgaggcatcaagaccagtagttgtatattagacttggtaaaaaaaaaagtatcaaagcgtacctagaggtatcgttttgtaccaaacaagtcattttcttcctctccccaacacaatatggatgtgttctttcacacatttttccaacccacatctctcattttccgcgtgcacacttttcaaactagtaaacagtgtcatttatgcaaaaaaatctttctatatgaaagttgttttataaatcatattaatccatttgtcaaaaaaaatagttaatacttaattaatcatcaaataatatgagcttcgttttgcgtgcagcctctgccgtcgtcgcactcatgtcggcttcttggggacggtaccaatggctggcccagatggcgttgcggtcgacgtggcaagaaaagagctcccggtggcaagtggctatagtggttgtaggcacagagagggtgatagaggacggagggagtagcttgcacgcggtgggtggtggtgcgtggatgactttgtgtagacgaatcaagataaggtgtagagcgttgatcattagtctatcctgttcggacggtataccgtggtctaacagttctccttttggattccatgacgacggaacaaatcacccggcaaataactctttaatttccgtgcgtggctagcaaataaccgttgcaacggattttaaaaaaatgatgttggatagactatcaaagatccatgtccgtccttgtcttaggtgggcaggcaagcccaccacaccacatgcaaggcctacccaggccagaaacccatacgctccaggcttcaacggagagtagacaggcctgcatgattttataagagcaggtacaatagcaggatataagccggctataaccatatatcgagaagaaaagagaagagagagaagaaagcggactataaatttgtagccggctataacacggactccaagatgttatatgtgtatgagaggtgggaccgggtattagtagtgtagtatatttttatagttaactattgtatgaaattagattggctatagatgtcttggagccagtagttggctatactattaaccttgctctaaagcgatacacggaaatacttcgcatcggatacaatatgcggacgaaaaaaacgaaagaaagacgatgtgactatataatcatcttcaatttttataatagataaagattatccgacacatatgatatgtaaggcctggtttagttcctaactttttcttcaaatttctaactttttcatcacatcaaaacttttctacacacaaacttctaacttttctatcacatcgttccaatttcaatcaaattttcaattttgacgtgaactaaacacatcgtacaacaaaatcacaaatattacctagatatatttccatcagaaatattcccaacaaattgtacatctccttccatgctcccaggggtacaattgaccttgttgcacatatcggtcaactactaggatcaagtgatggaaaaagtataaaagaatataatccaaattggataggatttaaatgtgcaaggaaaactaggagtagaagagatgctggctaaaatttttaagggcacaggaggaatcttatatgaaacaaaaacccgaaataatgaagagacgtactcgtccgtgtgtatggtgaaatatgtttgtaaccaaaagaataaaatattgtctgggagtgtatttgtatttcttcttcttgcaaacataagagtaaatttcacaaaaatacatatatatattgatcaagttatcagaaaaactacagatttaagattatgtataaaaaaactacatatttaacataaaatttatcataaaatatagatttaacgatttaataacaaagttgtcacaaaactataggtttagcgtcaatttaattacaaaacatggacttttataactcaatcataatattagtgctaaggatttaaacctaaatctatagttttgtgataattttattattaaatctgtagtttcacagtacttagccttaaacctaaaattttttgataaatttattgttactttcttcgtcccacaaaacctgtcgtttcaccgcataaggattgtcccagaaaaaactgtcgttgttgagagaagtggtgggtcagcctactccgtatgcgtggaactagaaaaaacgaagtgttttttattatttttgtcgctaccgtgaatgattcacgatctaatattctcgccaactgaataagatggacccaataccgttttcgggccctaggctgacacaagtggtatggcgcatgtgggctctgtgtaccggcacctatgaggaatatgggaaaaaaagaaaaaaaagaaaagcatatatggaaaaaaaaggtaaagcctaaaccggcacgcacgaggcatatggaaaaaaaaaagaaaagcatatctgaaaaaaaagaaaaaaaaagaaaagcctcgccgacctccatctcgccttccgcaccccgccgcctaccatgcatctcgccttcctccaccctgccggccgccgccaccgccgctgtaggccatcgtgtgtggccacttcaccacattctccaccaccatcatcccagatcacatcatccccatccaaaaatcaatagcaaactaccacatatatggaacaaagtatcaagaactcaacaagttggacatggaggaggagaaaacagaggaagaactcaagaactcaaaaagagaaaacttgttatacttgggccaccccgccggaagccacctctcccatgccagcctccaccaccaccgcaaccgccgttgctggatccagcggccgccaccagccgcctcctcgtccacgccagtctccaccaccaccgccgccgccaccacctcggcgcgtgtgtgccagcctctgcgtcgtacccaggtcggtcgtcacctcctgagtaggccgccatgtcctccgtcggccgccgccgccacctcgccgtggttttttctctaaaaccgacacctataatattaatattggtgtcggttcagttaaaaaaccggcacctatagaattggtgtcggtttttctttagaaccgacgcctatagtgcttaaaggtgttggttctatattttttcatcgtgtggaggtgagaaaaggctcataggtaccggttttaaatgaactgacacctataaggttagtccctatgagggttttttagtagtgtacgatcatgcactaagaggggggcgtgttcctgattagttgcgaagcctaggtatagattaaattcgacgaggatgtcgaatcttcgagggtgggtgaatgtaacaccctaggaaagaaaagaagagtgaaagctagtgttggcggctgttaaatgccgactctataccgccaacatatgcataaagttcggataataaaatatccaacatagtgataggtgcttaaatctcacatattccatagtgttggtgtatatttatatgcaggtgataaaacccgatgttgggaggaaatttaaaccaaagtgaggagaaatatgtatccatacaaggatgggttgtggacttcatagaaatactagaaaatcagcccaaaacactaaagaatggagagaggaggaccaggagaggagccaggccaaaggccaggccaggggggcccagcccaggtccctggttcggccgaaccctagtgatcaccgttgatcccaagtttttggcatggacgctccagatgcattcctgatggcggttaaggggcacttcggacaattctccttcctataaccgtcatacatatcctataaatagacctcacttcattcacactcacacacacttccaagcttgagctgaattataagaggctctattgtactatatcctatactagaataggaagagagtagagtagaagaagtcggaagaattccggagttgtcggtaatcttctcctatttcttttattctgtttattactctgaattcaatataatattcttctggagtaatcttgatttatcttgtgagaatttatctcttggttagttcctaaatagcatacgggattattgttcactataatcaactgaaatatagtgattgctttggtgagttataaacactaaagtagatattaattgcttagacgtggtgtttaggtaattattatccagtaattgctgcgcatcccacagtacgtttgaggtaggtgtagaggtggtgacagcgctcgagatcacttaagtcctccatgtctgggtacgtagtagagtgacatctgggaacagtgggttgccagtgccgaagtatcacattaggattaaagttaaactttccctagacactgtttctcactagtaaatcctctctatcctggcctatcatttgcttagtgtccttggatgagccggaggaagatctgactatatacgttcccttggattcaatacccttggaatactccgtaggggaagtgctacatcggtatatccgcgcgcttgcagattttatctgtaaccgtatcaaatactaacaagcatttctggtgccattgccggagaacggttgctgatcatttctgaacctagttcatcctcgtagcctttttacttttttttaattctatctctacccctgctatcctagagaagtattcctgtcaaactcttctcgaccaaggagcaacttctttttgagttgtctgctcctcgaggcgaattctatgagccacctccttcatcggggtccatttacataactggctatgaaattcgccccgaactaattagtatggttagggaaaattctttttttggctttgatctagaaaatccctaccatcatctgcgagattttgaaccgcgaacacgaattatttttttattagtacccaaccttactgatggtaaaccgtgagacgaatttattaagcctaattaatatatcattagcaaatgtttattgtagcaccacattgtcgaatcatagagcagttaggcttaaaagattcgtctcaaaaattagtcgcaatctgtataattagttatttttagcctatatttaatacttcatccaggtgttcaaacgttcgatgtgacaggtgttcaaaaacaggccctcattatttagctgcaatagctgtatatttaaaacggatggaggaagtaaataggtagttttttatataccacttagatatgtggttctgtgaaatttacttcaaacaaaatgacaaagaaaagattggagaaaagctttttctattgacttgcctggaattcactacccctttcaaaggagccgcgtccgccaacgcgtcataccgcgtccaacgcggacgttgatgcaacttgaccacttgagtagtgacgagtaaagaactggacccaccctatttgatcgctagctactcgtttttaacaaaattcgaagtaaactaataaaaaagaaagactctgttcctatgcacgttgcaatggggtcataggctagtaatagttatacacaagatgacattcattatatttttttccgcttatttgagaatgtgtggcgtgagtccaagtttttgaattctctctatgtggtttaaatcctacttaaaaaaaatattaccatggtgtccttgtccttgggtagtgtttggctaataggatagagaaataatttcccacacatcaaaaaatatctttaaatcttaatcatttattctctcttccatttaatactaatccttcattcattttccaatcccaatctcaacatcaatttcccattatccaacgcacccttagttctatcggatggatgcatgtcctctacaataactatagagaacagtgattgagtcttgcgatacaatgatttccattatcttggcattgtagcaacattgttctaaaagtaatcgattttatcatcgaacacctcttactgtagcacggtaatgtagcatgctaatttgcagcgttcaatgaagattcaacgtatcaaaacatgagctaatgtaaaataatgtagcacctctgcatttttttacttcaatgaaaaggatcttattccgtactggtgctgaagttgaatgttttatctccatctatctatctatcttctattatatactaaaagtccattaaactttctacaaacgctcctaaacctccacgtggcgctcctacaaacactcctaggccgccacgtggcactatctaatctcaccgttgattttcacttaaattggtgaacccgttaatttagaccattagattagatctattattaaaaaaattgatagtttttcttaaaaaaaatatgcaactggtggctgggaaaaggaaagaaaatgtccatacgcaagtataattgaaaaaaacaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51476 - DNA, 1378 bp, Oryza sativa
gttggatgtttcatagagtggtagatatcctatataatctaggccaacgttgttacttaacctaatcggctacctttcaatgatagatgtagccgattgaaggttagataacaatattgtcaggtattatatagaatatatgataactcgacaacttacatagacaatattagagtatcataaagatggaagcactaatcccgagaacgcaggccgccataacaagtttttcctctagttgaagatcgaaaccgatgcagctcaacccgaaagcaagaactcgtcgaaacaaaacgaaagtaaaagggtggcgatgcgccgagattgttattgaacatgtgttatcgattacatgggactcggggtctatttatacccgagattacataatatgtccatatcggacacgactcttatttctaacaaactctaagataccataagtctttactgcagacttttgcccgaacatatctctaaggaaattacataaaatatcctaattatagatacaattgccttttcaggactcaatctgtgcatggcaatccatgtgaagcactttaacctaacccgatgtcatgtatcgagtcatattgtcggaaccggcttaatcggctaaccttgtccgatttgaactctgccgattctaatcgtagccgattcggactttagccgattcttgctctgtttccagaacgatctccatcttggatttcgcttcggttttatcttcatctccgatacttgaattaccaaatttggttgttaacagaggtctagctttgcagcgagcattttcatctccttgacggtgtgcattcctcgctaacaggtccggagtcgttcctcgctccagcccaaattggagaccatcttttctataagatcgacggctcctttaaccgtcttagaaaagaaagctcctgcagctgccgcgtccaggtggtcacgggatgtgggagtgagtccattatagaagttctacaggatcagccagttgtccatcccatgatgagaacaggcggccatgtactcctgtagtgattcccacgcctcgggaatagactcatctctcgtctgctgtaaacttgaaattctcccgcgtagggcgttggttttgcccattgggaagaactttgataggattgccattgagcatttgtcctaggtgttgatcatatcatggttggcatagaaccactgcttagctttccctagagagaaaatgggaatagtcggagcctgacggcgtcaggactgacgcccttcattgtgtacgtgctgcagatttccaggaactgctgcagatgtgcattggcatcctcgtttggcttgccacggaacaggctagcctacgccatcatgatgaggctgg

SEQ ID NO: 51477 - DNA, 756 bp, Oryza sativa
cagaccctttgttaaccgtttaagcttaaaagtgatacgcttagccgaataaaaaaactagggtcaacactctatacttgtgccacatgatcaaagaaaccctctatctggacccaataattctcaaagcgaaaaacattcgattttggaatagaggattcaattttgatcacaaaaggaacatgatcagaaatagctctaggcatagtataaaccacaatgttagggtctttagggtccagtcattagaggtaaagacccaatcaagctgttctaagaggtgattactttgcatattactccaagtaaaacttctccctttaaaaggttctcaatcagccgtaaagaactgataatattgttgaaaatgaaaatgttattcatatcagcccctggcttatttctattctccacatatctgtaaaaattaaaatcactaagaaaaatccaggcttcatcatgctgaatttggaaggattttaaccaatcgacaaaataaactctttcatggcctctacaaggaccataaattgaagctaggaaccaagatttagagttatgcctagaagtaaattttaggcaaagtgcaaaattattagaggttatcaaagaacccctaaaaatggaaccacaccaacagaccaaaatgccccccctaagcaccatgagaaggcacaaagtgaaaactatcaaatcttttgggcacaacttttttaagagaagcacagtctacaatctctcttttagtttcctaaa

SEQ ID NO: 51478 - DNA, 956 bp, Oryza sativa
ggatatgaataatcaagatgggatttacccctcctatggagagatatctctatcgtgaggcaaagggattcatacaagtatacactagaggttcagccaatatggtttttatgtatgcccggtgggtcaatacgttctgctgggggccgctgttgacgcgtggaccgaaaaggattttcgggttacagcgagtgtacatgaacctactgggtcgcacacttaatgggccggaataaggagattggatggagatccaatatgagcttaattcggatagggatccgaataggagtcctacgggccttggaggcctgagtgatggatcctatatattcgtgaggggtgtgaccggcggaggtattgcatcacgtgagaaatcctagccgtcactcccctccccgagcaaaaccctagccgcgcgcgggtgctagcacatctgcgcgtggcgttccgtccctgtacgtgtggataccggtagcggcgctgctggtttgcggtgctgatcagcgtaggaatacagcgaggagaacgcacgaggaggagaaggtcgagctggtgcgatcgactacttcttctacatcgacgcacgctacttcgtgagaattccttcgacttcttagcgccttcttccgctgcgcagcacgtcgagtggtaacgatctatgatctaatacttgcatggttcctggtttacgcgatagaaaattttgatttctgctattgtagcctacgcgtaacccaacactaaagtaacagagctagaggcaacaagtgaacttgggtgcacatccatctcctgagaggcagaaatatcaacagggggccacgcagtagagggacttcatcaggagcaaaaatatccagaggggtagggggtagaatagccaggggaactacagaaatcattagatcccctaaagcatgcatgacatcatcaaccactaatagacttttttt

SEQ ID NO: 51479 - DNA, 728 bp, Oryza sativa
ccgattttcccgggtagagtgggggaaatggtggagacgttgaggggttcgtgcccacgtcgttgaatgcgagctcgggtgcgggagggcgccggattttgcgtcgacgtggacggcaatggcggttggggtcggccggcgagaggtaggaggaggagctgacgggtgggacagtcggtcccacctgtcggcgaagggagagaaggagggacgcaaaacagatttttgcgagcgggccaagtgagaggggagccggcccgagagagggagaaggcgcgcgggccgcgggagaggaaggaagacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttctagaaaatgtattattaattgatttttattgccgaacgaaaatcggggcgttacaaatctcccccccttgcaggaatctcgtcccgagattttgggatggctagaaagaaagccagtggtggtgggcgatatgactgatctgcacattgaactgccacattctgcttcgaactgattg

SEQ ID NO: 51480 - DNA, 706 bp, Oryza sativa
ggcctaggagatctgcttagttccagtgcaggtccaaatcttgataagatgcaggcgtgccagtcagtttgatcttacaactgacaagatatacaaatagcagatcaatgaaccaatcgactgacaagccgatagattaattccagctgatgccgataccagctgatagcgatagagttttgagctatcggttatatgtttgatgtagataacaatataaaggcaatcggctaatgatgatgtaacaacataacaataatataatccagtagaaaccaatcggctaacaatgacatgatagaataaacactgatccgaaggttaaagcatacatcggctgaaggtccgatgccataaaatccaaacgattagataaacagtaaaatctttgttgcgatcggctaaatccattatgtatgcaatcgttgtaagccgatgcaatgtccagataactcatcagctgaaaccccgatgaaacccttattagcaatcaagaaacaagctagagattatggttctaaacatgacttagtagatcaaacttaattgatgcagcactaagtatgaaaagaaacataatatctagacaatcaaacccttaactgattttcggggtggtagatatctaagtcaatctaatctagcaagacgatttagccgataccggcagaaaccctaaagcgagaagcagccgatagagctaaat

SEQ ID NO: 51481 - DNA, 2925 bp, Oryza sativa
agctaagcacaggagtaggatattatgcttctcaacggcccaaacctgtataaacccctttatctcattgttcttgaggggcccaacaccctctacaccacacttctcaccgagtcctcgaatctcacccgctgtccccggccaaaccaacaaagggggcctcactgtcccccgcttgcggagttcaccctccgacagtcagccttctcatctccatgcctccttccttacttttcttataagcccttgactatgcaaatctaaaggatagggggttgttcacaatgccaccctctggttccccatcctctgctggtaaagagaggaaggggattcaccctgccaatagatctagtagtttggttagatttttctctaaataaagttttaattttttgttttgcctcatcgacgtcaatggcggtggcgatgccacaatggtggatcttctagtgttggtccctatccatcttgtctcggtggtctattttatggggtgtgattggctatgggcttcgtttcacctagcttcgtcgcatgggtgaaaatgatggcgttctttgtaataacagtcctccaattctatctctttgcttcaccggtggtccatctggcactagtgaagggattgtgagggtcgtgtggttgcgccgatggatggtggagcggaggagcaaatctggtttgggtttgggtgtaacatacccaaattttagaccttaaaaatttcctgtcaaaatagttggaagttaagttttttatttttgggagccaaaaatttccattttaaacctaggtaaactttgatctaactcttgcatgaataaaatttgagaacaaactttttcatctttaacctatagcatagatgcaaacacaagtgtaagcatgcatacttgcataaaacatattttaacttgagtcttctttatgcatttggatttttggttggcattgcatattaggacccatgagcataaataaaagataaagattcactaagcaaacctataaccacacttgagcaataattataaagacatgaaaatgaagtcaaatgataccacctcaggtcaagagtagtctaaataaatttcttacaactatgtagatccatttataaattggaaacctatataaagaaaagtcttgctaattatctaaaataatttgtgcaagataaaatcatgggaaaattcatgtaggctctacttaaaacatgcaactcatagtaattttggtacaatttaataactaaatttaatatctcaaataaatcagtcaaaccagtcaaataatagtttaattataatccttaatcggctaaaaacctaccctcactaattgtgcattaaactgcatggaagtgtataggggaaataatttattcaaatattaggttaattatcatgaataaatataattttttcagaatttatcttctctacttagttctcctaaaaattcaaattagtttccaataagcccatcttcttttaatttctgtaatttctgtgagcaatctatccataatttttgagtagaaaacgttaactaggtacattcatttacctccaataaaatccacacgacctcatatgcaacacgaattaatctatgaattaacaagttagggaagagaaaataatctgaaaattcgtccaaaaatctctttcacacagttttctacccatccccacactccagcctagtgtacttcgccctgggcccacctgacggtgtcacaagctagctccaactctgtgcagaaccttcccaccgatctaaagactgagagaaaaagagagaacgagagagagagagagagccgaccgagctctggggcgcgtcgacgcgtggccgagacgtgtcgccgctccaaacccaacatctcttgatctcttccctcccagccgcttcacccatcactactcctcactctcaaaccgaagaagccgagggagaaggctctctgctcctccggcgctctcaatctcgtaaccggccgcgaagaagaaggacggcagcaatcgtcgtcgagccgcggtcatctcctcccttcatgcgttcccttgtctactcaggatgccggcttcattcctctaagtttcatcccatttggtgcagcggatcgtcgggaacgcggacctcaccatcgttgctccggagcgcgcaccgagtgccgccgtcgggttctcgtcgtcgttccgaccgctgtagaccaagccaagccgagccgtcgcgccaacatattctccttgaagtcctcctcaaaacccttcaagaatcccaggcaatggcgcagcaagtgcggagatcggccaccgtcttcttcacctccggtcgccgtcgccattgtcgattccgcctcctccggtgagccattattagattactcgcgcacacaccatctctctggcctcactaacctcatggacacacatgcatgatagttcttggagccgattgagccgtcgccgttcaccccggaggttcttgccgccgccgagccgttacacgagccgccgtcgtcaacctagcttcgccagccttgttttacatctcggtgagcacactggactccttagaaaagcacatgcatgcactcccttagtcgattcgcgcctatggcacaacatgcctacccatgccaaaacatcctccgctcggactcgccgccggcgttactccgatgtccactaaccgagaaaagtataggaatggaatcacaataacatgatcttcatttttattttggtcgtacccccaaacgagtcatcgtttgccgccggcgagctcgagatcgagctcggccatggcgctctgttctcgcagggacttcgttttgagaatttaaataaatataacgttcatgagaatttatttatttaaatataacgtttaaataaataaatttaaataaac

SEQ ID NO: 51482 - DNA, 856 bp, Oryza sativa
acccttcccaagcatgggcattgccagttttttccaaccaaagccatcaaatgcgcatagctcaactcttatattccaaattgtggattctcaaaccaccgtacataagggaccaacaaacctgctcccaagcaaccaaacaatttgccaccgttagccttttcatgacctgcccaaagaaagcctcttcgtatcttgtcaatagccttgattactgttagggttggaattgtgttccaccgaagggggaaggatgcggaacgacggggaacacaagcgcgcgaaggcgatgggaacgcaaagccagtgggcgcgagttgcgcgtgccagattgctacaggactttagcttcatctcaattagttaggattcactctcaagttatttagcaaatattatccattttcttcagctaaattagttacaaatgtttgttcttgtaagggcagactcaaggaataaagcaagccgaattaatctcatctactattttccatttcctcgtctccttccgattgcattcatcagcgccctgggtcgccgatctaccaagctccctaagcgtcggctgcctacatctcattcatatcctattcgatcattgccaggagctcgtgacaactttgtatcagaccatggaagaaacctccactgccaaacaaccgcttctggaaccctggtcccctcgacaagctgcaggacaatggtggatgtcctcgccagcatttcgctgctcgcgtccaagattgatatggttgatctcagtcgatcggtcgccgttgcgacttctcgcatcactgcacttgagcagttccaggttgcgtcgtctacatctacgtccaacaacgcgccctgg

SEQ ID NO: 51483 - DNA, 12358 bp, Oryza sativa
tccgccaggcacggaagtcacttgggtggaggtctgccgcagcttcaggaaggcgcaggtgccagatggggtcgtggcacaaaagaagagagaattccgagcactccaccagggcaacaggacggtgacggagtatctccatgagttcaatcgcctcgcgcgatatgcaccggaggatgtccgtactgacgccgagaagcaggagaaattcctagcaggtctggatgatgagctaaccaaccagttgatatctggagactacgccgacttcgagaggctggttgacaaggcaatccgtcaggaggatcagcgcaacaaaatggataggaagaggaaggcggcgcagttccggtccaaccaagggagccaccagcgaccgcgcttcactcccggacagcagggtggacctaccaccctgatcgtccactagcaccgccctttcaatgccagcaacttccatcagggcgctagtggcagccagaaccaccatggcggtcagcccaaccgcagtgcagctccacgcccaccaatggcaccagcacagtcagcttcgtccacgcaagccaagaaggagactgggacaaagccagggtcctgcttcaactgtggcgagcttggccacttcgctaacaaatgcccgaagcctaggcgtgctgggccaaggtttgtccaggctcgtgtcaaccacgcgtctgcggaggaggcacaagtagcaccagaggtcgtactgggtacgtttcctgttaactcaatccctgcaacagtactttttgattctggtgcaacgcattcattcatttcaaagaagtttgtcgggatgcatgggttaataagagaggaacttagtacaccaatgcgggttcataccccagggaatagctccactttggttcaattcagcccctcggtaacgatagaaattcaaagatcactctttctggccaacctcatccttctcgaatccaaagacctagatgtcattcttggtatggattggctgaccaggtttaagggtgtcattgattgtgcgaatcgcacagtcaccttgaccaatgagaagggagaaaccgtggtgtacaagtcactagtctcaccaaagcaaggggtttccttgaatcagattaaggtggaaaaccctgtgaccaccgaggagaagggttcgcggaaattggaggatatccccatagtctgcgagtatccagaagtgttccctgaagacctcactaccatgcacccaagagagagattgaattccggattgatttggcaccaggaactgcccctatttacaagagaccgtacagaatggcggccaacgagctagcagaggtcaagaagcaggtcgatgagcagctgcagaaagggtacattcgaccaagtacttcaccttggggtgcaccggtcatttttgtggagaaaaaggataagacgaagaggatgtgcgtcgactatcgcgcactcaatgaggtcacaatcaagaacaaatatcctttaccgcggatcgatgatttctttgataagctgaaaggagctaaagtgttttctaagatagacttgtgatcaggctaccaccagttgagaattcgggaagaggatattccaaagacggccttcaccactcggtacgggctatatgagtgcacggttatgtctttcagacttaccaacgcacccgcattcttcatgaatctgatgaacaaagtgttcatggaatttctcaacaagtttgttgtggtgttcatcgacgacatacttatctattcaaaatctgaagaagaacataagcaacatctccgtctggtactcgagaagttgaaggagcaccagttatatgccaagttcagcaagtgtgacttcttgttgtcggaagtcaaatttctgggtcacgtcatcacagctcagggcgtggcagtcgatccgtcgaatgtggagtcagttaccaaatggaccccaccgaagaccgtgtcgcaaattcggagttttcttggacttgcgggttattaccgtcgattcattgaaaacttctcgaggatcgcccgacccatgactcagttgcttaagaaagatgagaagtttaaatggacagctgagtgtgacaagagttttgaggagttcaagaagaaattagtatccgccccagttctgattctgcccgaccagatgaaagacttccaagtctattgcgacgcatcccgccacgggcttggatgtgttctaatgtaagagggcagagtggtcgcatatgcctcgcggcagttgcgtccacatgaagggaattatccaactcatgacctggaattggcagcagtggttcatgctttgaagatctggaggcactatttgattggcaaccgctgcgaagtatatacggaccacaagagtctgaaatacatcttcacccaaccggacctaaatctccgacaacgaagatggttggaactaatcaaagactatgacatgagcattcactaccacccgggtaaagtcaatgtggtggcaaatgcgcgaagcaggaaaagctactgcaatgccctatgcatcgagggcatgtgtggagaattgcagcaggagcttgagcgtctcaacttgcgacttgttgaacacgggtacgtggctgccctagaggcacgacctacgctcgtggatcaagtcagagtagcccaagtgaatgatcctgagatagctgaactgaaaaagaatatgagggtcggaaaagcctgggacttccacgaagatgaacacggcacaatttggatgggagaaagattgtgtgtacctgacgacaagtaactgaaggatctgatactcaccaaggctcatcagactcagtactccatccatccaggcagcaccaaaatgtatcaagacctcaaagaaaagttttggtgagtcagcatgagaagggaaatagccgaattcgtcgcgctctgcgatgtttgccaacgagtgaaggaagagcaccaaaggccagcaggtttactccaacctcttcaaatcccggaatggaaatgggaggagattggaatggactttataacaggactgccccggacatcatcgggtcacgattcaatctaggtagtcgtggatcgactcactaaggttgctcacttcataccagtacataccacgtatacgggcaaaaggttggcagagctctacctctcgagaatcatgtgtctacatggagtacccaaaaagatagtatctgatcgagggagccaattcacttcaaagttctggcagaaattgcaagaggaattgggaacccggctgaatttctgcacagcctaccatccgcagacagatggtcagaccgaaagggtcaaccaaatcttggaagatatgctacgagcatgtgcactcgactttggtggagcatgggataaaagtctgccttatgccgaattcttgtacaacaacagctatcaggccagtctacaaatggcgccgttcgaagcgttgtatggccggaagtgccgcacacctctcttctgggatcaaacaggcgaacgtcaactgttcggaacggaagtgttaacagaagcagaggagaaagtcaggattgtcagagagaggctgaggattgcccagtctcgacagaaaagctacgtggacaaccgccgacgagagctcacgttttaagcaggggactatgtgtaccttcgtgttactccgctccggggagtgcaccgttttcagacgaaaggcaagttggcaccacgcttcgtgggaccatacaaaatcttggaacgaagaggagaagttgcgtttcagctataacttccatccaatatgatcggtatccatgacgtgttccaagtatcccaattaaagaagtgcttgagggtacccgaagaacaagccaattcggagcacatcgatatccaacaagatctgatatatgtggagaagacagttcgtatccttgagaccagcgaaaggaggactagaaacaaggtcaccaggttttgccggattcagtggagtcaccatttagaggaggaagcaacctggataagggaagatgagttgaacgccgcccatccgcacctcttcgccagcccctccgaatctcggggccgagattccgtttaagggggagtaggtttgtcacaccccgaagttctttcccaagcctaaattggagttttaaatggtctcaagaaaataccagtgtaaagcaatagtaaaccttaataaattaatgcaaataataatcagaattggcatgtggaatttttcttgagttctacatgtcgaaatacgctaacaagatttttagttgaattttcagagccctcgaaataattttaactaattaaaattgagcacatgcaattttaaatcccagggaaaatcttttcctccttttctttttcttttccctccttttcctcttcttgggccgtcggcccagtccatccgccgccgccgcgcgcgccctcctccttgtgggccggcccaagccgccttccctctctccccgggacgccgacaggtgggccccacctgtcggggtcgtccccttcctccggccacccgtccccacgtcgccaccaccgccaaaaccgccgccgcgcccacgtcccgcctcctccgggccacgtcggccacgtccgtgtatgcgccgcatctcccacacccactcccccctctctcccgctcgtgcccgcgcccgagatggccgggattcgaattccgaatcccgcctctctctccacctccacctcccccacgtcggccggcgaatcatgcccctactggccatgtccgagttccccctcccctatataagctccaccgccatcccctctctctttttccccatctcgccgaactctctcgtggtccccatcgctcccgcaccgtgcatccacccgctgccgcctttcccgccactccggccgcctctagccgccgctaggctcgccgccacaccgcgccgtcgcctccgttggttcgagtggccgagatccaccccgtccacccctccttcgtcgaggttcgccgccggagcgccattcccgccgtgcgacggtgagagccgccatgtccgtcgccttcggccggcgttcccgccttctatggcccctctctccctctctaatcttgtccttttcgttctttaggtcgtctcggaccccgtccaccgcttgtcgacctccctccatcgcctctcgtcgccggtcgtcgccgccccctccggtgaggactccctcccctttcctttccttccccgtttccccgtgcgccgccgccacccgcacttgccgtcgccttcggtcgtcgccgccgccggggagccgtccgccgccgccgcccttgccatggccggccggccggctttgtgccgagtcgagccgagccaggcagccaccgcaccgtccgatcggccctgggccgatccggaccgtcgatcctgtggaccggtggtggaccacccgcgtggtcccggtccacggtagaccggccaccccttgcgccactgacatgcgggtcccgcctgtcggcgctgacccccccccttgatgacgtcagccctaggacttattgcgcaataaatgatttaaggactttttgttatagtaataaacacagtgaatcttctaaaaatcataactaattcatccgtgctccgtttaagcccaatcatgtcttagtaaatcaagaaaaaattgtagaatccattaaaaatggttttgttctctgtttcagtagtcttatagcctgtttgcattgtttgccttgtatgtcgcttagattctggttcttccgacgctccggtgtacttcgagatagtcgccgaggttcctccagcagcagagcaaggtaagtcatgcttgtcacttgaacatgttgatcctatattgcaaatgctctattgtttttcttcaaatactgcattgttttataatgttactatgggatgttcacctattgttacaaccatgctattttggtaccatgctccttgttagcttgggttataacatgaatagactttggactaggaattgcttagccatgtttagttcaactagcacacaatgagggagatcctattactgtttagactgtaggttctaatggtaatgttggattagtaccaccgctttggtgttgattaattaaaatgaatcacatggtgggctgtgggtgcatggttttgctagtcgcacccatggcaattaaggaccggttcatgggatgccctggaagaacttatcgtacttaccacaagccagcgtgggcaacagctgggcttgtagtgtagctttcctctagctgacgcatccaggcaagggtgggcgtgatggagcgggacgggccctgcgacggcctctgtcacttccggattcacctaggcacgagaggggactgcccgctgccttgcgaggagtgggggtgaaacctgaggtgtggtgtgcttggttagagggggttatgcgaagggtcctgtcacggcctctttccgatatgtcgtggtggcatgtcggcacacggaaacgtgtcgtggggctgtgtcttgtgggtacagttgtacacctctgatcagagtaaaactattcgaatagccgtgcaggcggttatgggcggtcaaccagattcaccgtgattagtttcaccctagtgtagtctaatgaaattggatagtttaggtggatggttgggcctgttgcaacgtgggatagcgttggacagtggatgattaatattgattaattattacaactgtttacttctttaaacttctgtttataaatgcctgctttatgcaaatgaaccattatagctaccccttgataattccctgcatcatacccctattccggtatgacttgctgagtacagtgggtagtactcagtcttgctctatttaccccaaccctagagtatgagtatgtgtcagatggtggtttctccgaggagtaggcttcgtccgtgccgtcgaggatgcctgtggagtggtgttcccgctgcagatcaagtcaaggctttgctccagttatatctcgtttttccgctgcatttatgtaagactttgataatgtttgtaagacgtggatctgaatgtcaacattgtcgtttgtgtaccccggccggtcctggacggggattttaatgcacattctgcttggaattctattcgggaatttctgggcgtgacattgatcaagttagagaagctcaaatcaatgatcctgatattcatgagatcaagaagaatatgagacgaggaaaagctatcggtttcttggaagatgagcaaggaactgtatggttgggtgagaggatctgtgtcccagacaacaaagatttgaaagatgcaattttgaaggaagctcatgatactttatactccattcaccctggtagtactaagatataccaagacctcaaggaatgattttggtgggcaagtatgaagcgtgagatagcagaatatgtagcagtatgtgatgtttgtcagcgagtcaaggcagaacatcagaaacccgcaggttttttgcagcctttgaagataccagaatggaagtgggaggaaatcggtatggatttcatcactggtctacccagaatgtcatcgggccatgactctatttgggtgatagtcgatagacttaccaaagtggctcatttcatcctggtgaggaccacctattccggaagtcggttggcagaattgtatatggcaaggattgtgtgtttgcatggtgttcctaagaagatagtatccgatcgaggtagccagtttacttcaaagttttggaagaagcttcaggaagagatgggttccaagctgaactttagtactgcttatctccgcagacagacggacaaactgaaagggtaaatcagattttagaagacatgttgagagcttgtgctttagacttcggtggaagttgggataagaatttgccttacgcggaattctcgtacaacaacagttatcaagctagtcttcaaatggctccttatgaagcattgtatggtcggaagtgccgcactccgcttttgtgggatcaaacgggagaacgtcaggttttcgggactgatatcctaagggaagcagaagagaaggtaaagatcattcaagaaagattgcgtgtggctcagtctcgtcataagagttatgccgacaatcgccgcagagatttaagttttgaagaaggagatcatgtgtaccttcgtgtcacgcctctccgaggggttcatcgttttcacaccaaaggaaaattggcaccgcgttttgtgggaccttataagattgtcagtagaagaggagaggtcgcttatcagttggagttacctcaatctttggcaggagtccataatgtgttccatgtgtcgcagttgaaaaagtgtttaagggtacctaccgaagaagctaatcttgaacagataggagtccaagaggatctgacatatgttgagaaaccaatccgtatcttggaaacagatgagagaagaaccaggaatagagttatccgtttttgcaaggttcaatggagtaatcacttagaggaagaatctacttgggaacgagaagatgaattaaagtcagctatccgcatttgttcgccagttcttccgaatctcgaggacgagattccgttttagggggataggtttgtcacaccctaaaaatcccaaatatataaattgttgtttaattagaattattagaattgattttaaaagcctagaagagaagatctaattttaaataataaattccaatataaaagtgggctagataaaattttattaaatactttgcttgattctatagttcctagatttttctgagatttatttgagccaaggaagtatttttaataaatggaattgcatttcatgaataatttaaattgaaaaaggttttaaaaagttctcttttggctttgggccgaaagtcggcccaaacctctctctctctctccccggcccaagccggcccgcagtcgagcgccgctcgcgcgtgctcgcgcgtcctcccgctgagagggccgtcgtcaacctccagccgtcgcccggctgaaccctagccgagccgcgccgccgccgcccttccaaattcgttcatccctttctcgatccggtgaaattgatagagggaaaatgatccccgagatccactctaccttttctcttttgaaatcgtcggctaaaatcgtttggaaatctgtggattcgatctcgaatcggattcgtctctctccccgaaccctagactttccttcacaccgccggtcgtcgtgggcctccgccgccacccctagccgctataaaaggaccccggtgtctcctctacccgccgccaccctcgctttcgtctctcgccgccggtagagctctagcgccgtgtagcctagcgccgccgtcgccgccgttcgtccagccgtgcgccgccgtcgctccggtcgtcgtcatcgctcgggaaagccgccgtcgtgatcatcaagtcgtcgccgacctcgtccgccccttcgtcgtcgctgtagatcgccggagccccgccgtcgtcgtcaagccgaaggtcgccgccgcttcttcctcatcgtcgtcgccatccgatgaccttctgccgttgttttggtcaccggtgagttcgccgcgtcgccagcaacccgtaggtgtccttcatttgcgtcgccacgccgtcgttcaccggcgagcacgcgaggccgagccgccgttggtgatgacgtcatcgctgacgtcatcgacgccgtccgtcgtagaccggtcgtagaccgttagatcttggccgcccgttttggatagattgatcacggccgttcgtttccgtgatccgccgccatgcacccggtccaccgtgagccgacccgctgacgcaataatcccctttttccttttcaaaaataattcattattgtgtcataattcaattaaaatctatataaatgttttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgattttgttcttttctctttagattccgacgttcccggagagtccgaatttgcaggagaagactttgaagagttccaaggccagcaaggcaagtcacacagatcccaaacaatcctttgagcatgttgatctcgtttaaagctattgtttctattcaacaattgcatttatttttgaatgtcattgggtggaaataacctattgctttgttatttcttgattaccctattctttgataccttgggttattataacttgactagttgagctttatatatatgggttcagctggatattagataacttatgcttagaaacattagcacactactgggataacttatgcttcactattatttaatgatggcttaatggtagctcatgatggttaatcatgattggttaattaattaatttgccaactaaaaattgataatggtgggttgtgagcatatgattttgatggttgtgctcatgacaattaaggaccggttcacgattttcggttgtgaaacatttaccgtgccaaccacaagccggcgtgggcaacggctttactttatgtatagcatggttcatagtagagcaccagactgtgaagtggcagagataagcccacgggggtcgctggggagtccataccttgtttataagggggtgattatgatccgggaacggtgcactgctttgaattgtattatatagagggtattgtcacaatctctatttgggtacttgtcaagtatcgcgacacatggttgacatgatgttgaggttgtgtcttgtgggtacagtggtacacctctggccggagtttaaactattcgaatagccgtgcccgcggttatgggcgtgtctaacaatgtctttcgtaattagtctcacatttctcaccatattaatttatgatgttaataacttgtttagctcctggtttagaatggttaattcctggtttggagatagaactgtgcagccgggattggttgttcagaatggttgggcctatgcaacagggtatgttgtatagcgttggattaatattgtttaattattatttaactgttttattaaattctgaaatatttgttaaatgctatttatgcaaatgagactatactatgccatcctttgttatcctgtgcacttgtatatttgctgcgtggcttgctaagtatgtcatatacttaccttgcaatcattcatcagaggaggagttctatagtgatgctgatggtgttgaggattaggcctagtcctggtcaagctacctgtggagaggagtcgcctgcgctgtttcttttattttccgctgcttagaactttattgattgagaggaactatctacctctgtaatgatattttattcgcttattaattagagtaataattgtactttattatcaatttgttattgtgtgcctcggctgattcatggacgagggtttacacacatgtaagcgtttggaattttggatagaaattccgggcgtgacagaaaagaaggacaatatctagacaatcaagccgttggacgtttcatagggtggtggataccctatataatctaggtcaacgttaatatttaacctaatcggctgccttccagtaatatatgttagctaattaaggattaaataacaatattgccagagattatataggatatatgataactcgacgatttacataaataggattagagtgtcataaagatggaagcactaatcccgagaacgcaagccgtcatgacaagtttacctctagttgaagatcgaaacgatgcaactcaacccgaaagcaagaattcgtcgagatgaaacgaaagtaaaaagggtggcgatgcgtcgagattgtattgaatgtgtgttgtttgattacataggttcgagtcatatttatacccgagatacaaaacatgtccttgtcggacacgactcttatctttaacaaactctaagacaccataagtctttacggcagacttttgcccaaacttatctctaaggaagttacataaaatattctaattaatagatacaattgccttttcaggactcaatccgtgcatggcaatccatatgaagcacattaactcaacccgacaacgtgtaccgagtcacattgtcggaatcggctcaatcggctaccttgtccgactcgaactctgtcgattctggtcgtagccgattcggacttcggccgattcttgctctgtttccggaacgatctatctcttagattccgctttgattttatcttcacctt

SEQ ID NO: 51484 - DNA, 1067 bp, Oryza sativa
taatgggcaaaaaccaacgctcttcgtggaagaatatccagctttcagcggatgagggatgaaaccaatcctgaagcttgggaaaggctgcagtagtacgtcaccactcgtcctcatcggatggacgagtggctcatcctgcaaaatttcttcaatggattaatcctctagtcctgggatcacatggacgctgctgctggaaagacattcttctcaaatatggttagaggtgccactaacctgattgagaagatgatctcaaacataggttggagcaaggaacgactcttaacccatcaacgcggcatgcacaccatcatggagacggaaatgctcgctgctaagttggatctccttaaaaagagactagacaacagtgagaaatacgccaagcagggtactgttaaggccctgggctctcacatgacatgtaaggtctgtggaaatgacggtcactctgggacagatcgtccggaaacccataaggatgtcatgttcatgaataacaacaacggtatcgtccacaaagagatgaaggatggtacattgctccatagggaatattacgtacgaaccaaaaccaacagaacatgaggaaggtcaaagtaaaaccctgacggatagcctcatcgatttcatggtgaacttcctggagcgggaagaaacgaggatccgtcgatacctcaagttggcattcaagaacccgggaatacaggccggtcaacctgcgttcccagtttcgaagaggtcaccgaccgcaccaaaaacaaagaaggtgtggcgagttaaggagaaggcacccgtccctgtatctctggaaccgggtacctcatcaagctaaaacgatggaggtacgatcatgctcgtcggacctaaaacgatgtcgcccttgccaacaggtaaatttgtagttatcccatatttattttccgcattgcattagcgcatatttacctttttagtttttccattcaaagttttgcattttaatatgaatttggagacaacaaatttaaaataaatttatgagcaaaaataaaataaaattttcagccgcatggctaggg

SEQ ID NO: 51485 - DNA, 1917 bp, Oryza sativa
atcaacatcaagatctaacctaatcggctgccttctgcatacagatattgaccgatagtagtttagatggcgatatcgttagagattatataaggtatatgataacttgatgaattacataaacaggactagagtgtcatgaggatggaagcactaatcctaagaacgcaatccatcacgacgaatgttacctcttgttgtagatcgaaatcgatgcagctcaacctgaaagcaagaactcgtcgaaataaaactaaagcaaaaggatggcgatgtgcagagattgtattgaacatgtgtattaaaaattacatagggctcggggtctatttatacccgaggattacaagatatgcccataccggacacgactattatctctaacaaactctaagataccataagtctttacggcagacttttgtctataaggaatttacataaaatatcctaattaatagatacaattgccttcccaggactctatccatgcgtggcaatcatcttgaagtacattaacttgaacccgatgtcgcgtacaagtcgtattgtcggaatcggctacatcgacttacccaacacgactcagacccagccgatcttatcgtagccgatctggatttcagccgattcctgctctgctttcaaacccgatttcctcttccgactttgcttcaatctactcttctctcccgacgctgatgttaccaaattcggttgttaacaggaacgcacacgtggaaggccaggatcaaaggcgccggtggtggttcggccaaaccttgggccccacctcctggccttccctttggccaggagactgactggtgggccctgatggcggttatgacagttatgacgcattccatggcggtttcacctgacttatgggcccttcaatccgtgtacttgcgtctaattggccagaggtgtgtttccttgcatgactggtgtgttttctcattaaaatacccgcatacacatatttcaccaacactagtggaattgggtagtaataatccctaccactaagttgaataccatattttatttcattattttatttcattatatgcaggtattgacggtcaaatattatgatttaaagaccatcaacatttggcctaatttgtggtcccatcaatccgtgtgctcacacgtgattcgctggtggtgtgtttctttgcatgccagcttcatttctcattcactttggtgtataatctccgcattcatgttaattctcttagtctagtacaactacattatttattattgatatacgtataagaaatgttaattttccctttattcattgtatacgtatgtcacgcccagaagttcttctccttagcaaaaattcaattaataaattgttgcaagaaattatttgtttaaaggcaagagagaaaccctaaattaataaatgcatttaataatcggaatcggcatgtgaaatttttcttagattctacatgctctactacattaacaggatttttagtggaattttcagagccttggaaataattttaaccaattaaaataagcaaagtgcaatattaaatccctgggaaaatcctttttcccttttctcttttctttttcctcctttttccttttcttgggccgtcggcccattccttcccgcgccggcccgcttctcccctccccgaagtcctccctccctccctctctccttcgggcgccgacaggtggggcccacctgtcggtcgtcttcctcctctagccgttggagccgtagctccaaccgccggcgccccacctcctccactccgcatctgcgccccaccccacacccacgtcgccggctcgccgcccgcttccccctcctctcccgcacgcgcgagccccgcaagggcgggattcggtttcaatcccccccccccaaactct

SEQ ID NO: 51486 - DNA, 12671 bp, Oryza sativa
tcctttttcctttttccatcagccgctcccgagctctccatcgctcccgcaccgctacaccagccgccgccgccttttccactcctccggccaccgctcgccactgctagcaccgccgtcgggttcgcacggctgaggtccacctcgtccgccgctcccccgtccaattccgtcaccggagcccgcatctcctcgcactccggcgagcttccaccattgccgccgccttcggccctagttttcgctcgccgcggacctcccttctccctctaatctctcttattttgacaactaggtggttccggacctcgttcggcacttgccgccatctcccggtcgttcgccatcgccgttcgtcgtcccttcttcccgcgccggccaaccccatggtgagaactccctgtcctccctctttctctccctcccgtgtccactgccatccaccgcgtgcgcgccattgccttcggccgacgccgacgccttccgcgccgttcgccgccgccggttgccatcgccggcgaccgtgcaccgccgccgctcgctgtagccggccggccggcttggagccgagccgagcccggcagacgtcgcccctccccctttttggagccgcggccggtggggcccgcctgctagtaccccctccctctcccttgtgcctccgacccttgggtcccgcctgtcggcgccgccccaccccttggatgatgtcagccctaggatgctttattgcacaataaatcaataaggcttttctttaatagtaaaaacacaaataatcttctaaaaatcatatctaattcatccgagctccgtttaaatccattcaagtcttagtaaattcataaaaatgcatagaatccattaaaaatggttttgtttcctgtttcagtagacttatagcatgttttgcttgtgtgctttgtttgttgcgtagatttcggtcgttccgtcgatccgcggtttctcgaagacgttgctgtggtctcatcagtgcgagagcaaggcaagtcatgcattagattgatcatattgtacccaatttacaagtgtcccgcatttctattaaatgttgcattgttttacaatatcatgtgggatgggtcctaccactcagccatatcttgtttaccttatgccattgatgataacttgggtatttgttgatagaaaacacgtggcctgggagatctgcttaactccagtgcaggtccaaagctcgccttcggatgtgttagcgtgccagttgatttgatcctgtaatcaacaagaaatagaagcaaagaaaccgcggttaaatctataaatgatagccgatcggctagatgccgatgacatatcatttatctttgagccgatgtcatctgtgtttcgatcggcagtcatgaataagtaaataaacactaaatctactcgatcggctatagatattaacgatatatactccttatatcgatgtatacttaaatcaagtgattgggatagatcggtcatcatgccgagacagtataaatcacttagatcgaaatatatatcaataacaggactatatatatttatagcatagccgatcagatagatgtagcatgtatcgactaatactccgatactactctatatcaggatattaaagcaaatataatatatcaaacaaaggcctaatatacttagatacagcaacatcttgatataaagggcagatttaacatgtcaatgaagcatatagaaaaaatatagttaaaccagatacgatcggctgaaactccgatgctattctaatcgataactagaaggcaggctagagattgatattctaagcacgacttaatagatcaaactcagctgatgcagcattaagtatgaaaagaagaacaatatctagacaatcaagccgctagaagtctcatagagtggtatatatcttatataatctagatcgacgtcaaaatctaacctaatcggctgccctctgctaacagatgttagccgatagtaggttagatggcggtattgctagagattatataagatatgtgataactcgacgaattacataaacaagattagagtatcataaagatggaagcactaatcctatgaatacaagccgtcataacgaattttacctcttgttgaagatcgaaatctatgcagctcaacctgaaagcaagaactcgtcgaaacaaaactaaagtaaaaagggtggcgatgcgccaaaattgtattgaacgtgtgtgttatcatttacatagggctcagggtctatttatacccgagaattacaagattgcccataccggacacgaccattatctctaacaaactctaagataccataagtctttgcggcagacttttgcccacatttatctataaggaatctacataaaatatcctaattaatagatacaattgccttcctaggactctatccgtgcgtggcaatcatcttgaagtacattaacttgaacccgatgtcgcgtacaaatcgtattgtcggaatcggcgttatcggcttacttagcctgactcagacctagccaatcctaatcgtagccgatctggactccagccgattcctgctctgtttccgaactcgatctccgcatccgatttcgctttgatccaatcttctttcctgacacagatgttaccaaatttggttgttaacagtattaaaatgattagatgttggtttagggaacgcttagccatgcttagttcaactagtacatagaggggggaattacagtaatgcatagactctgattattggtatagctttggaatagagccaccgcaatggtgttagttaattaaaatacactacatggtgggctgtggatgcatggttttgctagtcgtgcccatagcgattaaggaccggttcgcgggatgccctggaagaacttatcgtgcttaccacaagccagcatgggcaacggctaggcttgtagtgttgctttcctttagccgacgtacccaggcgagggtgggcgtgatggagttgggtcggtcggggtgtccggttgatcggcttccggattcaccgcggcacgaaaggggggctgcccgttgcctgctggggacgggggcgaaccctaaggtgtgatgcgatcggttagagggggttatgcgaaggatcctgtcatggcctctttccggtatgtcgtggtggcatgtcggcgcacggaaacgtgtcgtgggactgtgtcttgtgggtacagttgtacacctctgatcagagtaaaactattcgaatagccgtgcacgcggttatgggcggtcgaccagattcaccgtgattagtctcacccctagttagctaatgaactggtgtagttcaggtggttggttgggcctgttgcaacatggtgtagtgttggacagtgactggttaatactgattaattactacaactgttttattgctttcaactcctgcttttaaatgctagctttatgcgaaagaacctttagcctcccttggatatatcctgcatcatacctcctcttccggtatgacttgctgagtacagtgggtagtactcagtcctgctctcttttccctacccccagagttgaagttcttctcagttggagatgtctcgaagaagttggtttcgtcgctgccgtcaaggatgcctgtggaacggagtcgcccgctgcagcagtcaagtcttcaggcttagctcgcttttatcttttccgctgcatttgtaatcttttatatttttgtaagacgtggatctgtatgtcaacaattgtcatttgtataccctggctagtcctggataggggtttattacacattaagcttagaaattctggttcgtgaatttctgggcgtgacaacatataagagtgaccgatagcatggtagatcattttttcactcttgaaatggatgaccttgttaaaagacttccgattgacaaagctccaggcccagatggctttaatggttgttttattaaaaaattgttggccaattatagcccaaggttaatctagaatgtgttaatgattttaggcctatttctcactcttttaatctagacttgttaacatgaaaaaatgaccgaccggaacttcttttccctttattcattgatatacgtattaaattattgctttttaaaattctccactctcatgttatctaatcctattggatgcatgtattatatttattaggatgatccaaactacgagatgataataattatttcttggtctttgggttaagcgtggttgtgcattatattttggaatagagggagtagctcacacatgttgattgcaaaacaaaaattgtttttgtttttttcttattgtgttgtaggaatgttttgcacacacctgattagggcgttcgtacacatccaactggagaagatccctgttgtctattcctaaagaggtataccatgaaagcaaacagtgacaagtgtgatcgtgagactgcaggaccggatggggtgcatgaaaattacataacaaacatgatgatgattgaagcatttggagtgatgagggcagcatgcaagtcgaaggtcgcatatgaaagagctatggttattttgaaagagttgcgtaggcaggttgaggaggtaccacaagatattcaagttgttgtttgtgttctgtctctcaaccgctcaagacaaggaaggacagtgtctcgtgggaatcaggggtaagggtaagccaccgtgccaaatttatttgatttgagagagagtacacatatcttcttgcacctatacttttgagatatacagcatagtagcaactcctgatcagctaccaagtttttttttgtgagtcctttactcgggacgagcaaaggttcaagcttggggggttttgttgacggtcgttagcgatcaatttcgcccgtcaatattattaaaataaaggagaactagttatgcttgcaatgcatatttcatgtcaaactaaaatatattccactagcactaggtttctaactttttgcagagaatgatcataaatgaaggagaagtgacagcaaaacatacgatcaatcattcagacgctgtcaagaaacaaacttatggataaatgggctgagaacaccaaattcacaagatccaacaagcccaaaattcacaagtctgcggagaggagcaaacggggaggccacctgccaagaactgagccagcccagggttcggccgaaccagccgtagcaccgatggatgtagggtttggctggacggctgggattgatccccaatgatggttggagggcattaccgacctttccaaccgtcattaccagcctatataaacccctcactccctccatttcttcacacacctcaagcaagaagaatcaagctgtctctctagtttagtagtcttctcaagctagtggagtaggaatagaataggagtcttagtccgagaagtcttcataggaatcgggtatggatccggtagctttactttcttttgtaagacttatacttttattaaaatattcttctttatactactctggtattgtactactttccgaatatatgagtaccaattgtatcatacattcaaactatattgattatgatgctagcttatctgggaaatgcaatggtgtgggtataatgatcgtgcatacgattgctctgtgtcatgacaatgatattagagtagtatttggtaatttaagcgtggtgtttagattactagatatcgttatttggggttaaatgctacgaatacatcaaggtgggccgctgatggtgacagctcagtacgggtattcctccgcttgtgtatatactcctaagttactttcctggggaggctactcctccgtatttagcccaggttagatggtcatgacggattgttgtaagaaactcggcaatcaggggtggcttctcgaagcaccaggacggtattggaaagagggtattagctaagtaatcatataacttggatgtatatgtataatatgtatctatattagaagtataagaatagattctttctattctcttcccacttagcttagataatttattatgagagtatataattctcttgctgtgtgtcattctaccctatttataatcttaacccctgcttatactttgattattacaagtaatatataaattattagtatagttctctctgttataatcttcccgcaggattaaataaatacgatacccttggaatactgtcacgcccagaaatttagtccaaatttctagactattttgtgtattaaatcactgtccaggaccagccagggtacacaaaacgacaagtaatatacagttccaaacgtaaataaagcgtaaaatacttacaaaagaggcacttagtcctcgcaccgaaacgaaagcagcagcagcggaaaagggcgatcctagcggggcttcatctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaggggatacaaggaggggtttgtggctatttgcataaaggcggttgtaaaacattttattgagcaaaacagtaaaactgttgagtaattaaagtaacattaaatctccactgatcaacgctacaccacgttgaacaggcccaaccaacccacctggactacagtgtattgggtcgatttattaagatgggactaatcacggtgaatctggtcgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggacccttcgcataaccccctctaaccaagcacaccacacctcaggtttcacccccgtccccagcgggcaacgggcagtcctctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgactagcaaaaccatgcacccacagcccactattcagttgcattttagttggataattacgaccatgaagcatggacgggtgtctcgagcacgcagctcactctgatactaaagggtctaatactgcaattatcccatcaactgagctagtggtaattaagcatggctaagcatatagttctagctaggtcacataagtaacatgagctagtggattcattacccaaggttgacaaagaacagatatcaagtaaacatggcacaagcgagcagataggtaatacccggatcccatgtaattagtaaaacatgcatatttatttgtaaacggtaaaacatttataaattgggatcaacatgctcaaggggaatgtgtgacttgccttgctgcttcactttgatcttccgaactcttttcctcgcgaccgcggacttccgaaacgacggattctacacgctgacacgcaaaacgaggaaaaactctaataaaaactaagaaaacagtacataaaaagtaaacaaacatgtagagctcaattttagatgaattttgcaatttgaatggcccaatttggagttcgaatgaattagatatgaattttagaagttttgagccatttaaatgaatttctataattattaacgaattatgacgcaattattatttatttttccaaaggaaaagacggttgctgacgtcatcaaaggggaggggcggcgccggcaagcgggccccaccggtcagcggcacaagggcgccggtccaccgtggaccgggaccaccgaggcggtccaccgccggtccacgggaaccgacggcccggatcggcccaaaccgatcgggcggccaggggcggcgcggctggggcacagcacggcacaaagccggctggccaaacgacggcgcgcggcggcgcggccacccgcggcgacggccggcgacagcgcggggaggagaggagggatgctcaccaagggcggcgacggcgagactacaacgaggaagccggcggcgggctcctcggggaggcaacggtggtccggtggcgtaccacgggcgcgaggcggcggacggtgaccgggacgaccggggcgcggagagggcaatttcagtggttcccggaggcgaggaagcggtggccggggtgcggctcggagttgccgatccgagggaggaaacggcgcagtccggcgtcgaccggggaggcggggcgacacagatggagacgacaaacacggcggcgatctcgggttggtggtgaagttggtgctcgggcggcgagaggcgacaaccgagcggcggccgagcttgactttgaggcggcgaaggtactggcagtggtggcgcattggggcgacggctagggcggcggtggcgcgcggctggaggcggtgaaaggggcggcggcctcgggtgtgcggtgggagtggtgctcgaggggtggagagggggaaataagaggcggccggacttccccttgcggtggcgaagctggcggtggcggcggctcggcgcggtgacggctgtggcggcgggaaacggcgaccggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaactggcgccgattttcgcggggagagtgggggaaatggtggaggacgtggaggggatcgtgcccacgtcgttggatgcgagctcgggtgcgggagggcgccggattttgcggcgacgtggacggcaatggcggttggggtcggccggtgagaggtaggaggacgagctgacgggtgggaccgtcggtcccacctgtcggcgaagggagagaaggagggacgcaaaacagacttttgcgagcgggccaagtgagaggggagccggcccgagagagggagaaggcgcgcgggccgcgggagaggaaggaagacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttctagaaaatgtattattaattgatttttattgccgaacgaaaatcggggcgttacaaatctcccccccttgcaggaatctcgtcccgagattctgggatggctagaaagaaagccagtgctggtgggcgatctgactgatctgcacattgaactgccacattctgcttcgaactgattgattgactggttgatcaaacctgcatgattgaactggctggattcgacctttctgttcctttgctttgccaaaactggactgattggttctgcttgaactgacccaggccagaactgcggatgctcctggaacttacttatcttggactgaaccgttgatgctagcaatttgataacctgacagttcaccaagttggctagagaaggatggagttgttcctgaatcttgcatctggcatttgtaactcattgatcctacatccgcttgaacgggttctgactcgagtgacacgtaattccaggaaacctgcttgacctgtctttcgtctgaactgcaactgtcctcactgttgctcctctaagctaagctgttgaactgggctcatcggatgccctgggatcggcttagttcttctgataccttgcaacatgcttcttcaagtgctaccctgattgcggcactggttgaaccttcaactaaaacagcgacgaagtgaggcaaaactcttctccgagacctaccccccttacaaggagtagtcttactttcgcgtggctgagatcggttgaactgttgtccttcgaatataaccaacacttctctgttttgcgaagagccctgactttgaaaactaaaaacttcgccgatcgatcaaaatagagtaacaacgatgcactttcatcccattaagatttggaacttaaccctcagttgctgataggaaattccacataaagaaattctcatttagctcctgatcttactaactcttaactgactatcccatcagtaataactgctggcatgactgtccttcttctgacctgacttcggtgtcatccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttgcctctgggattgggggtgacttagctgtgctggtctgctaaagacttggtggcgtactgtctgaggttgcaggtgcttgctcttggaaaacaaactgactttcgctctgatcctgattccggcttgcatctgagcttgtacttgttgttggagacattgtcgttgcatctgctgctttggactctgcggttgctacatcaatatctggcacatccatcttccaatcttggctaaccagagcgaggtgctctgacttagctggtagcttgttgtcttgaactgatccactgactctgactgcaacacactactgctggagttatttccgctacatttgactaggtgtcgaacctgcatctcccacatcgatacacccatcttctgatcttggacaccaaaagttgatcatgagcaggtttcatctggcattggggcaccttgcagctttcaactaaaccattgatctgtggctttaattgatcttatctctaacactgaccatctgctgccaggacggaagagaggtggaagagaggggtcgctaaagataaggtactaaaccacttgcctactgatatgttgttaatagatttttattgttcaagttgcttaagcaaacaacctagtatagtcgcatccccaccaatgatgcaaaccatacccctacacacaagcaaacaacacacgatctagaatctaacgaactactcttccgggaaggattaggtttaggtgaacttcgggaaaactcttcttgatcttcgcggaacgatgactctgaactaatcttcccgctccttgcacgaagcttgagactcgacttgacttctggacgggcatgaagctggcggtttctcctacatgtttgacaactaaaagagttggagggacagggaggaaaaattttaataaactgtttcgcaaagaaatgccgaagggcgagaggagacaatttgcgaatagggttttcagaaaacttgtccttagggtttgaccatttggctcaacctacagtcaagttgcctctgataccactttgtcacgcccagaaatttagtccaaatttccagactattttgtgtattaaatccttgtccaggaccagccagggtacacaaaacgacaagtaatatacagctccaaacgtaaataaagcataaaatacttatagaagaggcacttagtcctcacaccgaaacaaaagcagcagcagcggaaaagggcgatcctagcggggcttcagctccactccacaggcaaaactcaactggggtctgagccttggtcttctaacttcgtcttcagctcagaagcactacacttctgaaaagggggaaataatagcaagactgagtacaaccaccgtactcagcaagccacaccaacgatgcagacgtgcaaggggatacaaggacggcttgtggctatttgcataaaggcggttgtaaaacattttattgagcaaaataataaaactgttgagtaattaaagtaacattaaatctccactgatcaacgctacaccacgttgaacaggcccaaccaacccacctgaactacagtgcattgagtcgatttattaaggtgggactaatcacggtgaatctggtcgaccgcccataaccgcgggcacgactattcgaatagttttactctgatcagaggtgtacaactgtaccaacaagacacagccccaccacacgtttccgtgcgccgacatgacaccacgacataccggaaagaggtcgtgacaggacccttcgcataacaccctctaaccgatcgcaccacacctcagggttcgcccccgtccctagcaggcaacgggcagcccctatctcgtgccgcggtgaatccggaagccgatcaatcggacaccccggccgacccaactccatcacgcccaccctcgtctgggtacgtcggctagaggaaagctacac

SEQ ID NO: 51487 - DNA, 1710 bp, Oryza sativa
tcggtcccacctgtcggcgaagggagagaaggagggacgcaaaacagacttttgcgagcgggccaagtgagaggggagccggcccgagagagggagaaggcgcgcgggccgcgggagaggaaggaagacttgggccgaaaatggcccaaagagaggaagggggattttaattgttttctttttattttaattgatgcaatgatctttgtgctattaaaactatttctcgagctccgaaaattcatggaaaattccggagagtacattagggcacaaagaatattacaaaatattcccggccaataatttttaaaggaaatttttaattccctcaataattcacttgattaagttgatttaacttttatttaatttctagaaaatgtattattaattgatttttattcccgaacgaaaatcggggcgttacaaatactctcgggtgaaatgctacaatgttatatccgtgcgcttgcagataaagtctgtaaccataatatacgaagagtgtttctacgctattgctgggaattatatttctagtaatatcattaagaaataccaacaaccatgattctaatttcattggaattaatccttgaccaaacctttgatctagtcttatctctaattcttctctatcctgacatgttaccaatccttctgtagatattccaatagtcaaattcctttttcgatcgagcctccaatttaatccctatggcttcaacctccccggcacaagaatagtattattacaaattttggaatgattgctcttgtgctaagaaaatagattttaattcatcgttctcatccaaaatctaaattccctattagccacaaataattccccaaatattcatactaccaatttaaggattcaaatccttttttttttgcctctaagtattttccttccttattcccaaaaatatattttgtgagtaatcatattatttatttcccctcctatttgagtgctttaatatttagtccaatgtattctttctctcaaaatattgcactcaaataaactagataatatgtcttttggaaaatctttcttttgtgaatttcctccaaattcaaattctatccaaaccaaattttctaaagcccttctaaaattcagaaaacatttatttgggccgaagtcctctcccttctcccttccccacctcttttccctacggaataagttcatctaaggtcccttaacttgtcaacgaatccgattttcatccttcaatcggaaatccagataccacgggttccctcaacaatcaaaaccggtgcagatgaggtccctcagcggtttagatggcggttttggctggcgtggcgcctacgtggctaatttgactcggtcttcatctgacatggcattcacgtgccgcttacatggcaatttgatccagaaaaataataaaaactcatgggacctacatgtcagtttcacacataaaataataaaaaatggtaggacccacatgtcattctcacccctcctttcttcctcctctctccccatctccttctcttcatctctatcccctttcctctctcttctttctccaacgctaccaccactgactccgccgctgctcccgccaccgccacatccctcgttgccgtcgtggggtttggtcccagcttcttggtgaaaaaggataacatgtgaagaccacgtgggtcccacctttttat

SEQ ID NO: 51488 - DNA, 9893 bp, Oryza sativa
gttttagggttcctgctggtatcggctaaattgccttactagattagattaattaaggcatctaccatcttgaaaagctgttaattccttgattgcttagactttaggtttctctacttactttgagatgcatcatccctagtcttgtttagaaccctgaaaactaacctggaattaatcataattagagaaagtatcggagttttagccgatcttacctaatatacatgcttcttttctggttttatgtatatttgccacttatatagacagatcatcctatataatcgtatcaagtttgatcagtatcgtctcggctatttgaatttctaactgatcatgatttgatatgctcatatagattgatttgtttatataagtttgtactagagtattagctactactttatcgttatctacatattcagctctaaatatttttccattggctattttcataatattgtcttaaatcttctttcttaaacctaataggcagtgttacagccgatgaggcatgtttagggtcttttattccctgatctatcccgtccatagccgatttggtctaactacatcggctgagaccaccaatgatacgctatcggccatcgactgactaattatgcttttgtctttcttgttgattgcatgatcaaatcagctggcacgcctttgacacactcgaggctatccttggacctgcactggagttaagtagatctcccagtgtaacgccccgattttcgttcgggattaaaaatcatttaatatattcatagcatagccgatcagatagatctagcatgtatcggttaatactccgatactactttatataaagatgttaaagcaagtagaatataccaaacagaagcccaatatacttaaatgcaacaaaatcttaatgtaaagggcagatttaacatatcgatcaatgtgggacacccaatttaggcttggtgccccgaaaatccactcgtgatcgtctaggatttcgatcacgtacaaattgatatacagaacagctttcgattaattatacaaatttggttatacaagctaattatacaattgttaaaaggtgaaaagatccaaactaatatatccttatttgaaatacaagaaaatccatagtactaaactactaaactcctaagctcttcaactactaaaactacagccaataaactgcaaagaattcaaagaactccataggcaaaagctcgagtgtagactagtctagacaaacttgtcgatgccgtagatctcgcttccttctaatctccttgttagcatgttttctctatatgtcaaattatgcaagggtgagtacttatgtactcagcaagacatattataaataattaaatgtgaagagatatgaataaataaaacaataataaagtaaaggaataataaaaaccataaatcatctttatcctcaacattttaattttaaaaatacttatacttcaggagtaggaatcaccctgatgacacaactccagaaccgggagtacggcacattcgaatgatttaattcacctctgcagagactgtccagttttaaccgcacgatgcccacagctagctaggctgagaacaacagagccgtttgaaggtcccacttactactagtaagtctaggtctgtccccattctagaagctgcggtcgtactcgttcgtttgacataagtacttggtaaacttatatcgaccaagacagtactagccacccggaaatcaaccaattcctgcgtactgtcccaatctaagttcattgtatttttatgcagtctaactaggcagggctaagcaaaagctagcatataactggtttgctatatgttcagattatgcattcaaaatcatgaatggctaatgcatagaatagaatgtagaatataggataattatgctcaaaggggaggaataataacttgccttgctccaacgcaaataaatacgagataggcaacctgattatccgattctcgaaataccataggttgccatccaaaagacaataaactctactgagaaagaggaagaaccaaatttaataaaagccataaaataataagaaaacgataaacggctaaaagggctagggtttaaggtataacctatctcttttatagggtatagggattatggggctagtatttgctagcggtaggtttaggtagtataatagctagggttcagttatatgggagttgattgtggagtaggatagtatattggttaggctctatattttatgtggaggctctcgtggtttggacgataggaaatatactagatagttgatatggttaaataggcatgtggctaatatgggtccaggttggctttgatagaatagtggttaggatttagttgtttaggccgatatcgaggtaggataaatatcggctagggttttaggtgtttgctagtcgtcgctagagttggacatcatgacgactaggtttagtatcatttctagccgtgtcgatagacaacatatcggctagaagaataggaggtgggtgcaggtttagtggggcggaagtgttactccgacaaccgtgagtggcggcggagcggcttggatcacacagagcccgagagctaactgtgcggcgtgcaatggaggtcgaggggatagtgaagctccgaccgctatacgcatcaaggcgtggggtgccaggagcagcacttcaaccttgggtttggtttatgccgagctttacaaccaacggtccgacgttgaggttcgtagaccgcgcaaacgtccccatggaaggcgtaaagttctaaccggcggctttttagtggctacagggtattttggaaataaaagaaaatatttggaaagcaaatataagtttaagttgtaaattcaattaaaagattaaatcaaattttattcaaatggcatttgaataaattaaagaaattcaaataaaatcttaaaatagcaaatttgatatcaaaatgaatagtttgaatttatatgaatttaggtccaaatttcactggaatcggatctacggtttaggagatataggcttctaaaaattgggatttgaattaaatctaaaaaatacaaaaagttactgttgatgggcccacctgtcaatctccttttctttttctctctccttctctcgtcgtcgtcttcttctcttctctgttccagagagagagagccgagagaagagagaggagaaggcgagcggggcggcggctctccggtggctggagggcggcgacgtcggcgtccacgcgtgttcccgagcaagacatacccggggagggcggtggctggcggagagagtgaaggagttggccggaacggcgcagtcaagagcttgtcttcggcggcaaagagaggtggcggtggtggttgctatggggtgggggagaaggggaaaacgggaaaaatggaatcaactcgtcgaggcgaactcgatggcgcgatggtttggcttgcgaagctccggtgagggagatcgggtggtggcggccatggggaggagagagaactggaactcgattttgtatggaatagaggaggggtggccggctatttataggggtgagaggcggtggtgagaggcggttcggaggaggagatcgagaagacacggcgacggtagcgtgaagaaaagaatgacggcggccggcttcgtttgcttagcggcgacggaagaggagttggcggcggcatgcgccgtgcacggcacgcgcaccaggaggaggaggcggctcggctggtggtgtgggctggtttgggccggcttggcttagctgggccggcagcccaagaaggaggaggaaaatagaaaataaaagaaaagggattgggccaaaagaaagaaagaatggagtttcggcccgatgacaaaaagaaagaagtctaatctgaatacttgatttggataactaggttttgcaaaggatttgaattcggagagaattcacaaaagagatttcttaagttatttgagtgcaatatttacagatggagtttgaggaaatttatttggaagcactcaaataggaagggaaattaataatattcctcaaatatttttggaatatagaagggaattagttgaaggcaataaataggatttgaactctaaaattggtattatgtatatttgtggctaaaaggggaaattgagtgaagaatataaattggaattttcttagcacaagagctattattcataatatttgtaataatacaattcttatgccgaagaggaaaatcaagccacaacgattaaattggtggctagatcaaaaggaggaaaatggatatttggatcgagaatcaaaggatgggtttaagatcaaaggatggattagcaattaattccaatgagattggaattactttggtctaggttcaaggacgaaattggaggatttcttggaccataattcataatagtaaaaatggttttcaaactaaatttgaataaaagagttttaatcgaaagaaggtttaatattcgaaaatagaattccaacaagaaataccaaatatgtttttaaatgaaaaacacaaaagggattaaataccagagaggttttatgcaagttaattttaggaagtcccgctaagtatattttcctaggtttaaaaggttattaagaacataagaatcagcatgatgcaagattagaaaatgacatattttcaggatgttacagcaaggtatctatatcgtcacactttcatgaatcccactgttgtgaaacactgctgcccaaactccttacgcaagttcaccccaaaaccgctcatagagccacccaacagtctttcatatagtgggacaatgtactaggctaagttacttgatcgtgcggatggacgcaactatgtcatttcccatgggataagggggtaattataatccggttaaaccacccaaaactttccaaactccccacaccaacatcacaaacttcatcattcatcaacattcataatcacaactcaataatgcccattttaaccggattcctaagtttgtaaagatatttaaataataaaccacataaaatgatgtccaatgcatctttctatgatttcatgtggcagtgctcggaagcattaataattaccacaatgttattctgaagtataacatctacccatgagatgttaaaagagtaattatcatgcatcaaatttaaatatgaagattatctcaaggtttctatatgattaaaattttagttatgtcttgccttgcgccttaagatttcccgcggcttcagcgtagccatctgggtccacgtcagttccttggatgtcgacaggacttgttgtacggtctaacgtacgaatacgaaaacatagcaaataaagcctataagcaaattgctacaagaaacgataaagccaaggaataaaattggagcgaggcgagaggacaaaggaatgggtttaaaataagttttaatttgaaaataaaagagaggtgttctacaggttggagattgaataaaatcaaataaagaataattttggataggtggggtctatttggtggattggtttttagtcggtgctagaatagggcagcacgacggctagatatgtggagttggttagccgatgctaaggatgggtagcatagcagctaaatgtttggctcgtctagtcgatgctacagttaagcagcacaacggctagagtcgggaaaatttgtgggggtttgcaagatggaaagtgttactccattgccgtgagtggcagcagagcggctaggatcgcatagagctcggaagctagtgtgctgtggaggtcgagggagaagtgaagctccgaccactatacgcgtcgaggcgtggggtgcgaagagcaacacttcgaccttaggattagattataccgggttttatgaccaacggtttgacgtcggggtttgagaccacacgaacgtctccatggaaggcgtaaagtttccacagcagttttttggtggctaaaggatggtatatgagtggtttaaaaagaagtattttaaataaatcaaaggaatttaaattcaaaaaggggttttaaataaattgaaaaaataaaatttaaaatggtattttaaaagaaataaagaaaaggtaattaaataaataaaagatatttaaagaaattaaaagataatttaatttaaaagtttttttaaataaagcaataaatttaaaattaaagggatttaagataaataaaataggtttaaattaaaaaatatttaaataaataaatttaaataaaattttaaaataggaaatttggtatcaaaagagagggtttgaaattagatgaatttagatcaaaagttttctggaattggatcatcggttggtgagatatggatgtctaaagtttgaaattgaataaaaagaaaaaggattactttataaaaggtgggggccactgtcatagcctcttctccttcttctacctcttcttcttctgttcctgtttttgccgaacaggtagagaggagagggaggaggggcgctagagctccggtggctggggatcggcgacgttggcggcaacgtgtgttcccggacgacgcgcatctggcaaggatggtggccggcagaggtagatgaggagttagccggaacggcgagcacaattgcatgaaccggagagagagagagaaagctccggtgaggctcgattcgaaaggaaaaagaagggggaaaggggtaaaatgggttcaccagagggaggcaaagccgatggtgcaaggaaactaggagggaagctataggggaggagatcgaccgatggcggcgtcggccggacttggcaggagagagagagctcgaggagctcggctatggggaaggaaacggggtctcactggctatatataggcgaggagaggcggtggagtaggtcggttccaatggagaatagcgaaggatgcacggcaacggcgacgtggggaagaggagtacggcgccggctctgtccgttgattggccggtgatggcggttcggctcggcggcgtgacgtcgcagctgacgttggtgatagatccttcgcgtcgacggcaagacaacggcagcggcgcaaagctgcgggcgacggcagcacaaagccacggcgacggtggcggcggtgtgccacgcgcgcccacagagaagagaaaggagccggcttagctggggctgggtcggcttgggctgaggagggagatgggccgaggggagaagaaaaaggaatttcggcccgatttgaataggaacctttgggaatttttgtgtagaggattttaaatggaatttaaaggagatgaaatctataagaagaatgtttgtggactttttgaatttgactagaattcaaaggggaaaaaattctaaaggaagatatttgtgaaccttttgaactttggacaaggaatttaaatagagttaaaggaattttaaactagaggaattttgaaggcagggttttaaataaattaataaattttaaaggagataaaatttaaaagaggaatgtttaagggtctcttaaactttataaaaggaatttgaatataaggtttttgaagcaaaaggagtttaaaatacttataaaataaaatcaagatatttatttttgagatataaatttgaaaaggataaacattaagatgctccaattttaaaagaattcaataagaaccaaatataaaacttatcacaaagattttctttaaaaattaaattaatcaaatgggaaggaaaggaaataatttaatttctaactttggataaatttgggatggtggcaaaaatagatggaggtaaataactaggattttagcctccaaaatatgtggtatggattctcggtgaattatttgtggctaaaggaagttggattttgagtagaagggattggaaataagtttcttagcacaagagcaatcattcaaatatttgtgataatattattctttgtgccaagaatgtgatcaagttataggaatcgaattggtgcatggatcaaaataggaacttaaccacgggatattttggaccgattaaaaggagacaaatgtttttggggataggtttagataggggttgatccaaaataaattccaacggaaagggagttatactggtttagccccaaagataaaaatggttattaggatataacagagaatcgggtcaatcggggaaatattggcctaagctaaatagtagactttgaaatcttgaatggataatttagatgaacgagatttcaaaggggaaatatttgtgggagtatagaactggattcggaagtatatgtggatgggaatctttataggaacgaaattggtggtatgttgataaactctaaaggatgggtatgttgactcaaaggggaattgaaaaggatattttatggactatgggaatatttaggtggagatccaaaggaaaggtattggttctgggggaaaaaataagaattggtatttcatgtgttcgggtagagatcaaaggggaagtatttgatggaagataaaaatggatttggtggtagtatggtaagctctagagagattgatattttatgtgctcaagagatggttgaatgggaattgaaagggtattggttcgaggtgttcgggaatggattccaaggaaatataatttagagccaaagttagagattacagaaaataaatggaaaggttttataaaatttaaaagagagcgattaactttgcaaataaagtttaaatccaagttaaaagaaattaacagaaggcaagatcacttcagaagaatcgagaagagtgcaactaaaatatttcgcaaaaatttttcccaaaattttgagtccgttacaatcaagcatgtaagataaaagaagttagatcaggtaagatcggctgaaagtccgatactactctaatcggcaaccagaaagcagactagggattgaaattctaagcacgacttaatagatcaaactcaactgatgtagcattaagtatgaaaagaagaacaatatctagacaatcaagccgctggatgtttcatagagtggtagatatcttatataatctaagccaacctcactatttaacataatcggccgccttctactaacagatgttagccgattatagattagataatgataatgtcagagattatatagaatatatggtaactcgacgaattacataaacaagactagagtatcataaagatggaagcactaatcccgagaacgcaagccatcataataagttttacctcttgttgaagatcgaaaccgatgcagctcaaccttacatatggctcggggtctatttatacccgagaaatacaagatatgtccatattggacacgactcttatctctaacaaactcttagataccataagtctttgcggcagacttttgcccacatttatctctaaggaatttacataaaatatcctaattaatagatacaattgccttctcaggactctatccatgtgcggcaatcatcttgaagcacaccaactcgaacccgatgtcgtacaaaagtcgtattgtcggaatcgactgtatcactcaacccagtctgactcggacttagccgatcccagtcgtagccaatccggactccagccgattcttactctgtttccgcaacaatacatattagagaacagcggaagcttgactacccaatcacaagcacccgataggggtttaccccattaagttctcatcctagaagaagcaatcggaacccgcatcactcaaagaataagtctaaacctgcaaacaaaaggttatatcaacagcaagagtcagtacattaaacaagttaatgtactggcaagcacaagtcaatcctaccatactacatg

SEQ ID NO: 51489 - DNA, 6836 bp, Oryza sativa
tactcatgatcttgagttagccgcagtggttcatgcgttgaaatttggcgtcactatctttttggtactcgtacggaggtgtatacggatcacaaaagtttgaagtatattttcacccagccggatctgaacatgagacagcggagatggttggaattgattaaggattatgatatgggaattcattattgtaacatcctgaaaatgtgtcattttctaatcttgcatcatgctgattcttatgttcttaataaccttttaaacctaggaaaatatacttagcgggacttcctaaaattaactcgcataaaacctctctggtatttaatcccttttgtgtttttcatttaaaaacatatttggtatttcttgttggaattctattttcgaatattaaaccttctttcgactaaaactcttttattcaaatttagtttgaaaaccatttttactattgcaaattatggtccaagaaatcctccaatttttgtccttgaacctagaccaaagtaattccaatctcattggaattaattgttagcccatcctttgatcctaaacccatcctttgattctcgatccaaatatccaaattcctccttttgatctagccaccaatttaatttatgtggcttgatttcctcttcggcacaagaatagtattattgcaaatattgtgaataattgctcttgtgctaagaaaattccaacttatactcttcattcaactttctcttttagccacaaatacacatcacaccaattttagaattcaaatcctatttattgccttcaactaattcccttcaatattcccaaaaatattttgaggaatattattaacttcccttcctatttgagtgcttccaaataaattccctcaaactccacctctaaatattgcactcaaataaattaggaaatctcttttgtgaattctttccaaattcaaattctttgcaaaacctagttatccaaatcaggtattcaaattagacttctttctttttgtcatcgggccgaaactccattctttcttcctttttggccaaattccttttcttttatcttctattttcctcctccttcttgggctgccggcccagctaagccgagccggcccaaaccagcccacaccccaaccgagccgccccctcctcccgtgcgcgtgtcgtgcacggctcacgccgccgccaactcctcttccttcgccgctaaggaaacgaagccggccgccgtagttcgaatcttcacgccatcgtcgcccgtgcacttctcgatctcctcctccacaaccgcctttcaccaccgcctctctcccctataaatagctggccatccctccccttctctacatacaatcagagctccatctctctctctttctctcccatgtccggccatggtcgccaccacccgatctccctcaccggagcttcgcaagccaaaccatcgcgccatcgagttcgcctcgacgaggtgattccatttttcccgttttccccttcccccccactccatagcaaccaccaccgccacctctctttgccgccgaagacaagctcttgactgcgccgttccggccaactccttcactctctccgccagccaccgccctccccgggtgtgtcttgctcgggaacacgcgtggacgccgacgtcgccgccctccagccaccggagcgccgccgccccgctcgccttctcctctctcttctctcggctctctctctggaacagagaagagaagaagaagaagacgagagaaggagagagaaaaagaaaaggagatcgacaggtgggcccatcaacagtaacttttcgtattttctagatttaattcaaatcccaatctttagaagcctatgtctcctaaaccgtagatccgattccagtgaaatttggacctaaattcatctaatttcaaactcttcattttgatgtcaaattttctattttaagattttatttgaattttcttaatttattcaaataccatttgaataaatatttgatttaatgttataattgaatttacaacttaaacttatatttgcttttcaaatattttcttttatttccaaaataccctgtagccactaaaaagccgccggttggaactttacgccttccatggggacgtttgcgcagtctacggacctcaacgtcggatcgttggttgtaaagcccggcatcaaccaaacccaaggtcgaagtgctgctcctggcaccccacgccttgatgcgtacagcggtcggagcttcactatcccctcgacctccattgcacgccgcactgttagctcttgagctctgtgtgatcctagccgctctgctgccactcacggttgtcggagtaacacttccgtcccactaaacctgcacccacctcctattcttctagccgatatgctgtctatcgacacggttagaaatgataccaaacctagtcgtcatgctgcccaactctagcgacgactagcaaacacctaaaaccctagccgatatttatcctacctcgatatcggcataaacaactaaatcctagccactattctatcaaagccaaccttgacccatgttagccacatgcctatttaaccatatcaactatctagtgtatttcctatcgtccaaaccacgagagcctccacataaaatatagagcctagccgatatgctatcctactccacaaacgactcccatacaactaaaccctaggtattataccacctaaacctaccactagcaaatactagccccataatccctataccctataaaagagataggttataccttaaaccctagccctcttaaccgtttatcgttttcttattattttatggcttttattgaaattagttcttcctctttctcagtagagtctattgtcttttggatggcaacctatggtatttcgagaatcggataatcaggttgcctatgttggatttattgcgttggagcaaggcaagttattattcctcccctttgaacataaatgtcctgtattctatatttctattctatgcattagtcattcatgatttggaatgcataatctaaacatatagcaaatcggttatatgctagcttttgcttagccctgcctagttagactgcataaaacataatgaacttagattgggacagtacgtaagatttggttgatttccgggtggctagtactgtctcggtcgatataagtttaccaagtacttatgtcaaacgaacgagtacgaccgcagcttctagaatggggacagacctagatattatgttaattaacaatgtggtacctctgtacagtggttcttatgtaagtcctcgcgaaggaggcaaatatatgccgcgaagggcaaatgtgatatttaccgaggcgcaggtaaatatcttgattatcgcgcgatgtgtgtgtgaatttatgagaacctggttgagatgacgtggggtctctcatccagttctctctaaaaaccctgggaacgccagaacttctctcgctgctgataacgttactttcagagcgcatggggactagagttcatggaacaggtgccacaattgttaacaacataatactgggccatgactaagctaatgattattggcaagtcgtggactgcgggtaaagcgtacatctactgcagtatgaatatccttgaatctattcgaatagccgtgcttacggattgagcatcgggactcatatggtactttggttagaaatataattcaagattttcttaaatactgttgcatatcaaacatttcaggagttctacctctttattctcagccttctgcaagtaaatctagctctacacagatattacctctcatgcattcattgttgaataatataatagcttgctgagtacgttgtactcacccttgcttcaacccctctttttcagagtttaattggagtttttgccgaagctgggagttcaatcacataagttagttccctttaaacctagtcttcaagtctagtagtatagttagatggtttaattctatagtaaaacgacagagttgagtcatcatatagcttctgctgtaatagttagccacaaacttgtaaatgtcctattattttatataaagatatctcctttggagtctttaccaaatgtatgcgatgaagatctagattgttgaacctgtatcaatctactgatccagggcttgaaacagttaaacatgtcggtttccgaatcattagttttgggagccgacaattatcacccgggaaaggctaatgttgtagcagatgctctcagcaggaaaggctattgtaatgctacagaaggacgacagttgccgttggagttatgcaaggaatttgaaagattaaatttgggaattgtcagtagaggtttcgttgcagccttagaagcgaagcccaccctcattgattgtcacaccccgaagttctttcccaagcctaaattggagttttaaatggtctcaagaaaataccagtgtaaagcaagagtaaaccttaataaattaataaaaataataatcggaattagcatgtggaatttttcttgagttctacatgtcgaaatacgctaacaagatttttagtggaattttcagagccctcgaaataattttaaccaattaaaattgagcacatgcaattttaaatcctagggaaaatcttttcctccttttctttttcttttccctccttttcctcttcttgggccgtcggcctagtccatcagccgccgccgcgcacgccctcctccttgtgggccggcccaagccgccttccctctctccccgggacgtcgacaggtgggccccacctgttggggtcgtccccttcctccggccgcccgtccccacgtcgccaccaccgccgaaaccgccgccgctcccacgtcccgcctcctccgggccacgtcggccacgcccgtgtatgcgccgcgtctcctgcacccactcccccctctctcccgctcgctcccgcgcccgagatggccgggattcgaattccgaatcccgcctctctctctacctccacctcccccacgtcggccggcgaatcccgcccctaccggccacgtccgagttccccctcccctatttaagctccaccgccaccccctctctctttttctccatctcgctgaactctctcgtgctccccatcgctcccgcacggtgcatccacccgccgccgcctttcccgccactccggccgcctctagccgccgctaggctcgccgccacaccgcgccgtcgccgccgttgggttcgagtggccgagatccaccccgtccacccctcctcagtcgaggttcgccgccggagcgccattcccgccgtgcgacggtgagagccgccatgtccgccgccttcggccagcgttcccgccttctatggcccctctctccctctctaatcttttccttttcgttctttaggtcgtcccggaccccgtccgacgcttgtcgacctccctacgtcactcctcgtctccggtcatcgccgccccctccggtgaggactccctcccctttcctttccttccccgtttccccgtgcgccgccgccacccgtgttcgccgtcgccttcggtcgtcgccgctgctggggcaccgtccgctgccgccgcccgcgccgccgcttgccgtcgccggtcgacgcgcgcgcgccgccgcccttgccatggccggccggccagctttgtgccgagccgagccgagccaggccgccgccgcaccgtccgatcggccccgggccgatccgggccgtcgatcccgtggaccggcggtggaccacccgcgtggtcccggtccacggtataccggccaccccttgcgccactgacatgcgggtcccgcctgtcggcgccgacccccccttgatgatgtcagccctgggacttattgcgcaataaatgatttaaggactttttttatagtaataaacacagtgaatcttctaaaaatcataactaattcatccgtgctccgtttaagcccattgaagtctcagtaaatcaagaaaaatgtgtagaatccattaaaaatggttttgttctctatttcagtagtcttatagcctgtttgcattgtttgccttgtatgtcgcttagattccggttcttctgacgctccggtgtacttcgagatagttgccgaggttcctccagcagcagagcaaggcaagtcatgtttgtcacttgaacatgttgatcctatattgcaaatgctctattgtttttcttcaaatactgcattgttttataatgttactatgggatgttcacctattgttacagccatgctattttggtaccatgctccttgttagcttgggttataacatgaatagactttggactaggaattgcttagccatgcttagttcaactagcacacaatgagggagatcctattaatgtttagactgtaggttctaatggtaatgttggattagtaccaccgctttggtgttgattaattaaaatgaatcacatggtgggctgtgggtgcatggttttgctagtcgcacccatggcaattaaggaccggttcgcgggatgccttggaagaacttatcgtacttaccacaagccagcgtgggcaacggctgggcttatagtgtagttttcctctagctgacgcatccaggcaagggtgggcgtgatggagcggggcgggccctacgacggcctttgtcgcttccggattcacctaggcacgagaggggactgcccgctgccttgcaaggagtgggggtgaaacctgaggtgtggtgtgcttggttagagggggttatgcgaagggtcctgtcacggcctctttcc

SEQ ID NO: 51490 - DNA, 1670 bp, Oryza sativa
tccaaggagtaggcttcgtccgtgccgtcgaggatgcctgtggagtggtgttcccgctgcagatcaagtcaaggcttagctccagttatctctcgtttttctgctgcatttatgtaagactttgataatgtttgtaagacgtggatctaaatgtcaacattgtcgtttgtgtaccccggccggtcctggacggggattttaatgcacattctgcttggaattctattcgggaatttctgggcgtgacaagttggtatcagagccgaccttgaccataggacaagccaaatggaaaaacctaagagccctctgaatccttttcattgcatatgttttttgcaattggatttgtttcgggaaaattggggtctgttcttgtggttcaagggaaaaatcttggtcactcgtttaagtgagatttgtcaaaacaagttagtctagggtttcagtaaaattatttgagatattttcgacagtcagttgggatttgatgggtgaaatgcattaggtcctagctcaggaatatgggttgcaaggtatttatgcttttattgttattattagtatgtctctaatttccccattattttatcgttatgtaagtctgtcttatttattcgctctcatgcaaaatgatccatgcataaaatttcgttcttattcgcttctcttatttgagtttttattgctttgtttaaaattgggtttgagcatgcattgatcctactcctttgttttctctagatggccgaccacccacccaaccaccgcggagaaggcatggatgatttcgtggcagaattggctcgcatcacactggtggtgggctaccccaacgcgccagagtacacgactgttccaccgctcagtggcgagcttcctcaccgtgtccgcctggaggtccatggctttgtgggcacctgcctcgctaatatggtggttgaggcgtccggaggcacagcagatcacgcctgtcaggaggtagcatacctgatgatggccagactacaggagcaccacaactacatcttccacgacacggcgtaccgatttcaccctcgtcgagccagcggtgatgatgtcagtactttccatccgacagccggcgagaacgacaccacctttggtcacatgtgcgccgtgatgagggggatggacaggatgcactcggatctacacaaggcgtccaaggccttgaacgatgggaagctcgtgaggatcatagctctgaaggatgagatagcacgcctgaagaaggagaatgctcagttgaagggtctcccagcgccagcaggagtccggatccgcaccacgccccgcaagacgacgactgcacccgtgtgcattcagcttgcgcccaggaacccacctccgcccgcaattcctgcagctccagctctagccccagctccagttccagtgtcagctcccgcgttcgctctctccttcgctctagcgtcagcagccaggggcccagctagtggcaacgggggttggttgcctgctactcccagtggcagccgcgaccatagcagcagcatttctagtggcacagagccgggcagtggcgagacgtatctgccagactccaggagccgcttagagggacctggtgacgagcaggaggacgccttcgactccaccgaccgcaggagccgttccaagcatta

SEQ ID NO: 51491 - DNA, 1336 bp, Oryza sativa
catcggggtataagccgatgatcaaagatgttaaagttgagattgcagcaatgtcagccgatgattggaggtatgatgtgcatcagtatttgagtaatccatctcaatcggcttctaggaaattacgatataaggcattgaactatacactgttggatgatgagcttattatcggacgattgatggggtattacttaagtgcttgagtgccgatcaggccaaggttgcaatcggtgaagttcatgaagggatctgtggtactcatcaatcggctcacaagatgaagtggttgcttcggcgtgcagggtacttttggccgacaatgctggaagatttattcagatattataaggggtgtcaggattgtcagaagtttggagcaattcagcgagcaccggcgtcggctatgaatcctattattaaaccatggcaatttagaggttaggggattgacattatcggtatgataaacccaccatcgagtaaagggcataaatttatattggtggcaactgattatttcaccaagtgggtagaagcgattcctttgaagaaagttgattcgggggatgctattcaatttgttcaagagcatataatctatcgatttggtcttcctcaaactatcactatggatcaaggttcaatcttcgtgtccgatgagtttattcagtttgccgatagcgtgggtatcaagttgttgaattcttcaccttattatgcacaagctaatgggcaagccgaggcatctaataagagtttgattaagttgatcaagcggaagatttctgattatcctcggcaatggcatactcgattggccgaagcattatggtcttataggatggcttgtcatggatcgatccaagttcctccttacaaacctgtttatggacatgaggctgttttaccatgggaagttagaatcggctctcgacgaacggagttgcaaaacgatttcacagcagatgagtattacaatcttatggctgatgagagggaggatttggttcagtcacgattgcgagcccttgcgaaggttactaaggataaggaacgtgttgctcggcattataataagaaagttgtacctaaagatttttcggaaggtgaacttgtatggaagctgattttgccgattggtactcatgatagtaaatttagcaagtggttgccgaattgggagggaccgttccaaattcataagtttgtgtctaagggggcatatatgttgcaagggcttgatggtgaagtttacgggcgagcgctcaatggcaaatacttgaagaaatattacccaagtgtgtgggttaacgcatgatcggctactactgcc

SEQ ID NO: 51492 - DNA, 8317 bp, Oryza sativa
tgattgggccttcagataattggtcaagcttggatttctcttcatgcacaagttgtcggctggcttggatagtggcttcaatgttcttacattctcgccgttcgactaatcttaacttggctttctccagcttgaattggtgttgctcaaggtaaacagctggagtaaggatgtcggctaactcatccgggattaaggcttgaatctcatgcagccgagcctgattgagccacagtcaactactaagctgtctagtgatgatgcctctagccgatccaaaatacttccttgagttttcttcacgtcatcagataaaggagccaatgctttgcttgtagtatcttcttctccttcatcaagatagtctctgatattgaaagagaaaagatcggccaatgcctgcaataacaatttagaagcagattagaggttaaacgattatagccgatttgaatgcctgttgtgataaaagaaacttactaagatagcaggagcagttggttgttcttcttcctcgacgtgatgactccctgcagctgaaggggtctgatcacttgatgattgttgaataaaaggagaaggaggaggtgaaggctgaaagggagacaagtgtcagatagaatcggctaaaaattaactaatgaaagttaaatctatcttactggtggagctggtttagatgttgttgcagccgatttcttcttcaccgcagtcttctttttctgcaattataagacttgggaatgatcggctataagacaaaataatcactaaaaggattaacgagaaacacttacccttgagaagtggactggggcagaaggagttggaagggtttgcttaggcgaagccgatggtgttctttcagtatcgcttacttcagctgcggcctgatcaacttcgtcttcaattatctcttcatctaaggcttgttcaatagatggatccaaggtgggcagatcatcggccggcttgtcagtcggtttggttttcttgaacttggcctttttctttggagccaagattgaagtgctcacagccgaggatctggttttcctttttgggcctgcatcggctggttctctagttaggccgtgaaggagagttgaggtcttgggggcatagtagccaataacagggggagatagcccacctccatttggaattaagcccgaagcatactcaatgttcttgccactattgctttggtgaggaggggaggactctgttgtctgcaaagcaggagcaaaagattggttaagtaataaatcgattaattgactacgcaatttgatagtaacaatgtttacctagggtatgacgtcgggggacagatctgtcatatacatcgtggctgattgatgaaacagatgtagcttctattcaccccaccatctgtcgaagtttttgcttctgaatccagccaactcaatattttcaatgctgccaagaggaggtcccgatagattgagtagccgatccatcattagagcagacgtgatttgtcctcggcactgaatcttgtcggcaaaaaataagccgattgggagttggcctaatccaagttgcctagccgagctcattgggtgataaaactcgtaggagacttggatgtttctcccttggtgaatgccgacaggaaggatgcaagggctgattgcggctataagaacttctctggatttctggaatttctcatggttaatatcttcgaatctaaaatctgatggaagttcgaggtctgctgattcttcataagggaaccagatccgggtatctttcttaaagccctcatagaagctgcagaaccagtccttaagcagctcagccgataactttgctccagcatcggttggtgtggatgcatattccccatatcatgtgcacctgcgatgagtacattcttctccgtcgtcacccacaatcggctctggcagtgggaactcagcttctgttacagaaggccgattgacaaccttcataaccatcaggtttaaccaagtttgcagtagccaccagggtccacctgctccaactgccgagccgacggctattctagccgatgtgttgttcaacatctggtacagatagccgagaaggattttgcccaaagggaattctttctttgactccagggcttcggctacgaactgccagttggttgtagggccacaactggatccacagaaaaggaacttttccagccacatgagcaaaaaggctacgtgctctcgaggggtaacggatccttgacccatatatgctgccacatagccggaccaacaacctatgctcttggttttgaaatcgaattggttcttggtattcatgctcatggggttggccgatgaagttacatctagtccggtgatcatagtgatgtcaattaaggttggagtcatcggcccttggttgaacaggaaagcgttgatggtgtttgaccagaagtaggtggcggcagccatcagaggttcgtctttggcagaattggctatggtgagggctagtgcttggccgattccaatctcatcccagtgaactttcttactagccgatacacgttgataccaagtggaccaactcctgtcgggtgtgggtttttcgagagatggccaggatttaaaggtgttcttccaatgacctaggttagggttggatagcctaaagggaatccggttggtctcaccagtgatgaaatcggtggggtcgagattgccgattgggccaaggaagtagtggttctggtgtgaaaggcttggaattgcgacttggtgggaaagatgttacgaatccaaagcaatcgaaaagagaggggaggtatgagatgagagaaaatcaatctattgctaaggaaaggggatttagccgatgagaacttacctcggcgtactcggctattggcgcaccagacgggctggcggaggatgacatggccgcgggcggagatctcgtcgaaggagaggttgcctgggaatcgcctttgcgtcggaagagtcgccggagaaggaaggggaataagttctgcttgagcggtgaaaacgggtgtcacggtgtgaggtttctcgggggtgacggttagtatttaaagcacggcagtaacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatagagtcctgggaaggcaattgtatctattaattaggatattttatgtaaattccttatagataagtgtggggcaaaagtctgccgtaatgacttatggtatcttagagtttgttagagataatggtcatgtccgctatgggcatatcttgtaatcctcgggtataaatagaccccgagccctatgtaatgtcacaccctaaaaatcctaaatatataaattgttgtttaattggaattattagaaataattttaaaagcctagaagagaagatctaattttaaataataaattccaatgtaaaagtggctagataaaattttattaaatactttacttgattttatagttcctggatttttctgggatttatttgagccaaggaagtatttttaataaatggaattgcatttcatgaataatttaaattgaaaatgttttaaaaatcctccttttggctttgggccgaaagtcggcccaaaaccctctctctctcctccccggcccaagttggcctgcagccgagacgccgctcgcgcgcgcgtcccactcgctgacaggtggggcccacctatcggactcgtcgtccacctccagccgtcgcccggccgaaccctagccaagccgcgccgccgccgcccttccaaattcgctcgtccctttctcgatccgatgaaattgtttgaggggaaatgatccccgagatctcctctactttttcccttttggaatcatcgcctaattcgcttttgaaatcgccggattcgagtttgattcggattcgttttcttcccctgaaccctaatgtttccatcgccgtcgccggccgccgtgggcctccaccgtcaccccctagcccctataaaggacccccgagctctcctctacccgccgccaccctcgcctcgccttccatggccggtagagctctagcaccgtgagctcttgcaccgctgtcgctgccgcaagtccagccgtgcgacgccgtcgctccggtcgtcatcgtcgcttgggaaggacaacgccgggttcaccaagccgtcgccgtcctcgtccacccctccgtcgtcgccgaggatcgccggaagaccgccgtcgtcgtcaagccgaccgtcgccgccgcttcttcctcgtcgccgtccgccgccgttcgtgcctcggtaaggatcgctgcatcgtccactacgcatagaggccctccgtttgcgccaccgcgccgttgttcgccggcgagcatgcgcgcccgagccgccgccggtggtgacgtcatcgccgacgtcatcgtcgtcgtttcccgtgagccgcggtagaccgattagatctcggccgtctgttttggatagggttgatcccggccgttcgtttccgtagaccgccgctgtgcacccggtccaccgtgaacccgagccactgacgcaataatccccttttccttttaaaaaattattcattattgcatcataattcaattaaaatctatataaatgatttaatccgatttaatctttaaaaattcataacttattcatcttagctcggatttagttggttcaagtctctaaatttttctaaaattgagatctacatgttaaaaatatccacatgtactttttatgcttgtttatgtgctgttttagtgtttttgctcttttctctttagattccgatgttcccggagagtccgattttgcaggagaagactttgaggaattccaaggcgagcaaggcaagtcacacagattccaaacaatcctttgagcatgttgatcccgtttaaagttattgtttctattcaactattgcatttatttttgaatgtcattgggtggaaataacctattgccttgttatagcccttttgttcttgattactctattccttaatactttgggttattataatttgactagttgagctttatatattggttcagctagatattagacataattgcttagccatgcttagaaacattagcacactattaggataacttatgattcactattatttaatgatggcttaatgatagctcacgatggttaatcgtgattggttaattaattaatttgccaactaaaacctgataatggtgggttgtgagcacatggttttgatggtcgtgctcatgaaaattaaggaccggttcacgattttcggttgtgaaacattaaccatgccaaccacaagccagcgtgagcaacggctttactttctgtatagtatggttcattgtagagcaccaggctgtgaagtggtggagataagcccacgggggtcgctggggagtccatgccttgtttataagggggtgattatgatccaggaacggtgcactgctttaaattgtattatatagagggtattgtcacaatctctattcgggtacttgttaagtatcgcgacgcttggttgacatgatgttgaggttgtgtcttgtgggtacagtggtacacctctggctagagttaaaactattcgaatagccgtgcccgcggttatgggcgggtctaacaatgtctttcgtgattagtctcacacttcttaccatattaaatgatgctgtttaataacttgtttaactcctggtttggaatggtatattcctggcttggagatagaactgtgcagccgaggttggttgttcagaatggttgggcctatgcaacagggtatgttgtatagcgttggattaatattgtttaatttaatactctactgttttattaaattctgaaatatttattaaatgctatttatgcaaatgagactatactatgccatcctttgttatcctatgcacttgcatatttgctgcgtggcttactgagtatgtcatatactcaccttgcaatcattcatcagaggaagagttctactgtgatgctgatggtgtggaggattaggcctagccctggtcaagctgcctgtggagtagagtcgtctgtgctgtttcttttattttccgctgcttagaactttattgtttgagaggaactatctacctctgtaatgacattatagtcgcttattaataattgtactctattatcaatttgttattgtgtgcctcggctgattcctagacgagggtttacacacatgtaagcgtttggaattttggatagaaatttcgggcgtgacatgtaatttttaatacacacgttcaatacaatctcggcgcatcgccatccttttgctttagttttattttgacgagttcttgctttcgggttgagctgcatggatttcgatcttcaacaagaggtaacattcgccgtgatggattgcgttcttaggattaatgcttccatcctcatgacactctagtcctgtttatgtaattcatcaagttatcatataccttatataatctctaacgatattgccatctaaactactatcggtcaatatctgtatgcagaaggcagccgattaggttagatctagatgttgatctagattatataagatatctaccattctatgaaacagctagcggcttgattgtctagatatggttcttcttttcatacttaatgctgcatcagttgagtttgatctattaagtcgtgtttagaatatcgatctctggcctgctttctagttgccgattagaatagcatcggggtttcagccaatcgtatctgatttagccatatttattctacatgtctcatcgatatgctaaatctgcccttaatatcaagatattgctgcatctaaatatgttagggctttgtttgatatattatacctgctttaatatcctgatatgagttagtatcggagtattagccgatacacgctagatctatctgatcggctacgctataaacatatataatcatgttattgatatatatttcgatctaagtgatttatactgtctcggcatggtgtccgatctatcccaatcactcgatttaagtatataccaatataaggagtatatatcgttaacatctacagccgatcgagtagatttagtgtttatttactttttcatgactgccgatcgatacacaaatgacatcggcccaaagataaatgatatgtcatcggcatctagccaatcggctatcatttatagatttaaccatggtttctttgcttttatttcttgttgattacaggatcaaatcaactggcatgctaatacatccgaaggcgagttttggacctgcactggagttaagcagatctcccaggccacgtgttttctgtcaacacacttttggcacgcccagtgggagttgattagaagtcagatgtcagttcttcctcatggccgagaaacaagcaccaccaccatcaagcccaggttccattaaaggcaaggcattgaagccaggattgactgacatcattgatgacaatgtcatgccaatcgatccagagaaattcacacttgagatgaagcaggagtttgaagcaatgatgcagcaagcacgggatcagtatctgagctcgtttggacatttcccaatgtcggttggagggcagtttggacatttcccatagccataactgtcatatggagcttataaaatgaggtctccatccacacttcaacacacacaactttgagctgaattacaagaggctctattgtatctcttgaacattagaaaataggtagagagtgaggggaagctttggaggactgcccgaaagtttggcgctccatccgacttctatctcaacgagtgtagctttctaggaggaattctggaggagtaccggagttgtcggcacatgtcacgcccagaaatttagcccaaatttccagactattttgtgtattaaatccttgtccaggaccagccagggtacacaaaatgacaagtaataaacagctcccaacgtaaataaagcattaaata

SEQ ID NO: 51493 - DNA, 5588 bp, Oryza sativa
tacaaccaccgtactcagcaagccacaccaacgatgcagacgtgcaaggggatacaaggacggtttgtggctattttcataaatgcggttgtaaatcattttattgagcaaaacagtaaaatagttgagtaattaaggtaatattaaatctccattgatcaacgctacaccacgttgaacaggcccaaacaacccacctgaactacagtgcattgggtcgatttattaggggtgagactaatcacggtgaatctggtcgatcgcccataaccgcgggcacggctattcgaatagttttactctggccagaggtgcacaactgtacccacaagacacaatccaccggcatgtcaccgtgccatcatgtgcccatgatgcacacgtcaccatgtcgagtgattgtgacaaaaccctccgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcacattttagttggataattacgaccatgaaacatggccagatgtctcgagcacgcagctcaacaagataatagaatgtctaatactgcaattatcccttcgactgagctagtggtaattaagcatggctaagcatatagttctagctaggtcatcaaagtaacacaagctaggcgatctattacccatggttgacaaatgacagatatcaagtaaacatggcacaagcgagcagataggtaaaccctgatcccttgtaattagcaaaacatgcatatttatttacaaacggtaaaacatttataaattgggaacaacatgctcaaggggaatgtgtgacttgccttgcttcttcacttggattttttgaactcttttcctcgcgaccgcgatcttccgaaacgacggattctacacgctggctcgcaaaacgaggaaaaaaactctaataaaaaccaaggaaacagtacataaaaagtaaacaaacatgtagaactcaattttagatgaattttgcaatttgaatggcccaattcggagttcgaatgaattagatatgaattttagaagttttgagccatttaaatggatttctataattattaatgatttattgcgcaattatcaattattttctcaaaggaaaaggcattcgctgatgtcagcaaggggcgccggcgctgacacgcgggccccgcacgtcagcgacacaaaaggggcgggcgcacggtggactcggtccaccgcggcctggcggcaccgtggacccagaccacgggagtggtccatgggtggcgaacagagcggcaaggggcgggctcgccggccagcccgacaaggcggcggcacacgcgcggacggccgccggcgatggcagcacgacgcggcgccggacaagggaggcagaagggaaaagggaggaaggaggcctcaccgtgcgccgggcggcgaggggcgatgagcgcggcggcgagctcctcaggacgactgcgggatggtgctcccgcggcggctccacggggtggaaacggcggacggaggccgggatgacctgggagggcgatggaatgattaggggaaagggaggaggcgcgaggcggtggaaaaaaagcggccagaggccggcaacatgggaagtagctcacctcgacgggaaggagaggactccggcggtgaatggcgagggcgaaggggcggcaccagacggagaagccgatggaggcgacggcgcatattaaggtggtctgggacggcagcaggaggcggctggaggcggaaaatgcagcgtcggcctcaggttggcggtgggggtggttttcggtggtggaggggaaaaactgatcggtggccgggcttgcctgcgcggcagcgaagccggctgcggtggtggcaggacgcgggagcggctcaggcgacgacgacatgcgactggaggcggtttagggtggtggcgactcgggtgcatggtggaaggggagtttcggcggaggtttgtgcaaatggagcggtggccggtgtgcggcgaggcatggcgaagccggcggtgtaagcagcgcagcgtggcggtggctacggcgacggcggcgtgcagccggagctcgccggaaagcggcggagcacgggctcgcgcggggagcacgggagaggtaacgaggagctcggggaggggagggaaacggaagaggagagcacgagggtgcttttgataggcttggggaggagaaatcgtggccggacgtggcggatttgaagcggcaacggccggcgacgtgggcgacaccgtgggcgaagtggggctcgatttggcgccaaaaattggggaaaagtaggggatttggtggaggaggtggaggggtgacgtaagagtgcataaatgccacaaccacgctggcagaccaataaggagtgatctctcggtagtacctaggtgcttggaacaaagtcctatgttgtcaggatatatatgttaagtgatactaaatatgattactatagaagtacagttatatcatagtttcctaatgttattttccactagacattattataaaggtgaatctcctgtttgttcactacattatcaattataggttgattcatgagatataaaccatatatttataccgccgccttcccggtggaatataaatacgatacccttgggaatactcatgggagaaatgctacaacggtatccgtgcgcttgcagatttatctatgaacgtacgaaataccaacacatgacccacgtgccccaatcatgcccaggctggcatgcgacacctcaggaataagtccacattgactccctcaactatagctctaatctgattcatatccctgaagagcaataccatatatctttttttagtgtaaaatactaccagagctttgcctaataattatatattaaaataaaaagagttatttacagaggaaaaaacaaaaagcaaaaccaatacccctttgaaaattacaaactttgtagctagctaagaatggaggagctaagagaatccttcattctgcagaaatgtagaagaatttcatttgtaaaagcaacaaaccacctattaagataaggctgaacattataaaaaacatggccatttcgctgcttccaaatgtgccaacaagcaaatcaaataatatccagaaaaccttttcttctgaataaaattcgacatttgggaaatttccaagtttcgattccaactgaggcgctcccagcacaacttactaaaaggacaagtgaagaaaaggtgaatcaacgtctctctaggaccaccacaaattacacagtttaaaactgcatctttaggagcacaatgcctcctatccaacatgtcgttggtatttagcatgtcccacaaaagcaaccacataaaaaccttaattttcttcacacatttggtcttccaaatctagataaaaggccttggaacatagagtcccacaaaattagtcctgtaaaacttttggccagagtagatgtgtgaattccagaagaaagtccataaatctcccttatttggactgagagacagaatgactaaatcagattgcaactgaagaaactgtctataagcctgatcatctaggggaagattaaagtaatcttcaagttgtaaattcaaaaagtgattcacagattcccatcttaaagtagtttgggagaaaagatcacgatactttagtttcttaatctcaccattccagagatcatcccaaaacaagactgaagtgccagattgtattgtacattgggaaatagctctataaatatcggccaactgaattatgtacctccaccaaaaagaccctttattgaaaaccatatgaggtacttttgttctgtagcaagaagcccaaataagtctaacccaaggaaggtcttgttgtaacgtcccgcctttgcctctcccaggctaggcccacttacattcataccattttgtcacgtcccgcctctcccaggctgggcccacttacatctaatagcttttatagttcatagactaccctcacagaccaacacaagtcttttctgcacactttatcctcactcatgtgcacccggaagaattttccggtcggtcacccatcccaaattgctccaggccaagcacgcttaacctcagagttctttggatatcggcttgaagttgcaacttgttgatatgagtattctattaatcctattaagccctgggccagaatgtcacacttgtgctgtgtaaaatttatgcaaatgcttcaaaagcaaagccacattctaaatatacagatttaatacacctagaccacccttgtccttaggtctacagacttcatcctatgctgccaaagattttcttttaactaaaacattagaacctttccaaagatttcttcttgcagtgtcaatggcctctataatagtctttggcaatttaagggagcacatgcaataggttggaatggcagataaaacagagtttatcaaagtaacatgcctccataaggaagagaagaagcaatggcagtcaacctcctttccaccctatcaaccactgctgccatatcaaccactcttggccttgtggaaccctttggaaagccaagagaagtgaaaggcacagagccagattttccaatttctcgtcaaggacattcaaaggataaatattggacttatgatagttaattttcaaaccagtgtcttgattgaaagtgtgcaagagggccttaagacaaagcaattctctttgtgaagcctttaagaagatgagagtgtaatcggcatgctgaacaccaggaaaatcacctcctccttgaccatttataggcttagataacaaaccaagactcatggctctacttaaaacatcctgaagaagttcagcaccaatcacaaaaagcaagggagagagaggatcaccctgcctgacccctcttttgcacctaaggaatttcccaggaatcccatttagtaagatagaagaacttgctgattcaaaaaccatcttaacccaattcaaccattttgtagggaacccatatgtttcattattttcaaaatggtcgaatgttcgattgtatcgaaggccttttaaaagtccaatttaagaatcaggatttccctcttggattgctgacactgatgaatatactcaaaagacccggctaaatagtcttgtatagtcctctctttaataaaaaccatattgattttcatgtacaatcttctttataactccttgaagcctatcagccattagcttagtcaaaaattttagagtgatactcatacgagaaataggcctaaaatcattaacacattctagattaaccttcttaggcacaagaataatataagaa

SEQ ID NO: 51494 - DNA, 779 bp, Oryza sativa
catcaatagactaacttatacatctacaaagggaaaggcgtcgtcacgtcagctatggatatagactaggctcaggaacggagtcttaaagtatttactgagagtatactaaggaagaagtcagtggaagtgagctcgtaactaagacttccataatagaaggcaaagaagtcgacgaacgagcagcttttctaaaacccagttgaataggagggtgaaggctctcagatttcctgttgtctgtaagagtttttaaccctaccaatattttggcagcgataagatttatcaggattgtttggcttggcgttaaatttttgctagtgctcttgtttatgtttcttaccaatacttttgcaataccatttcttctctagcaaacggaatgccatccaattctattggcattgccaatttttttggcatggattcaaatcaaacaggttcgaatcttcggctattgttccgagcgtggcatccaacacggctgccgtctcctctacccgatgaagacgagaacatcaacattggggtttcgtggtacaagtcaaacgcgtccagtagaactggccaactgggtctgtttagaaacattttgacaaaacaaccaaaatttataacttctatactactccctcatctacttttgactgtcatatttcatattggcacacagaccaataataagcaattctacttatcatggatttaaacaagttactagacattcctcgtaaacaagcaattcattaatatttacatttcttgatacccatgta

SEQ ID NO: 51495 - DNA, 1113 bp, Oryza sativa
acccatgaattcagaaaccccagaagtccgcacattcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaa

SEQ ID NO: 51496 - DNA, 3272 bp, Oryza sativa
cttttcttaacaatctgttgcaactcttcaacattttttgtgattatttcaagaggttcaagaagggcaaaatccttcgcaagatcttcatcattctgcaacaagataaagagcatgatgtagcatgcatcagaaaggtaatgaacactagaagacaaacaaacttacttcatccgtatttgcttctagttctatgtattggaggcctttctgcacgatagtgataagagcaccaggtggaactagatttccatcaatcccacccttatggatccctgcttcataccctaatgtgaatgcggcatgaatgaaacctggaaaggttgagaaaccatcagcaataactgtcatagtcatatataaccaaatatatatataagtcgggtgcagcataaagtagttgcagctacatcattggacactgacacagatcacatgtcagttatgtatcaggaaaaagtcagctaaaatagatgatgttttttttttccgatacagctttggaacttcattgacaagcatgcaaaaatttatcgcacatgcaacacaaccctgccacttcaacaaaaagtgaaaagcctatcactagaaacagacaactaaagtaaatgatattattctttgatacagctttggaacttcattggacgcatgcaaaaatttatcacatccacaacacaaccctgccacgtcaacaaaagaatgatataagcttatcgctagagtgctagaccagcctccctccataggttttctcctcgtcatccagaccatgcacctctctggacatgcccccatgtcaagctcagttaagccatgtcaagctcactggtgggttcttattagttcctttcatcagttccttctgaattattaagttcttctctaagttaggttacatggagcaaaactggatgagttttggatttgttcttcttacttccactttcatattttagaaaatagaaacgaataatacaagtattccaagaaggagcacatactatcatcaaggcttcctatgttgaattgttgaaaaagacaaatactgaaatgggaaataatgtgcatagagagacatatcgtcatgttgtcttgtttgcaaaaatggcaatccctctcttggagtctatgtatcgtattcatgcccgtggaaccatatatatcaactgtgggtaacagataaatgagagaatatggcataatattcttcttgactcgttaggcacttctagaacaaaaaggcaccatagtagcacgaactccctatagcttggttctgaactctgagttctgagccatattttactctctgcaattgaggacagttagaaatatggaagccagcagtgctacagtgatcagtgaacaggcaccaaacgcaattctctcccgcaaattaccagttaccactacaatttcaaccccaaaaccaacaaaaacaacaacttcccatgcaccaacggttattaaaatcctcgggtccaactaaaaggaatgaaacggaagttagtaaaagaaacagacaacatcgaaccctattatatatatgggcatgtttggattgctaccctaccagtggtagtgccaaatcttgggcaagttttattactatcaacattttgttagagatttctagggagagatttctattgatttggcaagttatggaatcaatccaaacatcacacaagtactatttagactacctgttggtagtgcaagatttggcactaaaaccaaaacagccctatgtttccctggacacatcagatcccaagattgtgccctagcagaccctattttccccagggccgcacatctccaccacaatagcaccgaaccacactagagctactaaacatccagcagcggtaaatctccaacccacacgaaaatcctctcaacgtaaataaacacaaacaaaagaacctaatatccccaacgccccacatctccaccacaatagaaccgaaccacactagagctactaaacatacagcagcagtaaatctccaatccacacgaaaatcctctcaatctaaacacaaacaaaagaacctagtttccccagcgccgcacatcaccacaacagaaccgaaccactagagcagcagaggtaaatctccaatccacacgaaaatcctcgcaacgtaaccacaaacaaaagacctagggagaagaattcgagagtggacgaaccggactcctggagataccggaagatgaggaagttgagctcggccgaggtgattgcccccataggcgccggtcgacgaacgcgtggccgccgccgagacgggaaggctccggaggagaggggagaggggagaggggagaggggagagtggccaaggggacgaaaccggcgaagggatggatggtgtgggtataggaaaaattgatggattgagaattttaggtcatctcctgaagtcagtctggacacggtcaggatcgcgtgcagaaaaatcggacggggcatgagccccgtaggcatggacgggcctagaccgttcgtttgctttaagatccgtgcacaactggaatactaaatgctacaatgtaattctattgtatttaataacttttaagatcttgatttttctgttcgtcacacaaggcacacgtcgaccgttgccctttgagcacatagcatgagagcatgaatataaacccaaataatagttcgatatgaagtagatgtcaaattaatagtttcaccatgtataaccagattaacaattttgttggtcatctcgttatcgtcttcttttaagatctatatggcacgactattaaaatttgtcgatggcaaaagtaaatatttagagaggcatacttgttaacatagtcatggtattattccggtgcaaatgggcgcatgtagcacgagatggtatggagaagataatcacacaatattctacatgaatggtgatggcgtgctgtacagaacaagaggacattggtgagtaacataaagatcagcaatttactatcctctagattatgttttcgaattaattttgatcatgcgaacctatatttgctcactagtcaagaacgtctttatatacgatattcctagtgctcttccctgtggggtctacttctttctttggcttggctaaaatccttgttgtttgtcttgacacaccccttaacaatgcgacatacaactgaccatgtgaaaaaataggctatggatgatagatcccaacatttggggctgtgtcttgtgggtacagttgtacacctctgatcagatt

SEQ ID NO: 51497 - DNA, 8499 bp, Oryza sativa
aaatgcctgctttatgcaaataaacctttagcctcctttggatatatcttgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaatcttttatatgtttgtaagacgtggatctgtatgtcaaaaattgtcgcttgtgtaccctagctggtcctggataggggttttaatgtacattcagcttagaaattctggttcgtgaatttatgggcgtgacagtagcgaagtatctgctaaggtttagttgtttgctagtcattgctagagttgggtagcatgatgactgagtttggtatcttctctagccggtgtccacgaatagcatatcggctagaggaataggaggttggtgcaagtttagcgaggcgaaagtattacttcacaatcgtgggtggcgacggagcgactaggatcgcacagagcccgagagttaactgtgtggcgtgttgtggaggtcaagggaatagtgaagctccgaccactgtacacatcaaggcgtggggtgccaggagcagcacttcgaccttgggtttggttctgctggattttacaaccaacggtccgacgtggggcccgtagaccgcacgaacatccccatggaaggcgtaaagttccaaccggcggctttttagtggctaataggtattttgggataaaataaaatatttgaaaataaaatataagtttaaattggaaattcaaatataggagtaaatcaaatataaactcaaatggtatttaaataaattaagaaaattcaaataaaatattaaaatactaaatttggtatcaaaatgtagagtttgaatttatatgaatttaggtataagtttcactataatcggatctacactttaggagatatgggcttctaaagaataggatttgaattaaataaggaaaatacgaaaagttactgtgtaggggcccacctgtcagtatagatggccatgtgggcagcttgtcgggccggcacggtccgaccgacgcaccgggctgtgccgtgccaacccacgtgccgcactcacggcccaggcatggcccaacacgactcgggccgtgccgggccggcccaaaggtagagatggcccatcgtgcttttcctcagaataagactattttatgtctctcttctttgggctgtgatatataaatagctaaataagtctatttaaggtccctattctttggacatcgacatctctaatactaccaattgcagggttcaggatcaagtttttcattgggccacatgccaacttataaatttcgttagggcccatctgaaaatctgccacgtgtccccttctctgattctaggatttgctccgacgcatcaaagccttcaaaggtagagatggtgcaaaggacctaactgtaaattttgctattcaaagggagttgaatgcaaaaggtacgatccctatcttccacatgattcgttccccctcctgaaacatcaagagcctcatgctaagatcatcagatcgatataaatcaggtcatgtgtgaaaaaaaaatagcatatctaccctaaatccacattgagaaaactaaaaaaaaatctaagaagattaaaaagcacggcagaagtaattggtgaaaaaaattgaacacaatctccttgcatattgcttgacttcttcagttctttgatatcagctttctataacgccgatcagaattgggaaaaaaaacaaggaaagcaaaaaaccaggaaaaacaatttaagcaatacatctccaaggagtacttcccaactatctgctcccttaggcaaggaaaaaaaatctgttgctccgtcctattcgattgaatatacatccaggattgtgaaggagaaaaaaagaaagaaaaaatatcagatgcccaaaaaagaaaaatcagtaccggtggttagctagacggatgaactagagcttgaccggctgccaacaacgagctatagctcagctcactttctctgtttcctctcagatgcggccagccacctaccgtcggccgtcacctccctaatccctatccacgccggattaggcccgctatggctagcggttgcacagcaccgaatctagcggacgaacatgtcgtggcccatgtgagcaacaggaataggggatcatggaggattggtggcgacggaatccgcagtgcgccaacgacggggaatgagcgagaataagactagttttattcttttctcctttttttcgactttcatctcggtgatttctctatgagctttatcagcatgggcaaaacgatatgggccaagagcccaaagagaggtaggttggatatggcagtagtactatgtgtgatttatttctaactcgatttgttcgccaagattttcaacatattgcaaaccccaacgctaggggggcttgggggaaaaaagattgtctaaaatacaatttcatttagaagaatctagaatacaatgggtctccttaacaattagaccaagtgaccagtccgactaggtagattagtcgtgctgtcctaaaacagcgtcaatataacttaatgctatttttctagattacacgacagagccacacatgtacacatcactatatacgcaaatacgcaataccacactgacaaattttgctataacttacaatcgtctaaattacatctaaaacaaaaatttagataaagaatcaattatccaaaatattaagttaattataactatcactgatcgattagtttgatgtatttgtgacatccgcatgcatagtgttactacatacccaccttgatcactacatatatgcatgtactgattaaccggccagcatgccatttggcctaattagaatactcaggagcatttgatatatttcccgtgttctctctttccgtccaacaccaaaactaatactccctccgtttctaaatatttggcaccgttaactttttaagaacatgtttgacctttcgtattattcaaaaacttttgtaaaatatgtaaaactatatgtctacataaaaatatatttaacaatgaatcaaatgaaatgaaaaaaattaataattacttaaattgtttgaataagacaaatggtcaaacatatttaaaaaagtcaacggcgtcaaatatttagaaatggagggagtaaaatagtgggatgatgtccagtagcaaggagccacattataacagtgtgtttctctaaataaatatttacttttacgctacaactaaaccacgaagtcgcaaaatccaataacagattttaccatatttggtgtttcagaaaagattaagtacacaaggataaaagataaatgtggcataaacaatatacataggaaatagaaaattgttagcatttcatgttcacattgtaaactatttaaatttatctcaagttaaacttctatagctttggctgacttcataaaaagaataataaaactacaacaccaaactaattgagttagatttatcatgaaatatgtctccatagtgcatttatttattattatagatattgctatacttttctataacttataagattaacttagaaaaaggattaatgaaaaggagcaatattgaacctatgctattataaatgttcggataaacactacacctactatttggtaacaccaaaaattagaaattaaaaatattattaattacatatatttttgtttatagacgtatatgggcgaaaaaatcaggggcgccaacaggcgcaccgattttctagtttatatgtctatttttagtctctatactttgtgtgccgggcctggccttccggcccgaccgtgccgggccagcccagcatgccggtggggaggcccaggcacggcccggcggtcaggccgggccggcatggacccgacccaagtcgagccatgccgtgcttgggccgagccaaaatgccgtgccgtgggccggtccttcgggcctcgggtcttatgtccatctatacttgtcagggaatattctattctttttatttttatttttcatccttcctctcgtcttctttcttctctgtttcgttcttcacaggtagagcagagggaggagaggagcggggcgccggtgctccggtggctgggtggttgcgacgccggcggccaaacgtgttcctgagggtggcgcacccaggaagggtggtggccggcagagagagtgtgggatgtggccggaacagtcggtagaggagctcagctctggcgacaaaaagaggtggtggtggtggcttgtttcggaggggggaaaggaggggaaaatggtgaaatgggctctcctcggcgaggcgaggctggtggtgagagggaattggaagagttgctatggaggaggagatcggccggtgactttgtggtagccggccatggtggagagagaagagagagctcgaggagcttagttgtggagagggatggcgagcttgctggccatttataggcggagagaggcggtggagtaagtcggctgcggaggagaacggcgaggagtacacggcgacggctgcgtggaggagaaggggacggcgcggcctcggcttccaattggtcggccatggcggcgcgtgtacgtggagactgccctagggttgggcggcggaggaagaggagcacaacacggtgatgccggaggtgcaactcagtgggcggcagtggatgtcacaccccgaagttctcctcccaagccaaatttaatttgtaaacaaccccaagaaaatgcaggtgcaaatcaagagaaaaccctaagaaagtaatgcaaataataatcggatttggcatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctcttttttccgaatgggccgccggcccattctctcctttcttccccctcctccttgttgggccagccgcaggccgaggcccatccaggccgtcccgcctccctcctctctcggggtcgccgacaggtggggcccacctgtcgggcccgtctccctcctccagccgacgccgcgcccgcaaccgccgcgcccgcaaccgccgccgcgtcgcctccgcctcctccgggccacgtcgaccacgccgcgcgtgcgccgcgttccccgcgcccactcccctctctctcccgctcgcgcccgcgcccgagatggccgggattcgattttggaatcccgcctctctctcctcccccacttctcccacgttggccggcgaaatcccgcctctcccggccacgtccggccctcccctcccctatttaagcttccccgtcactccctctcgctttttccttttctcgccgaactccctcgtgctctccatcgctcccgcgccgtgcaaccacccgccgccgccgtctccgctactccggccgccgctagccgccgctaggctcaccgccgcaccgcgccgtcgccgccgtcgggttcgcgtggccgagatccaccccgtccacccctcctccgtagagattcgccgccggagccccatccccgtcgtgcgctggtgagtgacgccatggccgccgccttcggccggcgccctcgctctctcgcactctcctctctccctctaacccctctccttttgttcgttaggaggttccgaagctcgtcccgccgtcgccatcgtcctccgtcgcccgccgtcgtcgaccgttgtcggtgaggcctctcctcctctttctctctctcccgcactgtttagccgtcgcgccgccgcttagccgcgtagctgccgcttcacctctagccgccgctctccgccgccggtcggtcgccgtcggccgccgtcttgcgccgctgccgcatgtgcgccgcgccgtcgcgcgccatggtcgccgggccggtttgcgccgtgcccgcgcgcaccggccgcgagctcccgccgccgtccgatctacccttgggtagatcggggccatcggttcggccgccgcgtggcgcgccgctcctccccggtccgtggacccgatccgccgtggaccgccctccccgagccgctgaccggtggggcccgcttgtcggcgcccttcctccctccccgagccgctgaccggtggggcccgcatgtcggcgccgcgccccgccttgatgacgtcagccctggaatatattgcgcaataaatgatttaaggtttttcttgtatagtaataaacacagtgaatcttctaaaattcataactaattcatccgagctccgtttaaacccattcaagtctcagtaaatcaagaaaaatgtgtagaatccattaaaaatggttttgttccctgtttcagtagtcttatagcctgtttgcaatgtttgctttgtatgtcactagattccgattcctccgacgctccggtgtacttcgaaatagtcgccgaggttcctccagcaacagagcaaggcaagtcatgcttgtcacttgaacatgttgatcctatattgcaaatgctctattgttttcgttcaaatactgcatcgttttataatgttactatgggttgtttacctattgtcatagccatgctattgttgtaccttgtttctttgtcaacttggggttataacatgattagagttaggactagggaatgcttagccatgcttagttcaactagtgcacaatggggaaaatcctattaatgtttagactgttggttctaatggtgttgttggattagtgacaccgctttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctgggcttgtagcgtagctttcctctagccgacgcatccaggcaagggtgagcgtgatggagtttggatgggccctgcgacggcctatgcggcttccggattcacctaggcacgtgaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccatgatttgtctcaccctagtgtaatcttttaaaattggatagtttaggtggatggttgggcctgtcgcaacgtgggttagcgttggacagtggatagctgatattgtttaattattacaactgtttaaatctttcaacttctgtttataaatgctcgctttatgcaaatgaaccactttagctcttctttgatgattccgtgcatcatacccctattccggtatgacttgctgagtacagtgggtagtactcagtcttgctctacttttcccaaccccagagttcgagtatgtgtcagatgaaggtttctccgaggagtaggcttcgtccgtgccgtcgaggatgcctgtggagtggtgttcccgctgcagttttagtcaaggcttagctcctgtgtctttcttttcttccgctgcatttgtgtaagacttttatgatgtttgtaagacgtggatctgaatgtcaacattgtcgtttgtgtaccccggctggtcctggacggggattttaatgcacattccgcttgaaattctattcgggaatttctgggcgtgacagtggagaacggcgggcggcggcgcaggccgtaggcaatagcagcggctgcgccatgcgcgtgcgccacgcgcgcccatggcgcacccccagagaggagagaaggcggcggctgctgctcagcttggctagctgggccggcttgggccgtgcgctaggtttgggccggggtagggaaaggaataagtttatctgaggtcccttaacttgtcatcgaatctgattttcatctttcaatcggaaaaccagatatcacgggtccctcaactattaaaaccggtgcagatgacgtacctcggcggtttagatggcgattttggctgacatggcgcttacgtggctaattgactcggtcttcatttgtcgtggcattgacgtgacgcttacgtggcaatttgatccggaaaaataataaaacccttgggacccacatgtcagtttcacacacaaaataataaaaaggtgggacccac

SEQ ID NO: 51498 - DNA, 1096 bp, Oryza sativa
agtgaacacgctatcaggcattgacggagctagcaccatgaggcttccggttacaatagccgacatacgtgttgtgggcttgtggcactcgtcgactccggctcgacgcacaggtggtgcatcacctcctccatcttgagccggtgtgctagggacttcgctttgtcatggccaatggtgatcgccttgtcagccgggcctgtgtcgcaacctcgcgctcaacatcgatggcgaggccttctcggtcgactgcttcgcccttgacttgtgtgctgtcgacatcatcctaggcatgcaatggttgcaaacgttggggccaatactgtgggatttcaagaacatgcgcatggccatatggcgcagcacacgcgaggtcatgttctacagcctcgctgatcagggcccgatgtgatgagtggcgatcgacatcgacgatattttgcagcatctcctggcggaattagaggacctcttcgccgaaccccaaggcttgctgtcggcacgggctatcgactaccgcatccacctcaagcctggggccacatcagtcgccgttcgtccctaccgctaccgctatccctcaaggcataccatggtacataatatggctcatggttgtgttcttcctattccggccaaggcaatatagggtcgtttggcttgcggtgttcctgaaacccttgttcagtgggaaggtaaggcaccggcagatgcaacttgggaaattgaatcggattttcgtcaccgtttccctgcattctggctcgaggatgagctgtttctgaaggatgggagagatgttagggtcggaattgtgttccaccgaaggggcaaacgcgcaaaagcgatgggagcgtgaagccggcaggcatgagttgagctacgcatcccggattgctgcaggtcttcggcttcatctcaattagttaggatttactctcaagtttgttagcaaatattatcccttttcttcagctaaattagttacaattgtaagctcttagggagaagaattcgagagtggacgaaccggactcctggagataccggaagatgaggaagttgagctcggccgaggtgattgcccccataggcg

SEQ ID NO: 51499 - DNA, 1961 bp, Oryza sativa
tcatattcagctggattattagtcgcatacggttggatagtataagcgaactcgaaagatgcccccctaggggaaattataactaagccgatgccacaaccatgagtgcacaccgatccatcaaagaatataaagtccatggtactatctccaccgagccgattgaatcgtcatgatgttccacaataaaatcagctatagcttgtcccttaatcgccttcggtgattcataccgaagatcaaactcagtcaaagaaaatatccatttcccaactcgtccctttaatattggagccgacagcatgtaactgactacatcggctttgcatataacagtgcactcgttagataataaataatgcctcaaccttgtacacgaaaaatacaggcacaagcacaacttttccacaggagaataccgagtctcagcatccaagagccgtcgactgagatagaacacaactcgctccttcccttccaattcttgaatcagaaccgagccgattgacctctcgccagccgataaatataacctaaacagtattcctttctgtggagggatcaaaacaggaggagagctgagatactccttgatattatccaaagctttttgctgctctgctccccaagtgaattgttgatcggcctttaacctcaataagggtgtaaaaggttccaaccttccagacaaattagaaatgaaccttctaacaaaatttatcttgccgatcatctcttgtagctccgtcttattttctgggggcttaattttcttgatcgcattaacgctcctttggttcacctcaatccccctttcatgaacaagaaatcccaaaaactggccagccgacacaccaaaagcacattttgttggattcatcttcaagccatacttcctggttctctcgaaaactttccttaaatcggctatgtggtcctccacttctttagacttaacaaccacatcgtcaatatagacttcaaccaaccagccgattaaatcatgatatatatagttcatggccctttgataagttgctccagcactctttaagccgaacgtcatgacaacccattcaaataagccgattgcaccaggacatctaaaagccgtcttatggatatctccctcggccataaagatctgattatatcctgcattcccatccataaaactcaaaaatttgttccctgacgcggcatcaaccagctgatcggctaccggcattggatattcgtcctttggtgtagctttattcaagtctcgaaaatcaatgcacaccctgaccttgccattctttttaataactggaactatgctagaaacccattcagcatatcggcagggacgaataaaaccagcatcatacaatcgtttaatctcagctttaacaggttcgagcatatcggctttacatctcctcggaggttgctgacgtggtctaacccctggccgatgttcaacgatcgatcggctaagtccgggcatctcatagtactcccaagcaaagcaatctctaaactcttttaggaactctatcagcttggttctaaactctggagacaaatttttgctaataaatatcggccttggccgatcgcctggacctatgtctatttcttccaaatcattggccgacataaaaccttgaccttgcttgtcattgagatcatctactgtatccttagcgtagacattcgaaccctccacaacgccctcaaagtaatagcttgggttctccatcttcgattggctgtatatcagaatcggacacttttagaaaatctccatcccagaattttccagataaacaatcaaggccatccatctcccaaagggctaaatcggcactggcaacattaactgacctgtcggctggcacgatctctatcttgttgccttgccattgaatcaagcattgatgcatagtcgaagggatgcaacagttggcatgaatcca

SEQ ID NO: 51500 - DNA, 787 bp, Oryza sativa
  unsure (1)..(787): unsure at all n locations
acagtagttcatcaataatcacatagccaaaacccccttacgatgccctcctggtgtttcgagagaccacccctgggtgccgagttccttacgacaacccgccatgaccatccaaccggggctaaatatggaggagtaccctccccaggaaattgtaattaggattatatacacgcgcgaaggaatacccgtactgagctgtcacatcagcggcccacctctacgtatccgcagcatataaccccaaataatgatattcaatagcctaagcacatcgcttatgttaaatgattcacttgatctctcaaagtgtatgaatatgaattcctcaccaaattttcctttttgattcctactctaaagttgatatgtggagcttggtactctaaagtccaaggccaatcgtttcatgaggaggttgttgatgcgaaaaacacgaggcctgggagatctgcttaactccagtgtaggtccaaaaatcttgcctttaggttcgtgagcgtgccagttgattagatcctgcaatcaacaagaaataaagacaggaaaatagcagttaaatccataaatgatagccgatcagccaatcgccgatgacatatcatttatctttgagccgatgtcatatttgaatcgatcgacggatataaataagtaagaaagaactaaatctattcgatcggctgtagatattaacagtatgtaatccatatgtcgatatatacttaaatcaagtgattgggatagatcggtcgccatgccgagacagtatanatcacttacatcg

SEQ ID NO: 51501 - DNA, 749 bp, Oryza sativa
attcagaggttggggaattgatatgattggtataatcaatccaccatcgagcaaaggacacaagtttattttggtggaaatcgattactttaccaaatgggtagagccgattcctttgaagaaagttgattctggggatgctatacaatttgttcaagagcatataatttgtcgttttggtattcctcagaccattacaaccgatcaaggctcgatctttgtgtccgatgagtttgttcagtttgcagatagcatgggtatcaaattgttgaattcttcgccgtattatgcacaagctaatgggctagccgaggcgtctaacaaaagtttgatcaaattaattaagaggaagatttctgattatcctcggcaatggcatactagattggccgaagcattgtggtcctatcggatggcttgtcatgtttatggacatgaggctgttttaccatgggaagttagaatcagctcgagaaggatggagttgcaagttgagttgacagccgatgagtattataatctcatggctgatgaaagggaggatttggttcaatcaggttgagagcccttgcaaaagtcaagggtgcccaagtctttttcgaaaggtgaacttgtgtggaaattgattttgccgatagggacttgagataacaaatttggcaagtggtcaccaaattgggaaggccgtttaaaatttataaggttgtatccaaaggggcttacatgttgcaaggacttgacggtgaagt

SEQ ID NO: 51502 - DNA, 1134 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcctgc

SEQ ID NO: 51503 - DNA, 3942 bp, Oryza sativa
cgataccactctatattaagatattaaagcaagtagaatataataaacaaaagcataatatacttaaatgcagcaagatcttaatataaagggcggatttaacatgtcaatcaaacatatagaataaatattgctaaatctggtaagatcggctgaaaccccgatgctaccctaatcggcaaccaaaaagcaggctagagatcgaaattctaagcacgacttagcagatcaaacataactgatgcagcactaaatatgaaaagaataaccatatctagacaatcaagccaccggacgcttcatagagtggtggatatcttatataatctaagccaacatcgctatttaacctaaccggctgccttctactaacagatgttagtcgattgtaggttaaacgacgatattaccaaagattatgtaagatatatgataactcgacgaattacagaaacgagattagagtatcataaagatggaagcactaatcctgagaatacaagccgccataacaagttttacctcttgttgaagatcgaaaccgatgcagctcaacccgaaagcaagaactcatcgaaacaaaatgaaagtaaaaggtggcaatgcgccgagattgtattgaacgtgtgttaattcgattacatggggctcgggtctatttatacccgagaattacaaaatatgtccatctcggacacgactcttatctctaacaaactctaagataccataagtctttacggcagacttttgcccaaacatatctctaaggaaattacataaaatatcctaattaatagatacaattgccttcttaggactcaatccgtgtgtggcaactcacgtgaagcacattaactcaacccgatgatgtacaccgacgtattcttggaatcgactatatcggctagtcctgtctgactcgaactctgccgatcctgaccgtagccgattcggattgcagccgactcttgctcggtttccgcaacgatcttcgtctttgattccgtttcaatctagtctttatcttcgacactgatattaccaaatttggtcgttaacaccgccataacaagttttacctctagttgaagatggaaaccgatgcagctcaacccgaaagcaagaactcgttgaaacaaaatgaaagtaaaagggtggcgatacgccgagattgtattgaacgtgcgttatttaattacatggggctcgggtctatttatacccgagaattacaaaatatgtccatatcggacacgactcttatctctaacaaactctaagataccataagtctttgcggcagacttttgcccaaacatatctctaaggaaattacataaaatatcctaattaatagatacaattgccttctcaggactttatacatgcgtggcaatcatcatgaagcacgtcaacctaacccgacatcatatgccttgtcatattgtcggattcggctcaatcggctaaccttgtccgactcaaacactgccgatcttagtcgttgccgattcggacttcagccgaccctcactctgtttccgggataatctctatctcgaactccgtctcgagtcctccttcacatccgatccttggattaccaaatttggtcgttaacgcatgccccccaagtctggaatattggataatgtttcggatttgccatacgtcgactccaagagaatatcgcacttgccgttttccgaccgttattccagcgctttaaatactaaccgttgtccccgacaaatctcacaccgtttcctccattttcatcgtcgaagcaaactttgtcctctctctctccggcgatccccttggtgcacgaagcgattcccaggcgatttcctctccagccaactttccgttcacagcgatgtcgatctccgccagtccatccgccacatcttcagcagagtacgcggaggtaagttttcatatgatagatcctctcctttcacatcagattggttttccctctccttatcttgttttcttcttctctgttcttttggattcgtagcacctctccaatctgatcgcagttccgagtttgttgcatgaaaatcactactttcttggtccaatcggcaatcccgatcccactgagttcatcattggtgaaaccaataggatccctttcagattagccaacccgaatctaggtcactaaaataataccattacatcttggccatccctcgagaaaacttcacccgagaaaagctggaccacatggtataagcgtgtatcggctagcaagcaaacacattgggatgagattggaatcggccaagcacttgccctcactatagcgaattcggttaaggatgaacccctaatagctgccgccacctatttctggtccaataccatcaacgcctttttgttcaaccaagggccgatgacaccaaccctgatagatatcaccatgatcactggtctggatgtgacctcatcggctaaccctatgagtctgaacaccaagaatcagtatgacttcaggaccaagagcataggtggttggtctagttatgtggcagcatacatgggccaaggatctgtcactcctcgagagcatgtagcctttctactgatgtggctggagaaatttcttttctgtggatcaagttgtggccccataaccaattggcagtttgtagccgaagccttagaatcaaaaaggcaattccccttaggaaaaatcctcctcggctatctgtaccaaatgctgaacaatgcattggctaagatagctgtcggctcagtagttggagcaggtggaccatgggggctgttacagacctggctaaatctgtgatagaagccaaattcccaagactggagctgattgtagaagatgatggagaagaacagcacccatcatagatgcatgtcatatggagaatatgcatccacaccagccgatgctggagcaaagttatcagctgagctgctcaaagattgtttctgcagcttttatgagggctttcaaaaagatgctcgagtttggtttccttatgaagattcagtgcatcttgatctcccatcagacttcagattcgaggatatcaaccatgaaagatatcaaaaatctagagaagtcttcttagctgtgattagcccatgcattcttcctgtcagcattcatcaagggaggaacattcaagtttcttatgaattttatcacctgatgagctctgccagacaacttgggatgggtcaattaccaatcggcctgttctttgccgataaaatccaatgccgaggagaaatctcatcaaccttgatgatggatcggctgctgaatatccaaggacctcctttgggtagtattgaaaatatagaactagcagctttcaggagcaaagcatttgacagatggtggggtgaatggaagctgcatctgttccatcaatcggcttctatgtacatggcagatctctttccagacatcatcactcaggtacaccttagctttaatctcgcttgaataggtgttagccgatttacaatttgactaattttcttttgacttgcagacaacagaattcccccctcctcatcaaagcaatagtggtagagacatcgaatatgccccaggtctaattccaaatggaggtgggccatctcgccctgtcatcggctatcatgcccccaagacttcaaatcttctacaagggctcattagagaaccagccaatgctggtaaaaagagaaaaaccaaagcatcggctatatatccatcggctccggcaccaaagaagaaagctaagtcaaagaagaccaagccaaccgatgatctgcctgccctagatccatccattgaacaagccctggatgaagaagagattggagaagatgttgatcaggctgcagctgggataagcgatactgaaagaacaccatcgacttcacacaaacaaactcccccga

SEQ ID NO: 51504 - DNA, 11042 bp, Oryza sativa
  unsure (1)..(11042): unsure at all n locations
tcggcttgattagctccaaactcacctggtaacgtgaaaaccatgttaaccgacgcaggacaacacttttccctttagccaacctttttgcttcgtcggcttgacctcatcggctgtagcagcttggttcttaacacgccactcctgcctcggcttcgttttcttcagccgatggttaatctcttgctcgacttcttggaagcgttgtctgttcctcaatctttgaaccctcctttcctgattctttgtaaaaataccaaaagggcaccattgattttttccgccctcatcatccccctgatcttaatttactgggcccacatctttcatgaacagggaacccttggttgccctaacccaatggctctatattagaatggccttgaaccttctgcaacattactgcgttccggacaaatcttcaatagatggcagcctcatcccttcaggccagcaaaatctgaaaaactcacaaccccaatgaggatcaaaaccaccatcatcttcttcataatacctctcctgctgctgcttgtcatatttcctctggtacttgttgataattctagccgcattcatctgaaagttctattctttcccccatctgctgtccttctagatgtgtgcaccatgttaacagggaaaggattaccatcaaccttcattggcttctttaagtcatcaaatgtaatcttccctccttcaatagccacctagatttgctgtctgaaaactttgcaatcattagtagaatgagaaccagagttatgccatttgcaatacctccttttgcctagctcctcagctgatggaattatgtgaccagcaggaagttgaatttgtttctcccgaagcaacaaatcaaaaatcttaccagccttggtgatatcaaagtcgaatctttcttcttttccagaacttctcacccatgggcatggcacaacctttttgctcctgacccactcggctgctgccacttcggaatcatcttcatcatcagaaccatacatataagccaaatcggctggctgcgaatatgtcaaagataagctgtaacatctgttcctcatctccctgaatctctggatataatattgaacagattcattgtggagataatgggttcctcatacccacacggtatggttatcccactagttataggagataactaatatcagggaaatatgtaatggatcatgacttgggtattacgtttccttgtgtactatggaacggcctaaagtcctgttttgataatattgtaaagtagatttaggaaaccgataccgtattggttaaggtttctatcttgtaatcctgccccccatcctatataaggtgggcaggaggccctctatggggcatgagacaactagatcgtcagatctataatacacccggcggattcaaatccccaaacaggagtaaggtattacctctcatcgagaggacctgaacctgtctaaatccttgtctctgcatccatctacttttaggtctcgtgcgctacccccttttattattgccgaattcatgtttcgacagttggcgcgccaggtaggggagcgtcgagttttccattgataagtgcgatggaatcaacttcagaacaaatgctgagatcaatctcatcgagttcgatggcttgaatcttcaatcccggtttgtttgttctaatctgatttgttgttattagattgattaatcgcagattaaactctgggtatcttttgtgtttaccttatgcatgattgttgagatcaaccgtcttcgccggctcaccttcatgtcggtgtccgcatgatcttcttttaatgagatccgccggctacctccgatgacgacgtcgtgctgaaggaccatcaagctagccatcggctacagggccagatacacatatttggtgatggttaatttttttgaattaatcacccctagcaagctggccgacgccgacttcttctgcaaatcgatgaaatagcagacaacatgcatcgattaatatccttaatcatctatatcttctatacttccctagtcctaatcactcttgttttgcatggcaatctgtccgactggccggccaatcaggaggagccaataggctacatgcaatcatgcatgtgctttagtgcttattacggtcatacgacctctccatcaagttgcaaatcaagccatgtgtttggatctgttaattatatatcaattattttctttttacaaatatctaaccacaggttgatgtgcaatttcttgtctttgcatgtaccatcgcctgtactccatcactgaccggctgcctcatagccgccgactggtgcttttgcctatacggtttgatggtcacatcaccgttcatgggcatccacgtcttcaccaaccggctggccttcgccgccgcatgcacggctggcctattatgccgccgttgttgggcgtctacgacttcaccgccggcctgcctccgtcgccgccgactggtgtgctcgcctatacagttggttggtcatgccaccgttcgtgggcattcacgtcttcaccgaccggctagccttcgccgccgccgactggtgtttccgcctgcacggctggcctattttgccgccgttgttgggcgtctacgacttcaccgccggcctgcctccgtcgccgccgactggtgtcctcgcctatacggttggttggtcatgccaccgttcatgggcatccacgtcttcaccgaccggctagccttcgccaccgccgactggtgtttccgcctgcacagctgacctattatgccgccgttgttgcgcgtctacgacttcaccgccgacctgcctccatcgccgctgactagtatcctcgcctatatggttggttggtcacgccacagttcatgggcgtccacgtcttcaccgaccggctggccttcaccgccgccggctggtgtttctgcctgcacggctagcctattacgccgccgctgttgggcgcctacaacttcactgccggcctgcctccgtcgccgccgactggtgtttccgcctacacggctggcctattataccaccgttgaggggcatccacatcttcaccactggctcgccttcgttgccgccgactagtgtttctgcctatacggttggcctattattccgccgttgatgggcgtcttcactttcattgtcagtcgtctcaagctgcttctatggctggtgtattcattgccattgatggacgactttgttcccacatcggccgtcaccaagggaaagactagaaagctatgtcatcattaatttttttctttatatgatattttccttttcctctgcctcactacatcaactggttcgccgttgactagtgagttgggggctacatatgttatatcatattttttttaataattttcataatatttatcttgattgcttgcgacataatctgagtacaaaagtgcctattgagttatggagttctatcttcctatgctttccgtttggtttgtcgatggatagttgcctttgggccgattcctagcacccggcggctcgttggatgaaccgagtaatgcaaggtgctaagtattattcggaataaatcaaaagcatagagataagataaatttattgtcacgtcctgataaattcatcccgaaataaaaaatcatcctctaaaaagaataatagaattatataaaattcgaaaagaaattggcaaacactaaaatacgtgccagaaaaattcgaatgtggtccgaagaatttttgttaaattctccttggtctaaaaagagccctcaaattttacttgaattttcagagcaccggaaatatttattaagcaacaacgactatgatcaaagtttactaaaaagaaaagctaaaaataatcctccttcctccctttgggccaagtctggcccaaagtcctctctctctctctcggcccgcggccaaagtcctctcttcctccctctctttctctccctctcctcctttccctccttctcttgggcctcctctccttcccctcggcccagctccctcctccctctcttccccaggcctcctctccctcttctcctcctgggccggccgcccggcccaagccgcgccacccagccaccccatcctcccgagccgcccccccccctcacgcgcgccgcacgcgcgtngcacgcgcgctgaccgtgtggggcccacgcgcctgtcggtttcctcccgcacggcctcctccctctcccgtgaaccctagctcctttcctccctcaaatccgtgcgatttaatcatgggattccaaaattaaatagggagaattaatccccattgattcctctttgatttcccccgttttcccccttgaatggcgcccccaatcgcctggaacggccacgccattcccggccgcttccatggccgccggccgtgtttcccatcgccgttctgccctctctcatgcccagctccctcccctcacctataaaatggaacgccctctgtgtgttctctcgttttagccccttcccgagctccctcgtggccgcaccacctctccccgccttctccttctctctctccggcgccggccggcctccagccgcctctccctcctcgcccgagcaccgtccggtcgcgccgtcgccgccctcggcctcgcagccgcctcctctcccccggtcagccctccgtttcgcagggaaatcaccggagacgcgtcctcgccggcaaaacagtggcgttgccgccactgtactgcctccagcctcccctgccgcgccgctcaggtgcgggccggccgcgccgtctcctccctcggcgtcgccgcgtcgacctccaccccggcctaccctctgattcgtccagagaccgccgtcaccagcgccgggctctccatcctcttcgtcgccggcgtcccttcggccgccccaccctcctccccggctcgtcggctcgctgcgacaccaccacctccggcatcgcagcggcaaggtcgccctcggcctcgcctccccttcgaccgacccccgccggtgttcgtcatcgtcgtcatcgttcctcctcgccggctcgttgtctcgctgcgccgcctccatcgtcggattcgcagcggcgtgttccacgccgtcctcgtctccgtgcagccgctgccggctgccctcgtcgcctcctcgccggccccggtcgtcgtcgtcgtcatcctctcgtcgttcccggttgtcgtggcgttcgtccgtccgtcaagccattctcgttcgtcgtcctcgttccgtcaagtgccgcagccccgtcatcgtcttcgtcctcgcctccgcgtcgccaagcattgcgccggccgcgtctcgccttcgtccaaggatcgacgccgaagtcgtcccctcgcctttcgtctccgtcattcccggccgtctccgccgcgcccgttcgtcgttgtcgttcccacgcctcgttgcatggtggtaaggatccctctccctcgctgccccgtcctcgtcctttcggtgtcgcccgtgcctgttgtgcggttgtcggccccggtacccgtgtatcggtgtcggcagtcgttcgcttgttcgtgtcgtgaccgtgttagtgtgtccgctcggtagccgcgtggtttccacgtgtgcagcccgtgtggtgtctagtggagtccgtttgtcggccactgtcacatcctgatttttgtttcaggatttataaattatttaataaattattaaaagaatttatattaaatgttcattaatttacaagtgaagttaaatgtgggaaataaaatttcttaaatataaagcatgggtggatttaatttttattaaattctccatggttaattatactctctggaattttctcggatttttcggagctcaattcttaattttaatcatacaaagagcatttcagtaattacccacatattaaattaatcattaaatggtctaattataattttgttaagtactttgagtgtccaagtattttcaggatttttcttgaaattatttgagcattggaagtatttttaacaattcaaagatcatttaaatgattattttaattgggaaagtaataaaatcctcctcctcagcttgggccattttcggcccattctttcctttccttcctctctcttccgccggcccaacctgagccgcctcctctcctctcagcccagccggaaaagtctactttacctccctggcactgttcatcttccagctctggacagagccgagccgcccgtgctgtgccctgtgcagtcgccgcttcctccgttaaatctcgcctccccgttgctcctttttccaatttagttgaggggaaatattcctcttatcctcctctatctttacccccaaaaaatcggagctaatcgttgagtatcttatccaaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgctgccgccacgtgctccaccccgccgtcgtcgccggccgagctccatccgcgtcgcgccgccgcctccgtcgtcgccgccggtcgccgtcaccgccgtaaggtgcgccgaggtgtggagaagcccggcctcctgtcccccttcgtcgccggccaccggagctccaccgccggcgaggtccgagccgccgccgccgttcacctcgtcgccggtcaccgtcggtcgtcgtttggctcgagggtaagtaccgttgggttcgtctcgtcgtcctctacgtgtacatatcctccaaattcgcagccaaccatccaatctccggcgaggtcgccatcttggtccggccattgatgaggtcatcatgacgtcatcatcggcttttctttttcccgattttctaatagattaaatcttcggaaaatcataactaaatcatcgtaactcggttttgagtggttcaagttgctaaattcatctaaaatcatgatctacatgtttgtttactttatatgtactgtttatttggttttttagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataatctggtaataatttgtttagctcctggtttggagttagatctgtacagccgggtatggttgttcagaatggttgggcctgtgcaacatgggtgtgttgtttagtgttgattaaaatttatgattaattactccactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcaaaactcagttgaagataaaggttccagaaggagaagacgtttggcttataccccagttgagctgcctgtgggagtggagctgaagccatcgctagatcgttattccgctgctgttttcttttcttttgtaagtatgtaacgttattattaagatggatttttatattaaattgtcagtttgtgtacctcggctgattcttggacgaggattttatgcacaaattagttcggaaattactagtgaatttccgggcgtgacaagttggtatcagagccatctcgactgtaggataagccaaatagtcaaaccttaaggactaattttccggaaacatgatttgtgaaaatttctcctttcttccttatctagaattcttcacaaatcgttttgtcgttctctcctcttttccctctttcaacttgagtagttgttaaatttgatggagaaactcgaagacgtcgatgttgtcaacttctgcaagtcaagtggatcgaggaataagaagatgatagttgaatcaaagtgttcagctgtcaagatagagtgaagtttggaacctagcttagaacctatgccgccaaagtgtctttgaagaatagttagtagggttgaacgtttgttgtttgctttgtgtgtaggtatggttgcattcccatcattggagtagttcattgatgagtgtgtaactgtactaggttgcttgcttaatcaacttgaacaatataatggtctacacacaccagatcagtggtaacctggttaaggtcttgtctttagtgtaacccctctcctcctatcttttctaatctgcaacagatggtgaacactcgcgccagtggaagtggaaacaataacaatgaagagaacccaacccttgctcaagtgctagctcaacagacccaattgatcaacatgttagtgcaacaaatgcagaaccagcaaaggaacaacaatgtcaatcctccgccgccgcagaacaagttagctgattttcttcgtgtgaggccgcctaccttctctatcactaccaacccagtggaagcaggtgattggctgcacgctgttgagaagaagttggaattgctccagtgcacggatcaggagaaagttgttttcgcttcacatcagttgcaaggacctgcatcagaatggtgggatcatttccggatgaacagagcagaaggacaaccaatcacttgggcggagttcactgaggcattcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaagagaagttcttggaaggcttaaaggatgaggtgtcagttatgttgatctctcatgactatgaggattttcaggggttggttgacaaagcaattcgactggaagacaagaagaacaggatggacaatcgtaagagaggaaggattgttttccaggagacacagggtagtagccagaggcagcgtatcaagccactccaacttggtgaatctttttctgcaggtcaagaacagtcgcaacagttgaacatcggtggtgagatcaaatcagagactaatgaaagcaatgaagtaaacatcgagcaagctaatcagccggtgctagttcagcaggatcagtctcaggagaataacagtaatggaagggggcagcaggtatgtttcaactgttacaagccaggccactttgcaagagagtgtccgaagtcaaagcatcagcagccgcagggtcagatcaacaacattgtcgtcacaggagccaatgcggtgccagttgcgtcttcaagagttgcgtcttcaagtgttacagctcagtcaccagtttcaaagcagcagtagttttctttaaagccttagaataattatcggagttatggaataagatagactgcagtttacctatgcccttttctttctagccgttccgaatctcgggacgagattctttgtaaggggggtagatttgtcacatcctgatttttgtttcaggatttataaattatttaataaattattaaaagaatttatattaaatgttcattaatttacaagtgaagttaaatgtgggaaataaaatttcttaaatataaagcatgggtggatttaatttttattaaattctccatggttaattatactctctggaattttctcggatttttcggagctcaattcttaattttaatcatacaaagagcatttcagtaattacccacatattaaattaatcattaaatggtctaattataatttttttaagtactttgagtgtccaagtattttcaggatttttcttgaaattatttgagcattggaagtatttttaacaattcaaagatcatttaagtgattattttaattgggaaagtaataaaatcctcctcctcagcttgggccattttcggcccattctttcctttccttcctctctcttccgccggcccaacctgagccgcctcctctcctctcagcccagccggaaaagtctactttacctccctggcactgttcatcttccagctctggacagagccgagccgcccgtgctgtgccctgtgcagccgccgctttctccgtaaatctcgcctccccgttgctcctttttcatttagttgaggggaaatattcctcttatcctcct

SEQ ID NO: 51505 - DNA, 2115 bp, Oryza sativa
actgaggacaacctgaagataatagtgggaagtaaactgaatgtaaagaaagtgaatccgagctgcttggtcgtgggaactatttccagttatgaaccaagtgatatgttcgaagattgttttccaagggcaaattaaaaatcacatctaacaacgaagctttagatttgccaggataaccatcaaacaataagaagtccagcacaaagccatttgggaagacgtcaaagcatgtcaagtgggataagttggttcggttgagaaacataattcaaaggcaaagttatcgactctcgcatggaatagcagaagtagctagcacccggagagcaggaaagctaatatgaggcagttggtggcaagttagaagtaaatgacaagcatggtattctcatgatgacaagcatggtatcctagtaatgacaagctgatatcgacgcataacgtgaagtgggtaacttgtatgaggttgacgccaaagatatgaattatgagaagttctggaacggaagcatcattaaactaccgcaacctagtctgagtcagctaaaaggtgcaccctggttcaagtcaggtgaaaagaagattccatctgcaacaggagatcaagccaagcagttcagagtggggaagttttgctgggcaagtccattcaagaagatgcaacggaagaagtcagaccagaaaagaagaccgcccaacctatcttcttgctagcctcctcgaatcttggggacgagattcctgtaagaggggtggatttgtcacgtcctaataaattcatcccgaaataaaaatcatcctctaaaaagaataatagaattaaaaaaaattcgaaaagaaaatggcaaacactaaaatacgtgctagaaaaattcgaatgtggtccggagaatttttgttaaattctccttggtctaaaaagagccctcaaattttacttgaattttcagagcaccggaaatatttattaagcaacaacaactatgatcaaagtttactaaaaagaaaagctaaaaataatcctccttcctccctttgggccaagtcccaaagtcctctctctctctctctcggcccgcggccaaagtcctctcttcctccctctctttctctccctctcctcctctaactccttctcttgggcctcctctccttcccctcggcccagctccctcctcctccctctcttccccaagccgcctctccctcttctcctcctgggccggccgcccggcccaagccacgccacccagccgccccatcctcccgagccgcaaccacccccctcacgcgcgccgcacgcgcgttgcacgcgcgctaaccgtgtggggcccacgcgccggtcgtctccctcctcccgtgaaccctagctcctttcctccctcaaatccgtgcgatttaatcatgggattccaaaattaaatagggggaattaatccccattgattcctctttgatttcccccgttttcccccttgaatggcacccccaatcgcccggaacggccgcgccattcccggccgccttccatggccgccggccgtgtttcccgtcgccgttccgccctctcccatgcccggctccctcccctgacctataaaatggaaccccctccatgcgttctcttgttttagcctcctctccccggtcagccctccgtttcacggggaaatcaccggagacgcgtcctcgccggcaaaacagtggcgttgccgccactgtactgcctccagccacccctgccgcgccgctcaggtgcgggccggccacgccgtctcctccctcggcgtcgccacgtcgacctccaccccggcctaccctctgattcgtccggagaccgccgtcgctcgcgccggcctctccatcctcttcgtcgccggcgtcccttcggccgcccctccctcctccccggctcgtcggctcgctgagccaccaccacctccggcatcgcagcggcaaggtcgccctcggcctcgcctcccctttgaccgaaccccgccggtgttcgtcgtcgtcgtcatcgttcctcctcgccggctcgttgtctcgctgcgccgcctccgtcatcggattcgcagcggcgtgttccacgccgtcctcgtctccgtgcag

SEQ ID NO: 51506 - DNA, 17917 bp, Oryza sativa
tgacacacgggatctgcttctgtcgacccgtggaccgtctctgtgtacccggtccaccgtggtcccttaggttggcatgtggagtccgcatgtcaacagcgcagccttcctgtcttttccaggctagcgcttacacatgttttatagttgtaaaacctaattataataatccgcaaatctccatataacagcattaaacttcggatgaccatgccttggtcatacgaaccccgaatcgacccgttcaagtctcctaatgtttgttataacataaagaaccctgtgctttctttttatgtattgttattacttctttataggcttgtagctttgcttgtgtgcttcgcgtagcttctgtcgttctggaggttctcgaagcgtggttcgcggtcgtcgccgaaggttcggaaggccattctctctgagcaaggcaagtcacatcatccttgagcatattgaatcccagtttataaaattattttgatttaaattaatgcattatcactttatttaaattcccgcgttatcactgttttatttagccatgcctatttacctttgttatgaccttattattattgctatcgttattattaccttgttcacccttggaaaatgaaaccccaactagtgggtactctattcatggttccactagtatgaatttagggagatgcttcgctgattaattagacaacattaggtggttttataactttagactttgggaattctcatatcacttggatactatggaatggttggcttatgttggaattggacacacacctccccctctattcaaaacccccaaaatggttttaggctgggctcgaggtgcgtggttgggttttgttagtcgtacctcgggtactataaggattaagctcgggcctctattgcaaagcactaccgtacttccacatgtccagtgggtaaggcttagtttgtggctcagactggttataaacaaaagtacacggatggaggtggacgaagtcgggggtcgatggacatctctaggacaaatgaaggctacacgagctgtggcccggtagtcgagatgtcatggcacagggctggtgttctgctgctaggggctcaatcctgcctgcctgtcccggtggttccggccgtaggcggggctgggtcggtactcttgtttatggctaggatgggttgggaactatgtcacgtcttccgtccgtatgccgtggtggtatgtagcacgtggttacacgtgaggaagatgtgtcttgtgggtaaagatgtacacctctgatcagagtataatctattcgaatagccgcgccatcggttatgggcaagcctagcaatgtacccaagttagtgttttaattcttaaaacctgcttaacaactaaaatgtggaatggttggcctgggttggcttgggacgagctgagacccagggtcgggttgccagttcggtctgaatcatcgtaggccttgggttaaggcaggttcgtgagggttcacggtcttgattaataatactgtgtagctctgggatcgtctttttaaaatggctttgggcaactaagtgacttttaaatgctgtttactgcaaaacttaacccctatattattaccccttgtacccccttgcattaatcatgcatctgccggtgttgcttgctgagtactgtggttatactcattcttgctctatctctcccccctttagtaagagaagctttggagaagaagtcttaggtggagtcctggcttataccctagttgagcgcctgtgaagatggagccgtaggcccgctagtccgctgctgtttattttttgttgtcaggcctgaagtgcctttgtaataatgtaaatattatcgatataataaagatgtgccttttgtatcatgtttgtttggtgtaccccggcttttcctgggacggggattaatacactagcgttcgggaaaatgcaaattttctcggtcgcgacatttattttccgcacttaacaattgcgaaattacccgagtagtaaattctaattcgtgaaactttgttccattaatgacgaactcatgtcactcatatgcatgtttgggaagtgcctaggccgactcccggtgcttgtgggctatgactagtcgggcagagtgtttaaatgtaaggagtcatctgctcggggaaatcaaaattgacaaaaggagaaatacgtatttataaatattttaaaaatacttgaattttcttcgagtattatatttacatcagatactactcatcctatatttttgttctacaggatccagatccagatatgcataaaagggattcatggctttaagcttatctcttacgcttcaggaattgatcagtcagaacatcaccaccggcttgccgtcatcgccgccgactggtgtcctcgcctttacggttgggtggtcaccccgccgttgctgggcatcgttgtcttcaccgaccggctgcttcatctgccgccgactggtgtctctgcctatacggttggttggtcacaccaccattgttaggcatatacgtcttcaccaccggcttgccttcgccgccgacgactggtgtctccgcctgcacggctggcctattatgccgccgttgttgggcgtctacgtctccaccaccggcttgccttcgtcgctgacgacaagtgtctccgcctgcacggctggcgtattatgccgtcgttgttgggcgtctacgtcttcaccaccggcttgcctttgccgtcgacgactggtgtctccgcctgcacggctggcttattatgccgccgttgatgggcgtcttcatctcaaccaccggcttgccttccccgccgacgactggtgtctccgcctgcacggctagcgtattatgccgtcgttgttgagcgtctacgtcttcaccaccggcttgtctttgccgccgatgactcgtgtcttcacctacacggctggcctattatgccgccgttgttgggcatctacgtcttcacgaccggcttgccttcgctgccgccgactggtgtctccgcctacacggctggcctattctgccgccgttgttgggcgtcttcgtcttcatcgaccggcttgccttcgccgccgccgactggtgtctccgcctacacggctggcctattatgccgccgttgttgggcgtcttcgtcttcaccgaccggcttgccttcgccgccgccgactggtgtcttcgcctacacggctggcctattatgccgtcgttattgggcgtctatgtcgtcaccgccagctgccttcgctgtcgacgactggtatctccgcctgcaccgctggcctattatgacgccgttgttggatgcctacatcttcaccgaccggccacctcgtatgatgccagctggcgctatcgtcttcacggctggccatgtcgccgccaccgctaataggcatcagcatcttcaacgcgtatgacgccagctggcgctatcatcttcacttccatggctgcatgattctgccagtgttgattggccttatcgtcttcaccgctggtcatctcgtctgctcctgactagtgccgtcgcctctacggctggtttatactgctaccactactgatagacgtcatcgtcttcattgctggccgccttgtcagacgccgactggcttattcgcctccacagctacgtgtcttcgtcaacattgactggagtcatcgtcattaccagtttgcctttgccgccgcccatggtgtcccgactctatgttcagttgtttctcaactaaccaaagagtcgggggctacataaatacaagactcaaaattcgacagatattatgtcaacatgaaggaatcaattaaccagccaatgagtcattatcttcatcttcgcttaagagcaagctttttacttcatcaactccaattatttcaccggcaattttggcttctccgtcatcgccacgatctacttcaaatttctcaaatatcaagtttgagatataatttacatgtccgggagttcagagttattaaccaatcagctcagtttcgacgagttggacaacaacatctactttcctccaagtagagcatgtgcaacaactataacaccaagttctactgacatctttataaatcaaggatcgttgcatcagtcttcgttatgcacacgctcgcatcaaggaaattactcgagcttcgatatcttctcaacagtttgatggattattatcattgacatcatcatcagcacctctacttcatcggctttgacatctctgccgttgctaatggatgactacgtcttcgcctccggttgcttccgtcattgccgacttgttatttcgccttcacaattgacctactatgcaaacgctgatgagcgtcttcgtcattatcatcggttgctatgctgctattgactggatcatcgacatcgtcatcttcatcaacatcctgtcaagcctcttcaacatagcctactctgctgctgtttgatgggcaacttcgtcatcatagtcgatcatctatgattgctgcttatcatcattactgtcggttgcatttgtcgtcgccgactattttcttcatcttcatgattggtggatttcgtcatcgcctttgatgcgtgtctacatcttcaccgtcggcttgctttcgtcaccaccgaccggtatcctcgccttcacggatggctaattatgtcaccactaatgggcgccttcatctccattgctggctgacctgactgctgccgactggtttcttcgcctccacggctatgcgacttcatcacctttgattggtgtcactgtttttactaccactgacatcttccatcacctctgatgagcaatatcatcgtcatgttggtcatttcatctccatgccgactgcatcagctacaatcaatggacaattgtgactacgacggaaagataagctacatgcataggggctcatcaactcaagcgcgaggattatatcttcaatttggactttttccagatacattcagcttgaatttatggtcatgagtcgatttcttatgctcaacgactggattattcattattccccgtaagggctatcaaccgaatacttgcgccagtcgggattcaatttttatatctattttggagtatcccataagggataatcactcagatcagaagctattgatatgagctacacttggtctgtatcacccggaagatttattactcgggagcatgttacatgcgtcatcctttaaagggagtcgaagacatatttttttggcctaggtctaatatgtctgcagcccatattttcaggtgtggcctgtcacgttcttttagggacttaggcactttttgcttaggccaaagtgcgtgtgatcaagtgcccaataccttaaaatccttttataccgcagtcactcaactttttacgagttggtacaatgtatcttaaaaggtgtcaaacagtaaagctttatatagctgccccgttgacttttttatataagtcaaagtgttgtttgggtttttaagcaattgattgaatacaatatcgttactttttgccacgtaagtgtgcatttttattgaccaatattatggcttaggctgattatatatcttggtcattttctaggtggttggtaaatcttttatgagtttatttactcggatgttagtacatatgccatatatttccaggtgtgtaccatgtctcttttagggacttaagcacatctgttaaagcagtgtgcgcatggtgtatgcccaatactttgaaatttctttattcacagcattcaagcttttttatagctgttttgctatgtgaattttcaatgatgtagtcaactttaggttgctcgcatctatgtttacaaagcagtcggtatatcacttggttcatgttatttggtggattcactccatatatgctatatattgatatcaagtcacttggttgactataattatcgagaaccactcagttggttcgattatttattccttgactatatgcttggtttgtttaactaaccacatagtcggaggctacacctattaggtgcatctagtcaatgcacctaagtttacatttcattattttcagccctccccagtcttcaaatttgataaaagtactcggaagaccatggcaaagatgattgaagcactcggctttagagtaatctggttcgagagaagattatcttttcgactgtgaaggtctcaggggctactgtggagataatgggtaccccatacccacactgcatggttatctgactagttataggagataactaatatctatgaaatatgtaacggatcatgacttgggtattacgtttccttgtgtattatggaacggcctaaagtcctggtttgataatattgtaaagtagatttaggaaaccgataccgtattggttaaggtttctatcttgtaatcctgccccccatcctatataaggtgggcaggaggccctctagggggcatgagacaactagatcgtcagatctataatacacccggcggattcaaatccccaaacaggagtagggtattacctctcatcgagaggacctgaacctgtctaaatccttgtctctgcatccatccacttttaggtctcgtgcgctacccccttttattattgccgaattcatgtttcgacatacatcatgcctctgcctaattgctattaaatcggacaatttcatctcatgaataccactgtagaaataactgtgaaactacttctccaaatcggcccaactattgacagagttgtacggcaaaaaagaaaaccaagtaaaagccgatccgaataaagacaaaggaaataacctaactctcaaggcatcaacagctgatgcttctccacattgagctaagaatcgggtgacatgttcataagtggaaacattatcttgccctgaaaattttgagaaatctggcaccttgtacctagcaggaaatgcaactctttcgaaccactcaggatacggatgcatatacaagttcccagtgtcctttggcttgagcccgaactgttccctcatcacatctgcaatcatatcggcccaaggtctctgctgaggtaccccttgtgtatgctgctgtatcggctcgaactgattgaattgaggagcatactgaggctgagttgaccccccttggtggacatgaggtgatggaggctggtaattataattcaagtaacccccgtggtaattttgggtattcggttgaatatttgttaacgaccaaatttggtaacctaaagtatcgaagatgaagatcagatcgaagcggaatccaagaccaagattgtttcggcaacagagtaaggatcgactgaagtccaaatcggctacaatcgggatcggcagagtccgagttggacaaggttagccgatcaagccgaatccgacaattgtatctattaattaggatatttcatggaatttccttagagatatgtttgggcaaaagtctgctgcaaagacttatagtatcttagagtttgttagagacaagagtcgtgtccgacatggacatattttgtaatcttgggtataaatagaccccaagccccatgtaatcaaactaacacacgttcaatacaatcttggcacatcgccacccttttactttcactttgtttcgacgagttcttgctttcggattgagctgcattggtttcgatcttcaactagaggtaaaacttagtatggcggcttgtgttctcgggattagtgcttccatctttatgataccctaatcttgtctatgtaattcgtcgagttattatatattctatataatccacgacaatatcgttatttaacctacaatgggctaacatctatcatcggaaggaagccgattaggttaaatagcaacgttggcttcgattgtataggatatccaccaccctatgaaacatccagcggcttgattgtctagatattattcttcttttcatacttagtgctgtatcagttaagtttgatctactaagtcgtgcttagaatattaatctctagcctgctttctagttgcccattagagtagtatcggagtttcagccgatcttacctgatttaactacttttacgttacatgattgattaacatgttaaatccgccctttacattaagatcttgttgtaattagatatgttaggcttctgtttgacgtattttacttgctttaatatcttaatatagagtggtatcggagtattagccgatacatgctagatctatctgatcggctatgttataaacatatataatccggttgttaatatatatttcgatctaagtgatttatactgtctcggcaaggcaaccgatttatcccaatcacttgatttaaatttatatcgatataaggattatatgttgttaacaactgtagccgatcgagtaaatttagttctttattacttattcacgattatcgatcgatccatatatgacatcggttcaaagataaatgatatgtcatcggcaattagccgatcggctatcatttatggatttaaccgcggtttccctgtctttatttcttgttgattgcaggatcaaatcaactggcacgatcacgaacctaaaggcaagcttttggacctgcactggagttaagcagatctcccaggcctcgtgtttttacatcaacacgcttttggcacgcccggtgggacagagtttttagcaacattctctcatggctgagaaaccaccaccatcaccgtcttcggctggtaaaggatttcctcctaagactgataatcaaaagtttggtgcatctaaagttaatgagggaaatattgttcccatcaatttaggtaaactgacaccggaacaaaagacagagctcgaacagatgatgcagcaaacacaacaccagttcttaaactcgttcatggagacccgtaagggaacagttgttcagaagtacaaaatcaaattagtaactgatgttcctgggatagattcttctaaggatggagaagtgcaacaagccccggctggtacagctgaaacgggaaaccaaggcattccagagggctcaggagataaaggtgacggcacctagggggtacaagttgaggatcttggtccagatggcaattcgacacaattacagttcaataatttcaaagattggattgactatgctgtgcaacatgctttgatcaaccaatctggagtgttagtcaatactttatcaaatatggtgaagtcaatggttgatggttcgatagctgagtatcaagccacagtaccagtttatttagcaggaggtgttttcccaaactattggcctttgattacagataatcagccagctacttctaatgtaccaccagttcagccgactgcgccgatattagctcctgcatttgctgcaccagcatcggcaccagggcaattgatcaatcctcggttgttggtgagagagcagccgcaacacgctggtcagaatgttaatcggctgacccaagaataggtcactgctatgtttttaccaactcagcctaccgttgatccagcacagcaccaaccgattcagcagacgccatcgaggcaacaggttatccagccgattcaacagacaccaccaaggcaacaggctattcagccgattcagcagcaaggttcgctgaatgcatcggctgggttgatgacgcctggtaatcagccaaggcagcatgtcatgactcaagttgtccctgagaatttggttcataatgtgcaaccagatcaatcagtgatacctcaagtcgttcctgaacatttggtatgcaacatacagccgaactttcagaattatcaagggggcaatttgaattaccaatatcagccaccatcgccacaagtttagtatcagcaagggggtcagctcagcctcaattcgctccttagatcaatcaattcaagcccatgccgcaacaagtgcaaggagtacctcagccaagaccatgggttgatatgattgcagatgtaatgagagagcagtttgggcttaagccgaaggatgctggaaatttgtatcggcatccataccatgagtggtttgagagagttcaattgcctaatcgatacaaagttccggatttttcaaagttcttgggggcaggacagtgtttcaacctatgaacacgtcagccgattattagctcaatgtggcgaggcatcggctactgacgccctgagggttagattgtttcctttgtctttatctggatcggctttcacatgattttcttctttgccatacaattcgatcaacagttgggccgatttggagaagtaattccatagttacttttatagtggggttcatgagatgaaattgtctgatttgacaacaatcaagcaaaggcacgatgaatgtcacagcctgaatttcgtttcaggatttataaattatttaataaattattaatagaatttatattaaatgtttattaatttacaagtgaagttaaatgtgggaaataaaatttccttaatttaaaacatggatggatttaatttgtattaaattctccatgattaattatactctctgaaattttctcggaattttcggagctcaattcctaatgttaataatacaaagaacagtttagcaattatttaaataataaattaatcattaaatgatctggatattattatattaaatactttgagtgtccaagtatgttcaagatttttcttggaattatttgagcattgaaagtatttttaacaattgaaagatcatctcattggttaatttatttggaaaagtaataaaaatcctcctcctcagcctgggccgaattcagctcattccctcccttcctctcagcccggccgagagtctgttttacctccccctcgctacagtactccatcttcctcctccagccgactgtctcccgtgccgtgcacagtgccgccgattcccttccaaaatccggccacctcattgctcctctcaatctcctcttccttttccccaagaaatccccaaatgtttctatggaaatcctttccaatttcgcggttcaacctttcctttttccagcgaagatctaaactttcccgagtttagatcccggcctcccatggctatataaaggaccccctagtcgtcctctccctatcccctcaagtcccgtccgccgtcgtcgccggaatcgctctccccgcgctctccctctctctccacctccggccgccgctccagccgccattcgccgtcgccccggccgtcgccggtcagcaccgccacctccctcggcttcgcagtgaagatctctaccccggccacccgttcttttgcgccgaaccccgccggaagtcgccgtcaccgtgaaggccgaaccgttgccatgttttgatctccggcgaagctttgccgtcgactccgtggtcgccggacctcgccgtatccactgtcggcatcgcagcagtgaggagaagcccggcagccatctccccgaagccgaaatccatcggagcaccgtcgtcaccgtgaagccgatctgttccatcttcagtcgcgccgttcgtcgtcgtccgtcgtcgccctcggtcgccgtcgactccattgggttcgcaggagcaaggtgaagcccggccatcggtttttcttcgccgaagatcgctgaaacgtcgccgccgtggacagtacctcgccgcccttcgaagctcgtcgtcggccatcttccgtcgctgtccgtcgttgcgtaagtgttggtaagaatcgccgtcgccttctctacctcacggtgccctccgtttgcattattgtgccatggttcgccggcaaccgccactcctatgccgttcacctatgaggttttccctagggccttaatccgatctaacctaatccgctgtctgtctagcgtagtagtcgtctccgtgtgttgccgccgggtagccatcatcatctctccctctccgatcattttggttcggtgagacttctatccatgttccctcggtttagtttttaatctctcgtttttgtcatcgagtagccgtcgccgtgccacgcttagctgctgccctagcgtcgccgctgcgctagccgcctagccgtcgctgtgccgtcatcctaaccctagccgcgtgtctccgccaagtcgccgctgcctagccgagccaagtcgccctagtgccgccgtgtcgcagctatgtgccgctttaacccagccgccgctttagccgttgctcggtagcgaagttgtctagccataggtgcatccctaaattcctatcggcctatcgtttgccgtaccggggctttaccgtgaatcgtgtctagcctaccggtttagtcgcagctgttgttgagtcgttcactcgttcgttcaaatgaggtgttccccgtgcttcgttcgttcgtccgtgtggagctgttcagagccgccagtttcgttcaccggtttcggttgatcatttcggtgatcccgtgtcacgtagaattgacttgttgagtcgatatctcgtgaggctcgcttgccagatcaatctaagccatccgatcttggtcaactctcggtcaagattaatcttagccgtccaaaattgatataaatccgttctctcttttcaatgacatattattcctttttaatatatgtcatctaccaaatatgatctaatctttttccggaggatgttttaatcttctgtctcagctataaatcatttgtaaattgtttaatcaatttggaatagtcttttctttaataggtttaattggaattaaatcttgtaaaattcgtaactaattcatacgaaatcggaatgagaccattcaagtctctaaatttatctaaaatcataatctacatgtttgtttactttatatgaattgtttatttggtttttattagtctttttcctcgttttgcgtgatagcttgtcgtttccgtcgttgcgaaggttcgtgagtgcgtcggaagtgttcaagaagactaattgaagaccgattattgcaaggcaagtcacacagatcccaaacacaattcctttgagtatgttgatcctatatttaaattctttatttatttcaactgtgcatttattttcgaacgtcatcgggtggtgtgaacttattcctttgttatggccaatttgcattgattaccttatttcttgattacctcaggttataatttgactagttggatttatatattggttcagctagatgttagacataattgcttagccatgcttagagacattagctcatataaatgggataacgtatgattcaccattatttaatgatggcttaatgatagctcacgatggtcaatcgtgattggttaattaattacttgccaattaaaacttgataatggtgggttgtgagcacatggttttgatggtcgtgctcatgacaattaaggaccggttcacgagtttcggttgtgaaacattgtcacgtcccaaaacgactctaaaatacatcctctaaattatgcctagaataattaaaatccgtgtgaaagcctccaaaaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaagtcccccttccctcccttgggccggcccggcccatctctcttccccccctctctctctcctctccccacggcccactcggcccctccccgcgcgcgcgtcgctgacgggcgggcccgcccgccaccctcgctgacgggtggggcccacccgtcatccccgtcctcccgccgctcccgccgctccgcccgcgccaagcgccgccgccgccgccaaatccgccgcatcccgccgtccccgcgtgcaataaagtgggggaaatcactccccgtgatcccctctccctttccccccattttcccctctctctcttgcgttcaaacgggcggatttgcccccgcaaatctcgccggcgccatcgatggcggccgaccccccgcgccggtttccttcccttccggccgctctctcccccttccaaccctatttaaaccctccccgcacctcctccgtccgtttccgcctctcgccgcccatcctcctcgccggattcgagctcgcgacgtcgctctctctctctccgccatcgccgccgagctccggtccgccgccgtcgtcgccccggaccgcctccgacctcggcgccgcctccttcgggttcgccgcatcctcgccaacctcgtccacctctccgtttcggtcgccaaccgccagaacgccgtcgaccccgtcgactcgagccacgccaccgcctccctccgctccggccgcctcctccgtcgccaccattgccccggggtgagccatggaccgtcgcctcctttcccccttccctcccctctctcggccgctgctccgccgcgccggtggtcgccggcggcggccatcggggcgcgggcgcgccgtctcccgccgaccgtgccggcacggccaccctcgggcgcgccgagtggctgccgcgtggggcccggccgtcagccgcccgcgcccttgggtgcggctgacgcgtgggacccacggcgccggccggtgtgagcccgggtgcacccggtccaccgtggaccgtgaggctgccgcgtgggccccactctcgtggacccggtccgcgcgccccctcccctcggctgacgcaataaaccctttttaaattaaattttaaatgaagaaattcgcaaatattcatttaaagagcatataaacttcaaatggccgtaacttggccatttgaactcggaattggaccgttcatgtctctaatttttccttaagaagtcaagaacccatttttgtgctttgttcctgctttttatatggagtttattatagtaaaagccttttcttttccattggtcgtgtagacgctgcagcttcggaagatccgctcttcgtggaggttgaagccgacgtttggaaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggaatattctcaacacctggacactatgggatggttggattattatggaattggattcacacctccccctctattcaaaaccctcaaaatggttttagggtgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgctgccgggggtcgatggacatctctagggcaaatgaagcctacacgagctgcggccgggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtatatcgtggtggtatgtggcacgtggttacacgtgaggaagatgtgtcttgtgggtaaagatgtacacctctaatcaaagaataatctattcgaatagtcgcgccctcggttatgggcaagccgagcaatgtacccaagttagtgttttaattcttaaaacctgcttaacaactaaaatgtggaatggttggcctgggttcgcttgggacgagctgggacccagggtcgggttgccagttcggtctgaatcatcgtaggccttgggttaaggcaggttcgtgtgggttcacggccttgattaataatattgtatagctctagaatcgtgtttacaaaatagctttgagcaactaagtgtcttttaatgctgtttactgcaaaccctaaccctttatattattacccccttgtactcccctgcatttattctgcacttatgggtgtgtcttgttgagtacggtggttgtactcagtcttgctcaatttttcccaaacccagaagaggagcccctagaagatgaaggctttggtgtctagctcgtgcctgccatcaagcgcctgtggtcgtcgccctagtcttccgctgtttttcgtttgtcttcttgtgtgctgggtcttcgccgcccatgtaataaattaattaattatgcttccgcttgttaaactctgaattgtatcaacttttggtgtaccttgcctcctgggacaaggaataatgcacgcacgtaaggaacgcccattgggttatttccggtcgtgacaaacattaaccgtgccaaccacaagccagcgtgggcaacggctttaccttttgtatagtatggttcattgcggagcaccagactgagaagtggccgagataagcccacgggggtcgctggggagtccatgccttgttttctaagggggtgattatgatccaggaacggtgcactgtggtgaattgtgttgtgcgaggggtactgtcacagctcctttccgaggtaccgtgatggtattgaggcgcatggtgacaagtcgtggggctgtgtcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatagtacattcctggtttggagataggtctgtgcagccgggtatggttgttcaggatggttgggcctgatcagcatgggtgatgctgttcagtgttgattaatattgatgattaattactctactgttttgcaattcttaaatgtttgctaaatgctgcttttgcaaatgagccctatattatgccatcctttggtatccttgtgcagttgcatatttgctgtgtggcttgctgagtatgtcatatgctcaccttgcaataatcaatcaaactcagttgaagacaagttgcgaaggagaagacgtttggcttatccccatttgagctgcctgtgggagtggagtcggagcttcgctagattttattttccgctgcagttttcttcatggtgaggacaaagtgcctcttaagtaagtatttatcgttttagttaatttgatgaatctgtatattaaattgtcagtttgtgtacctcggttgattcctggacaaggattttatgcacaaataagttcggaaattactagtgaatttctgggcgtgacaatgaacctgtgcaagattatattcagaggttcaagaagatgacgaacaggtgctacagcttgagtttgaccgatgttctgctagccgatttagccttttagggtctgatagcttcgatcagggagaagttctcatctcatgactttgatactttattacatcttgcacaaaaagtgactttacatgaacagaggtttgcggaagccaggaagaacttcaaaaagattaatcatgtctgtccttatatctatgggtccaacgatgatgatgatattgactccgaagtagcagcagccgagtgggttagaagtaagaaggttataccgtgccaatgggtgaaaaa

SEQ ID NO: 51507 - DNA, 12393 bp, Oryza sativa
gcccccgcaaatctgcgccggcgccattgatggcgaccagacctcccgcgcccgtttccttcctccccggccactctctcccccttccaaccctatttaaaccctccccgcacctcctccgttcgtttccgcctctcgccgcccttcctcctcgccggattcgagctcgcgacgtcgctctctctctccgtcatcgccgccgagctccggtccgccgccgtcgtcgccccggaccgcctcccacctcggcgccgcctccttcggcttcgccgcatcctcgccgacctcgtccacctctccgtttcggtcaccgaccgccggagcaccgccgtccccgtcgacccgagctgcgccaccgcctccctccgctccggccacctcctccgtcgccgccgtcgccccggggtgagccgtggaccgtcgcatcctttcccccttccctcccctctctcagccgccgctccgccacgccgatggtcgctggcagcgaccatcggggcgtgggcgcgccgcctcccgccgaccgcgtgtcacgtcctgataaattcatcccgaaataaaaatcattttctaaaaggaataatagaattaattaaaattcgaaaagaaattgacaaacactaaaatacgtgccagaaaaattcgaatgtggtccgaagaattttttgttaaattctacttggtctaaaaggagccctcaaattttacttgaattttcagagcaccgaaaatatttattaaacaacaacaacaattatcagagtttactcaaaagaaaaactaaaaataaatcctccttcctcctttgggctaagcccagcccaaagtctccctctcctcccctctctttccctcctctcccgggccttctcctcctcctcctggcccacctcttccctccccctccggcccaactccctcccctcccctctctctcccgggccttccctccctccactcctcctgggccggccgccggcccaagccgcgcccaagccaggccgagccgagccagccgtgcacatgcgcgccgcgcgtgcgctgaccgcgcgcccgacctcgtggggcccacgcgccgatcgtctccttcctcccgcctggctcctctctctcccgtgaaaccctagctcgctccctcctccaaatccgcctcattcaaaccggggattccaaaattaagtggggggttttaatccccattgattcctcttcaattccccccaatttcccccttgaatgccgcccccaatcgccgggaacgaacacgccaactccggccaccttccatggccgccggccgtgtttcccgtcgccgttccgccctctcccgtgcccggctccctcccccatcctataaaatggaatccccatcctccgttctatcgttttagcctcatcccgagcctccccgtggtcgtatcacctctccccgccgtcgcccttctcttttccccgcaccggccgcctccagccgcctctccctcctcgcccgagcgccatccggccgtgccgtcgcctcctccagcgtcgcagccacctcctctccaccggcctgccctccgtttcacgcggtgaccgccggaggcgcgttcccgccgttgtccagtggcattgccaccactgtaccacctccagccgcccctgccgcgccgctcaggtgcgtgccggccgcgccgtctcctccttcggcgtcgccgcgtcgacctccaccccggcctgctctctgattcgtccggagaccgccgtcgccgcgccggcctctccatcctcttcgtcgccggcgtcctttcggccgccccttcctcctccccggctcgtcggctcgctgcgccaccaccacccccggcattgcagcggcaaggtcgccctcggcctcgcctcccctttgtccaaacccctccgcgatccatcgtcgtcgtctccgttcgttctcgtcgtcgacgtcccgtcgatcgcccggctcgtcgtctggctgcgctgccaccgtcgtgggcatcgctgcagcgtgtcccacgccgtcctcacctccgtgcagctgctgccggctgccctcgtcgcctccctgtcggtcgtcgtcttcctccttcctcctcattgtggcgttcgtccctccgtcaagccgatcgcgttcgccgcccgcgtttcgtcaagtgtgcagcagccccgtcatggtcctcgtcctcggctccgcgtcgtcaagccttgtgccagccgcgtctcgccttcgtccaaggatcgccgctgaagtcgtcccctcgccgttcgtctccgtcgttcccggccgtctccgccgtgcccgttcgtcgttgtcgttccctcgcctcgtcgcgtggtggtaaggatctctccttcgctgccccgtcctcgtcctttcggtgtcgtccgtgcccgttgtgcggttgtcgaccccggtacccgtgtgccggtgtcgatagtcgttcgctggtgcgtgtggtgaccgtgttagtgtgcccgctcggtagccgcgtggtttcgacgtgtgcaggccgtgtggtgtctagtggaatccgtttgtcggccactcgcctcggttgacacacgggatccgcttccgtcgacccgtggaccgtctctgtgtacccggtctgccgtggtcccttaggttgacatgtggggtccgcatgtcaacagcgcagccttcctgtcttttccaggctagcgcttgcacatgttttatagttgcaaagcttaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtccttccggaggttctcgaagcgtggtttgcgatcatcgccgaaggttcggaaggccattctctctgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccgaccaatataaggactaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaattaaaatgtggaatggttggcctgggttggcttgggacgagctgggacccagggtcgggttgccaattcggtctgaatcatcgtaggccttgtgttaaggcaggttcgtgtgggttcacggccttgattaataatactgtgtaactctaggatcgtctttataaaatggctttgggcaactaagtgacttttaaatgctgttttctgcaaaacttaacccctatatcattaccccttgtacccccttgcattaatcatgcatccgccggtgtggcttgttgagtactgtggttgtactcattcttgctctatctttctcccccctccagtaagagaagcttttgagaagaggtcttaggtggagtcctggcttataccccagttgagcgcctgtgaagatggagccataggcccgctagtccgctgctgtttatttttgattgtcaggccttaagtgcctttgtaataacgtaaatattatcgaccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctttggtcgtcgccctagtcttcgctgtttttcgtttgttttcttgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttatttccggtcgtgacacagccggaggagaggacgacgctgcgacgtcgacggaggagacagcgacgtcggtcggtgctcgggcacggcggaaggggctgccggaggtggtgcagtggcagcaacgccactgtttaccggcgaggacgcgtctccgatggtttccccacgaaacagaggcgacgtcggggaagaggatgcacctgcgaggccgagggtggcgacggcgcaaccggacggtgcacggtcgtggtgggaggtgcggctggaggtcggccggcaccggagagagagaaggagaaggcggggagaggcggggcggccacgggagagcgcgggagggggctaaaacaggagaacggaccgagggggttccattttagagatgaggggagggagccgaccatggcggaggtcggaacggaggtgggaatggcggccggcggccatggaaagcggcagggtttggcgcgtccgttctcggcgattgggggcacgaatcaagggggaaaacaggggaaatcaaagagaaatcaatggggattaaaaccccctaataatttggaaagagccggcttgaatggggtggatttggaggaggaatctgcgctagggtgttatgagttgtgtttgctgtagcttgtcagctgttgccgttccctgtattgagtgtaacagtgtgttggggcctggcttgttgtgggctgtggactgggtgtgtgtgtgtgcttttgacgtgccgtgctgggctggcggtcgcgtcgagtgcgtgtgccttgtacccgttaaaagggaaactccctgccgatgagcaagtatcgatgagaagaaatcaaatacaatcgaactacctctctctctctctctctctctctctcaggtcatccccttcctctctaattcaatccaaatcccctagcgaattctggattagcttggcgtgacgccggtggagtctaggagttcgtcacaatctgattccgctggcgatgaagaaggggccaaatctcacggagaggatggttgctgtgaaggcagagctcgtcgatctgaatcagcgagttggggagctcgcaagcaacctcaacgacctcctggggtcactgaccaagctggagacgtggattccatcggtggacacggggatccaagctctgaacaaggccgtggaaggaattgccgcaagggtgacggttctggagaactcacctgcagcggcatcggggatgacgaccccaacgcccatcgggcacggcgaaaccgagaatcaccagggagacgaatccaaagccctcgcggctcaggatcgattcctggtcaagggtaagtcccgattccctaactctcccatcacttttgatataggagagtcttcagttcagaatcaatccagcaatagattccatggtcctaggcttccaaagtctgatttcccaaagtttgatggtgacaatcctaagctctggaagaagaactctgaaaagtattttgaaatgtatcaagtgtcttatgaaaattgggcaaaattttctaccctccactttgtaggaaatgctgccttgcggctccaaacaaatgaggccctccatagtgttgaaacttggcctgaactctgtatagcagtgcatagcaaatttggccaggacaaatatcaggaacatttagaagagttagaagggcttaggctaattgttggtgttgaggagtattataccaagtttgaggaattaatgcatagggacagtttataatcaggcctatgatgaaacctattttgtcacaaagtttgttgggggtctaaaaactgaaatcaaagcagctatcaagctgcataggcccaggactgttgatacggctttatctcttgccaaaacgcaggaggaacttgtcttggagttgaagaagggtactcaaaagctggggtacaaacagaattacaagtcagcggcaagggaatattggggcatgctcctgatgatgctggaaaaactgaagagaaaccaaaatgggaggacagatttgagtccttgaaggcttccaggagagctaaaggagaatgtttcaaatgtggagaaaagtggggacctggccataaatgctaaaaatctgttcagttgcatgtcttggaggaattacttgaagttcttcaaattcaagagaatcaggaagctgggcaagattgtgaatcagaaggcagtaatgaagagttttcaattttggggatatggtttatttgaaattacaaccatatgttcagatgtcagttgctaacgtagttgtcagaaattgtgtttaaggtactttggtccatacaagattttggagcgcattggagaggtggcatacaaattagacttgcccccacaaaatcaagttcatccagtagtccatgtgtctcttctcaagaaggcaattcgtcctgatgtccaagttcaagccgatcttccagcaaattgcatggcagaagatgcagcagttattcctgaagaaattttgcaccgccaactcatcaagcgaggtaaatcagctgtgcccaatggattagtccgttggactggtttgcctgccgctcttgctaaatgggagaatctacgacagctgcaatttcgtttcccatcttctccggcttggggacaagcctcttcttaagcgggggaaattgttatgagttgtgtttgctgtagcttgtcagttgttgccattccctgtattgagtgtaacagtgtgtttgggcctggcttgttgtgggccttggactggattgtgtgtgtgtgttttcgacgtgccgtgctgggctggcggtcgcgtcgagtgcgtgtgccttgtacccgttaaaagggaaactccctgccgatgagcaggtatcgatgagaagaaatcaaatacaatcgaactacctctctctctctctctcttagttcatccccttcctctctaattcaatccaaatcccctagcgaattccggattagcttggcgtgacgccggcggagtctaggagttcgtcacatagatttcacgggtgagagaggaggccgagcgggaggaaggaaacgatcgggtgggtgggacccaccggtcaggcgcatgacgggcgctagagggaggcggccgctcggcttgggccggggcaggcccaggcgggaggaggagaggagggagtgggccggccgggaaggagggaatgaaggaaaagagagggagggaggagagactttgggtcagccttggcccaaaggaggaaggaggattatttttagtttttctttttaataaactttgtttattgttgttgttgcttaataattatttccagcgttctgaaaattcaagtaaaatttgagagcactttttagaccaaggagaatttaacaaaaattctccgggccacattcgaatttttcttgtacgtattttagtgtttgccaatttctttttgaattttaattaattctattatttcttttagagaatgatttttatttcgggatgaatttatcaggacgtgacaaatccacccccttacaggcatctcgtccccgagattcgagaggcttaggaagaagataggttggtcggtcttctcttcttgcctgacttcttccgttgcgtcttgtataccaaacttgtccagcaaaccttccccattcggaactgtttggcttgatctcctgttgcagattgaatcttctcttcacttgacttatccctggttgcacctctagctgacttcgactgggttgcggcacttgaagatggggcttcagttcgagaacttctcatagttcatatcttgggtgtcaatctcatgcaagttacccacttcacgttatgcgtcgatatcagcttgtcattactagaataccatgcttgtcatttacttctaacttgccaccaactgcctcatattagctttcctggtctccgagtgctagctacttctgctattcgatgcaagggtcgataactttgcctttgaattatgtttctcaatagaaccaacttatcccacttgacatgctttgacgtcttcccaaatggctttactgctagacttgttattgtttgatcgttatcctgccaaatctgaagcttcgttgttagatgtgattttaatctgacctctgtagactatcttcgaacatatcacttggttcataactgagaatagctcccacgaacagacaactcggattcactttctttacattcagtttacttcccactattctcttcatgttttcatcatttagcattcaacgtattcctttacaccttcgaccttgatgagttccttcccattggatcatctcccaagacatggcattacctggtaaccggtgcctgcacttttcactccgtatagcatctgataccgacttgaagatttcactccttgccttcacagaaacacttttacctagttcatcttgcttactcacgatttttttttcttaatgacaaggtgactgttgcagggcgattactgtcaggagtcttccttgtgtaatgcagagcatgtttttggttatcctttatcaatcaccattcagcctacttctgttcctgctagaaaacatctttgccgatctcttttatcgatcaccttttgacctttctcaaccaagtactcttcactctgagagttgtggatgcttctggtggcaatgtggtccttgggcttgctgcctttcagagaaaccttgaagtagttcgtcaaaagctatactgactgtcgttgccttttatcagaaaaagacacatctgaaactcttagtccaacaaatgtctctttggttgatcacttgattttcttttctacaactaggttatttgattcagaatagagtaggagctcacggaaatgagaccctaggtctcctttatcagtaaacaattacgcacataatcacatatccgcatcttccaaaagaatcctcatagatcttgtctgtattacacatttctcccttgttacatgaatactaagcactgcctaacaaaatggaaaggtgcttagcatcgatacattgtttctactatgggttatgattaacacgaggcctcacaggtatggcgtttgctccagtgaccacaaggcgagtgacttgtcttcttcttgcataatgcccggagtgatggcgcaggttacgcttcggttgtggacaatctctagagaaatgacctggttctttgcagttgtaacaaatcaacttcttctttactgagctgtccgtctgggaacgatcattctgacttggagttggaattggtggttggaaatccttgctaacattggcatcagtggtaccatagttgctatcaccattggattctttctcagagtcacaattgctagggttgtcattctgggtgccttcattgatactatcgtcgacatcttggtgaatgttgttgacattgcacgcttgattcgagtggtcactaatggggcaagaaccatggttggtggtggtatcatcatcattagtattgctaatgttgttgtctgcattgtatccatcttcttggggcaggaactcttgatgcgcaacagaagatccggtgatctgaagtggctcagttcgctgtctttggttaccacatggaattactgggatgttgacaatccttctcttgcagttcttcatctgattatgctcactttcgagttgtatggctttgtccagaagtttctcaaaatcttcataatcctctaggagtagttgcactgcaagctcatcttttaacccctggagaaacttctcttgtttatcttcatccgtttccacatcttctggtgcatagtgagccaaacgatggaactcgtgcaggtactctatgacggtcaaatattcttgctttaggtagcggaactctcattttcttagtgtgatcattcctgcgggaacatgtgatctcttgaatacagctaaaaactcgtcccaagtgatggtatgtccttctggccgtgatacttcgtagctatcccaccattctgaatctagcccaaccaactgatgagttgcgaagacaacccgctcctggtctgtgcactgaatcaaccccagattcttctcgactgtgcgcaaccaatcattggcttccataggatcgacggcaatggcaaaggttggaggcccagttttgagaaattctgataacttgcactgttgctggactataggtacttgaacgttggttgcccatgctgggttgttccgattctgtaatagttgaaatgctgttgccaacatgttggtttggttaaccacaatttggattagctatggtaaggtttcgttgatgcttttctcattcccattggcttgggttcttgagtcatcggatccatcattcccatagcctttgttaccagtgttatccatctgtcacaaggtagaggttgagagaggaagcatacaaggaaagaatagaccagaactagggataggaccttataggaactaactctttttgttgatgtgttgtttgtttcacttattctgcaagttgattaagcaaacaacctagcatggttacatcacaacccaccgatgcaaaccacgcgctacacacacaagcaaaggaacacacaactatcgactctaccctagagggtggcttaggttctgcgactggttcccaagatcttcactcctgcttcatagctggctccactgctttctccacttcgctagcggatcctgcagtcttccggagcttccgcaaacaattgacgacatcttcttcgcaaagctggccatctagtactagttgaaattcgaagaaggaagaaaagagaaaacattttgcaaatggcataggggaaaggaggaaaagggaactttcgcaaatagtttcatttataaaatatgtccttaggttttatccacttggcttatcctacagtcgagatggctctgataccagcttgtcgcgccgggaaaaattgccttttcccgagcgctagtgtattaatccccgtcccaggaaaagccagggtacaccacacaaacatgatacaaaagacacatctttattatatcgataatatttacattattaccaaggcacttaacgcctgacaatcaaaaataaacagcagcggactagcgggcctacggctccatcttcacaggcgctcaactggggtataagccaggactccacctaggacttcttctccaaagcttctcttactgaaggggggaaagatagagcaagaatgagtacaaccacagtactcagcaagtcacaccgggagatgcatgcttaatgcaagggggtacaaggagtaataataatagggttaggttttgcagtaaagagcatttaaaagacacttagttgctcaaagctattttgtaaacacgatcctagagctacacaatattattaatcaaggccgtgaaccctcacgaacctgccttaatccaaggcctacgatgattcagaccgaacaggcaacccgacctgggtcccagctcgtccaaggccaacccaggcctaccattccatattttagttgtttagcaaattttaagaattaaaccactaacttgggtacattgataggcttgcccatatccgagggcacggctattcaaatatattatact

SEQ ID NO: 51508 - DNA, 1618 bp, Oryza sativa
tttactctgcattccattgcaatgggaacccatcataaaaaacatgacatacccctttactatcctagctgtgaacaaaagtaccgacccaaccctgcctacagccggtatcccggacaggcaggccaggattgagcccctagcaacaggatctagaccgggtgcgccacacacataggggtgagaccacccgcgtactagtccagtgccatggcatctcgactaacggacaccggcccgtgtagcattcatttgcctagacatctcgattactgagccgcagctcgcgtagccttcatttgccttagagatatccatcgtcgcaacgacttcatccatctctatctgtgtccttttgttcaggactagactgagcaccgagataagccttacccattagacatgtggttagtacggtactgctttgcaacagaggcccgagcttaatccttatattggccggggtgctacttcccacaactgggatgcacccaaatcccaccggaaaacaggttttacgggttttgaaagaggaagagaggtgtatgtccaattccaccataagccaaccattccatagtatccaagtgatatgagaattcccaaagtctaaagttataaaaccccctaatgttgcctaattaatcagcgcagcatctacctaaattcatactagtcgaaccattgaaagagcatctatgcccctagtggattttggtttattgatgacaaacgattaaggaactaatgcacttattaagtgtataagaaagtgattagtccgatgaagaagctaggaaattgacttatcgatggatgataattaaacagaagatattgaagatgcgggtatgaagtgactacctatcgcaagacggtgaagcgcaagcgacgctcagctgcgatggaccatgcggtggtgaagggcaagcaaggggcttggcgccggtggtgaagggcgagtgaagactgtgtcgtgatgaaccgtgcgaggccatttgaagccatgtattatccgcattaatcatttgagaaatggaagacgaaatgtcaagaatcaagaagatgagatcttcccgatgatcaaatgaccttgacgttggtaaccctccaagtgaagaaacaatatggtgtgaaggtactcctattggtataactttactttttaaatttgagtttaggatgccgtactattaagagggataccacatgcaaataattggttgaatacaagtgctcaaaaggcttcatctttgtgcgagttgaaaaacatgtgagttgaaaaacctaagccaaaatttcaacatctttgcaagttttctttgcaagtttttcaacatctcttgaaggttttggaccaagttttatgttgggtttgatagcccacgaaactagctttccatagagtccaagatcttcgaaatcggagttcggagtaaaaagttattgcatttttacttgagcaacatcagactatccgatttgaaatcagactatctgatgtatcggactatccaatttttcacagaacttcactctctgtcttgatttgaaaaagtcctatctaagtgagtttttctaagtatcggagtatccgatgtcggatcagatagtccga

SEQ ID NO: 51509 - DNA, 1323 bp, Oryza sativa
gccaagataagtttgtgaagccggatctagcctccgcaacgaaagagatacccttagtggaaggaggagtgcatttgtgcaacctcacgaggatagggttaaaaagacccggctctttgcgagctccctcaacggaaattagaatcccctcaattgaactccgggaaatacatcgacgcgtaaacctcggtgatattctcactctctttaccgtcttgttccattgctttgtgctatgctaatattgttgttggtcgagctcacctctttgcttgtggattgaatctagagctcttaggttgttctcttgtttgtattgttgttgtgcaggtcagatagtctgatctcagttcagactatccgatcacataggactatccgacctgatatcagacaatccgaccctattttgttttagcttccgcatttattttaaaaaaccgcctgttcacaatcgacatattttaaaccgcctattctctttcccttcatctaggcgacatcaaggtcctttcaattggtatcagagccaagtctctctattaagggctttaccgcctagagagtaaagatgtcgattagtggtttggtggatattgttcctttactccttttagatggttcaaattatgattcttggagtactcgcatacatgtgacatatttaggactatgggtcctcaaatagagcgagttgtagatgtgagcgtttctcctcctaatgataaagagctatcatctgaagaggaagagaaatgcatacatctcaatgctcaagctactaatgttttatttagtgttttgagtgaagatgtatttaaaaccatcatgccgcttaaagatgctcatctcatttggaccacactcaaggagagatatgacaagtccaaatgtgatgatgtactctttttggaagaaccatttgaggaatgttcaacttcatcaccaaattgcgaagaacctcaagtgactaccttcgatgatccagataatcatcccacgtccaccttatcaacacatgactacattgaaggcaatgaattggtgagtaaggttgacgatcgtccaattctcccattggattccaacaacactgataatgaaattgtcatattgcattgtgttgttgactcatgcatctcacctagccccaagtatatgtgtgaggatgatatggataaatgctctacttcctatagtacttgtggaactaaccttttgaagggagaagtaaatgagcccaatggacaagtgaagaatccacctcaccaagatgctcatctttctatttccaaagatcatgctttctttatggaaaagatg

SEQ ID NO: 51510 - DNA, 1082 bp, Oryza sativa
tggtaagaggagtcaaatttggaagggagtccgaattcaggaagattgattaagataaggaaagagataagttggatacttgcaagagagggtttcctatgtgggttaggagttctaagttgtgttagattcgtggctatgcacagcctacctcatgtataaatagagagggaagatgaggcctcccggtatcgattttagagatactagagttgagagaaagttagggtttcgagtttagttcgagattttggtgaggagtgttgttggtgcactttgtaaacactagttgatgcaataatgtcaaaaagtttcaatctacatcttcgagtttgtcatctaccggtgtttatgggtcccgacggtctaaccgcaggtgtgcgtgcggtctgaccggtgggatagcggcggtctgaccgcaggtctacgggcggtctgaccggcgaggcttcggtggtttgaccggcggtaggagggcggttcgaccagcggtgatagggcttcgacgtctaattcgttttgagggtaatctttaattccgaaaaagatttttgggttttcggtttccctaccattcaccctcctctggtaggtttgttaggtttgtttggtcttgtgtgatcctacactcgcctggccccccctcgatttcgccaccacgctgtcaggaagccagccacgggggcatcgtcgtcggcgagccccattgccgaccgctccaccactgctgccctaccacggctagaatcaccgagcaagaagagtcgaggaagaatataagtgtaacatacgggtcccacttgttaacctctaaggctgtgtttgtttctgtgtgctgggaactcatttcccattcacggaaaacatagaggtccattagcgtgcaaggttattatgatttttttaagcaactttcatataaaaactttctgcaaaaaacgtaccgtctagcattttgaaaagcatgcacgtagaacacgaggaggtgggttgtgtgcattttggtttgtacgacaataaagactccatcctttcgcttattggcggaataagcgaaacgacatatttgcaaaaagaaaata

SEQ ID NO: 51511 - DNA, 5727 bp, Oryza sativa
ttcgctctcatggcctagaaattctcacattaatcggggagaaaaaaatgacagagtccatatagaaatacaatttagaaatagctgaaattcggaattaaaaaaaaaggaatattagaagaggagactagagtccatatagaagtacaataaaagatgactatggagtccaataaaaaataaggaatattagatgaggagactagagtccatatagaaatacaattaggaaatagctgaaattcggaattaaaaataaggaatattataagtagaggatagagtccatatagaaatacaattaggaaatagctgaaattcggaattaaaaataaggaatattagaagtagagtatagagtccatatagaaatacaattaggaaatagcttaaatttggaattaaaaataaggattattagaagtagagtatagagtccatatagaaataaaattagtagaaaaaggagcattcacgttcgctctcatggcctagaaattctcacattaatcggagaaaaagaaaagacagagtccatatagaaatacaatttagaaataactgaaattcggaattaaaaaataaggaatattagaagaggagactagagtctatatagaaatacaattaggaaatagctgaaattcggaattaaaaataaggaatattagaagtagaggatagggtccatatagaaatacagttaggaaataactgaaattcggaattaaaaacaaggaatattagaagtagagtatggagtccatatagaaatacaattaggaaataactgaaattcagaattaaaaaaaggattattagaagtagagtatagagtccatataggaatttaaaactaactaaaatttgaaaaaatataatgaaattaaaagtagagtttagagcccgtataaaaatacaatatatttataaataactaaaattcgaaattaagaaaaacatgggaagaagaatttaaagtcaatataagaatgcaatttagaagtaactgaaattcgaaattaaaaattaaagaatattgaaatatgagtttagagtccacgtagaaatacaattagaaataataaaaattcagaaataaaaataaataatgttggaagaagagtatagagtctatatagaaatacaatttacagaaaattcgaaattaaaaaaaagaaatattgaaagacgagtctagagtccatataggaatatatataatttacaaataactaaaatttgatattaaaaataattaataactaacacgtatataaaatacaatatgaatattacacattagtagttttgtaaagttattgcaaaatttaaaattatgttgtcattttaatatatttgaataatataataaaaatcatatatgctattatatgagagaaaatataatgatactagccgcgcaatctgcgcgggccaccatgctagttagaaagtaaagatatattcactttcgtgggatcacgctactaactaaaataatctaaccaaccagagtattaattcccagtgacaaaaattgtgatgtcaacaggtattccatgaattgtccgttgtcaaattccaattacgacataccaacttaccaagggcatgcgcacatagaattgtgctaaacccaccgctgtccgctctcggcttttctcatcttaccgtaggccaattctcttccttatatataatttttacgcgatttgacatcagaggatggagcaatttggcatcaggcttccacggcgaggccaatctgcatcacctgcccgctcgatccctgaaaatcttcttccgtttctctctggagattgctgacagcgaggctgcggaagcaggcgaggggttcagggctggtgactggtgagatcgatctctcatctctccgtcttgctatctttctccctatctctaagtcgatcattcctgtaaattgtattgctggtaggcttttcttgttacctttgctgttaaagccatttaggatttttctattgcctgtgacctgtttgtggaaatgcctcaaaaagatatcacagctcacaggggcaggattctaggttcccaggtgaaaagcaacatggaagagggaggaggatgaatctgagtttttttagagtatttctttttttgtatttgtaattggagaatttagattatttaccacctaattctcttgtaattgaggcattcattttctaaatcatatttcttttggctaactgcactatgagcacctgcaaacaccaaaaggtatactattagagcatgattttcatacatatataacagaagtttcagtaaagctctactgtaatcagattctgctttattgaattgcaatttctggtttagtgatacaggattttaggtgactatgcaataaggaaattcgtgcccttgtgtgcgtttgggggctgatgtttacaaaataataatcactatgttgaggatgttaaatggaacttgtttgctctttatatttagcattgtcttgcactatgtctcttaagggttatattatacgagttacatcatccagaattggactagaagtagaacttcatatttggaagtggaattaccagtctaattcggatcataatataacagtcatcatcccctaacaaattttgaccactagcagctacatggcacaggtaacaggtaatttagttcatagtatatatttgccataaggcatgcagatagggactaagcccagatcaattggtgagaggtgtggatgtacaccaccatcaccaaagttcagaaacctcttggactcaacttgggtctctatttcttctctattaatttgataccaagttcctttttagtatttgtttttgtgtcaatcaattaatcttcacaaatataacgcaagtgttcttgaatcttatataatatctttttctatgaaatcacccatttctaacaaaagttcactatttagccttaaaagtcatgtgctgattcattttccttccttatcgagtggcctatattgtatggcatccacaggtctgtcacatattttactttttttcagaaggctcagttcttacaactatggccgaagtacttctgtcaagttttgccgtgtcaattattggaaaaataattttgtttgttagtgaacacggtttgatggggattaaatcagacaggagtgtgcatcaagaactggggaagctacagaattcgttgcaagctattagtggagttcttctagacgcagagaggaagcagagtacttctagtgcactcaaggaatggctgcgaaaactgaaagatgtcatgtatgacatagatgacattttggacgatgcgtcaactgaaactttgaagcgcagagttagcaaagatgtggttactcaaaccaattgtgtacatatttctcgattgaaattgagaagaaaattgctcaaaaggaagaagaaatggagcagcagaataagagaagttcatgaaaagcttaacgaaatagccgctagtaaaaaggactttggactgaccgattggacagtgggtggtcagtgttctgaagaaccagaaagagaatcatattcttttgtgtatcaacctgatataattggaagggatgatgctagagatgagattgttagtaagatactaagagcagcagaacatcatgatatttttgtgcttcctctgcttgggcttggaggcattgggaaaactgaactagcaaatatggtgtatcatgatcaacaaatcagggagaggttcagcaagatgatgtgggcctgtgtctctaataaatttaatctgaaaaatatactacaagatataatcgagtctgccagtggtgagagttgcaagcatctaaacttggaacatttacaaaataagctcaggggaattctgcagaatggaaattatttcctggtattggatgatctgtggactcgtgatgtaaatgaatggagagagctgaggaatttgttgtcaagtggtgcaaggggtagtgtgataattgttactacacgcgaaaatgttgttgcatctatggttggtacctcagacccgtacaaggtgggtgcactcccttttcatgagtgcatgcaatttttaccagagttgcattcagacaaggtgaggaaaataaatatccgtggttgttgaaaattggagagtccattgtgaagaagtgtgctggagtaccactggcaataaaatcattgggttctctactatttaccatgcgtgatgaaactcaatggctacgtgttaaagaagaccacttgtgcaaaattgtacaaggtgacagagatataatgccagtgctaaagttaagttacaatggttttccagctgcccttaaaccatgtctttcctatttatccatatttcctaaggacttcgaatattacagaagatgcataatcatgttttggatggcacatgggctactgaactcgaacaaattgagtgaagaaatagatgttggtaatcagtacattattgaattgataggaagttccctttttcaagactctctaattacttttgatggaagcatgccacattgcaagttacatgacattgtacatgatcttggtagatatgttttggacacagacctagctgttgtgaactgtgaagggcaacaagtctcagaaacagtcaggcatctagtatgggaccttaaggatttcacacacgagcaagaatttcccaggcatttaatcaaagcaagaaaagctcgaacttttattagttcgtgtaatcatggttctttaagcaaaaaatttctggaagtgctgctgtccaagttattgcttctacgtgtattgattatatccggagttagaattgacgaactcccagattcaattggaaatttgaagcacttgaggtatcttgacctcacctggaacaaaaccataaaataccttcccaattccctatgcaagctcataaaccttcagacacttgatctttatcgaagtgaccaactaatcgagttgccgagagatgtaaacaagttaatcagcctcaggtacctgagtttgacatcgaagcaaaagcagttgccagaagcaggacttcgtggctgggcttcactaacatccctgcagcttcactcatgtagtgaactaacatcactgtcagaagggattggctcgttgactgccctacagatgctgtggatcagtgattgcccaaagcttccttctctcccagccagcatgacacacctctccagtctgcgagagctgttcatcgacaattgcccggagctggatttgatgcatccagaggaggccatggatgggctatggagtcttcgatcattgcagatcattggacttccaaagctagagcgtcttcctgacactctttgttctgcctcgggttctcttcggtatttattgattgagcaatgccccaatctaagggagcttccaagcttcatgcaagatctcactaaccatcagaggcaggggggtattcattaaggatttcccgagcataattatataaagggatgacaattagttgattactatctccccataaaatcttcatggaggtatagagcttatgctaaaagaaaagccccacaggaagtgaaataggtaagttgcattgttctctcagaaatttaaatctttataatttaatacgaattgcagtgtttgctagattttaggtttgggtgttaagcttgagtattctatagtgtca

SEQ ID NO: 51512 - DNA, 806 bp, Oryza sativa
tcccaatcacttgatttaagtatatatcaacataagaattatatattgttagtatctacagctgatcgaatagatttagttctttcttacgtattcataactgccgatcgattcaaatatgacatcggctcagagataaatgatatatcatcggcaactagccgaacggctatcatttatggatttaaccacgatttctttgtctttatttcttgttgattgcaggatcaaatcaactggcacgctcagatccaaaagcaatattttttggatctgcactggagttaagtagatctcctaggcctcgtgtttttctcatcaacacgcttttggcacgcccggtgggacccctaattagaagtcagagatggcactagaaaaacaacctccgccattaacagacaagtcgtcagagcctcaaaccaagatcctgaagctaactggggctgaagttgatgacggaaatgatgttccaatcactgtagacaagctgtcaccagagcagaagaaggagtttgaactgatgatgaaacatacacaacaacagttcatgaattcattcacagagactcggcaaggaagagttgttcagaagtacaagttgaaactagttgccgacgtccctggaacaggttcttctaaagatggtgaggtgcaaaaaacttaagttggtacagatgattcaggcaataaaggtactgctggtgaaccaggcgacaagggtgatggttttcaggagggagcagttgaagatcttggtccagatagcaaggactgcagccacaatttaacaattttcaggatcg

SEQ ID NO: 51513 - DNA, 2226 bp, Oryza sativa
cttctgctctagctgcacgagctgcaccatcatcagcacagacaaatgaccaatccacgattgcagatcagagaacagccacagcatagctggcaaaatgtcaatcggatgactcaggagcaggttgctgctatgttcttaccaaatccaccagcggctgatccagcacagtcgttgccaagtcagcagacaccgtaaaggaagctaatggttcagccgattcaacagcagaacttgcaaaatgcatcggctgggttaagaacacctgataatcagctaacacagcacgtggcaactcaggtttttcctgaacaattggttcataatgtacaaccagatcagtcggttttaccacaagttattcctaagcatttggtgcgtaatattgttgatgtaaaaacacgaggcctgggagatctgcttaactccagtgcaggtccaaaagcttgcctttaggttcgtgagcatgccagttgatttgttcttgcaatcaacaagaaataaagacagggaaaccgcggttaaatccataaatgatagccgatcggttaattgcgatgacataccatttatcttttagccgatgtcatatatggatcgatcggcaatcgtgaataagtaataaagaactaaatctactcgatcggctgtagttgttaacaatatacaatccttatatcgatataaatttaaatcaagtgattgggatagatcggtcgccatgccgagacagtataaatcacttagatcgaaatatatattaataaccggattatatatgtttataacatagccgatcagatagatctagcatgtatcggctaatactccgataccactttatattaagatattaaagcaagtaaaatacgtcaaacataagcctaacatatctaattacaacaagatcttgatgtaaagggcggatttaacatgttaatcaatcatgtaacgtaaaattagttaaatcaggtaagattggctgaaactccgatactactctaatgggcaactagaaagctggctagagattaatattctaagcacgacttagtagatcaaacttaactgatgcagcactaagtatgaaaagaagaacaatatctagacaatcaagccgctggatgtttcaaagagtggtggatatcctataaaatccaagccaacgttgctatttaacctaattggcttccttccgatgatagatgttagccgattgtaggttaaataatgatattttcgtggattatatagaatatatgataactcgatgaattacatagacaagattagagtatcataaagatggaagcactaatcccgagaacgcaagccgccataacaagttttacctctagttgaagatcgaaaccgatgtagctcaacccgaaagcaagaactcgtcgaaacaaagtgaaagtaaaagggtggcgatgcgccgagattgtattgaacgtgtgttagtttgattacatggggcttggggtctatttatacccgagattacaaaatatgtccgtgtcggacatgactcttatctctaacaaactctaagataccataagtctttgtggcagacttttgcccaaacatatctctaaggaaattacatgaaatatcctaattaatagatacaattgccttctcaagactcaatccgtgcatggcaatcctcatgaagcgcattaactatcctcgacaacgtgtaccgcatcacattgtcagactcggctcaatcggctaaccttgtccaactcggattccgccgatcctggtcacatccgattcggactttagccgatccttactctgtttccgaaacgatttccatcttggattccgcctcagttttatctccatctccgatactgaaattaccaaatttggttgttaacaaatttacatagtatacatacattctagttaaccgatatactagctaataccctctatccgatgccctccttgtacttcgagaagccacccatgactgccgagttccttatgacagctcgtcatgaccataaaaccagggctaaatacggaggaatactctccagggaattaacttaggattatatacaagcgcggaggaatacccgtactgagctgtcaccattagcagcccacctcatcatcagcatataaccaaaaataatgatatcccgtaatttagacacacgtcaaaactaccagatactaccctaataccatcgtcattacata

SEQ ID NO: 51514 - DNA, 1139 bp, Oryza sativa
aatggaggtggaccatctccccctgtcatcggctatcatgcccccaagacctcaagtctacttcaagggctaatcagagaaccaaccgatgtcagcaagaatagaaagactagagcatcggctatagacccatcggctctggttcccaagaagaaaactaggaagaacaagcctaagccaatcgatgatctacctaccttggatccatctatcgagcaagccctggatgaagaggaaattgaagaggatgttgacaaggctgcaggcgaagtaagcgatactgaaagaacaccattggcttcacccaagaagactcctccaactccttctactccagctcatttctccagggtaaacaactctccttgatcccttttataactacgttatttatagccgattacttataggcttcatagttgcaaaaaaagaaaactaatgtgaagaagaaatcagcagcaacaactctcaaaccggctccaccagtaagatgttcccatataaactctttcactaatcgatcataaccgatcttatctaacacttgtctcttttacagcctcctcctcctccttcttcccctgtacagcaatcatcaagtgatcaaactccatcggctgcagggagtcaccgtgtcgaagaagaggaacaactagccgctcctgccatcccagtaagtttccctttgacacaagaacttagatcggccatatctatttagcgtgtaactctctttcaattattcttgcaggccttagccaatatgttctttttcgacatcaaggactatttttatgagacagaagaggacaccaccaccaaagctttagctcccttatctgatgatgtgaagaaaactcttgaagacatccatcatcggctagaggcatcatctctagaaagtttggtggtagactgcggatcaattaggacttggctacatgaagttcaagctttggtcccagaagaactagccgacgtcctcactccaactgcttattttgaacaacatcaattcaagttggagaaggccaagctgagattagccgaacgtcgggagcgcaaagacatcgaagccacaatccaggccaattggcaacttgttcataaagagaagatccaagcttgatcagctatct

SEQ ID NO: 51515 - DNA, 6985 bp, Oryza sativa
cagaagagatttcatcaagcccatcaaggtgccaaattcaaacttggttcaagatatcaattttattgaatgggcatctcaaaaatcgacaaggaaggtaactcgatgatccatagcttgttatttaaattggtatgattggatcacttgccttgtctgtgcatctaggccaagtttcattccttgctaattagcctaatttgcaaaatgttgtgacgacatgcttgtttagtcaataagtgagtattagtcacaaagttgttctaagtgaatcaatgtgctcggagacctcattctatgtgaattttttatcttaacacaaactatgagattcatacatgcgaaactcatttgtgaaatgttttgtgaaaatcttgggtgagatttttttttttaaaaaaaactcttgaatctcactcgaatttgtgaagaagtggtttggcaagttcaaatctcgatgatcctcttcattgtatattatgtcctctccttaccatgcttaaataacaaagtaggagcgaaggactaagggggagggatacattaagttaaaaaagaagaagaatgtctttgacatgcaaagggtagactttcttcttctatgctttaaaccctttgcatgtgagctttctatgcgcaaaatatctcaatgcctattgatttacttgtgatctttatgtgaaattgatcttcatttcctaatcacaagtgatgaaatataaaattgagaggtaagtactcgatgatccctcatcaaggatcccttttcttttctttccttacttatgccctttttggtgttagatgtcaatgggggagaagtatactaaaggggataaagaaaagattgatcaaagggtgagatatttgtgagaacttatcgaaatgcatgctttaaagatgccatcgaagggtgagatatttgtgagaacttatcgaaatgcatgctttaaagatgccaaagagtaaataagaaagggggagagtatttgaaagtgtttatcaattgttgtgaatgcttattatttgatcaccatgcctcatgcaattgagattatcttttaatacttgaaattgttagtgtgttgttttacttttggtatctcgttcacacacaatacaacccacgaatgcaaagagttagggggagctctctcattttcaaaaatatgtgcatatgtgctcacttcataaacttgtatgcacacatttaggggagctcaaactaacctttggattcaaaatcattttttattaatcttttgtaagctttaatcgtgttgtcatcaatcaccaaaaagggggagattgaaagagcatctatgcccctagtgggttttgtgtactgatgacaaacgattaagggattaatgcacttattgagtgtataagcaagtgattagtctgatgaagaagctaggaaatggacttatcgatggattataattaaagagaagatgttgaacatgcgggtatgaagtgactacctatcgcaagacggtgaagcgcaagcgacgctcagctgcgatggaccatgcggtggtgaagggcaagcaaggggcttggcgcagacaaaccgaaactggtggtgaagggcgagtgaagactgtgtcgtgatgaaccgtgtgaggccatttgaagccatggattatccgcattaatcatttgagaaatggaaggcgaaatctaaaaaatcaagaagatgagatcttcccgatgatcaaatgaccttgacattggtaaccctccaagtgaagaaacaatatggtgtgaaggtactcctattggtataactttactttttaaatttgagtttaggatgccgtactattaagagggataccacatgcatataattggttgaatactagtgcataaaatgcttcatctttgtgtcaaaacacttatatcgggtttctttgcaagtttttcaacatctcttgaaggttttggaccatgttttatgttgggtttgatagcccacgaaactagctttccatagagtccaagatcttcgaaatcggagttcagagtaaaaagttattgcatttttacttgagcaacatatgactatccgatgtatcggactatccgatttttcacagaacttcactctctgtcttgatatgaaaaaatcctatcgaatgagtttttctaagtatcagagtatccaatgtcggatcagatagtccgatgacacagagactctgaaatttcatggaacttgagtctctgtttgaggacgaagtttttgcttctaaaatatcggatactccgatttaacatcagatagtccgatgtctcggaaagtccaaaatttcatagaacttcgttctctgtttgttgttgccttggaggtttaaaatatcggactatccgatattgtatcggactatccgacgtgggctgaaagattcccctcgaacggccacattttggggggatctatataaacctcccaccaacccttttctagggttgcccaaactcatttcattcaaatcttgttttgggttgagctttgtgctaagtgctttggatctttgagctctctccctctctatctcaaatcccccttgttctttgtgacctggatctttttgtgtggatttggagtttgggagtctagtgtgtgtttcttttgatcttgagcactaagatttgtccaagagttgtgtggtgtttattactcttggaggttgaggactcctagacggctaggtgtcgttcttgggccaccgatctacgtgtggttggccaagagaagtttgtgaaggccggatctcgcctccgcaaggaaagagatacccttagtggaaggaggagtgcatttgtgcaacctcacgaggatagggttgaaaaagacccggctctttgcgagcccctcaacggaaactagaatcccctcaattgaactccgggaaatacatcgacgcgtaaacctcggtgatattctcactctctttaccttcttgttccattgttttgtgctatgctaatattgttgttggtcgagctcacctctttgcttgtggattgaatctagagctcttaggttgttctcttgtttgtattattgttgtgcaggtcagatagtctgatctcagttcagactatccgatcacataggactatccgacctgatatcagacaatccgaccctattttgttttagcttccgcatttattttaaaaaaccgcctattcacccccctctaggcgacatcaaggtcctttcaaccatgaatagagtacccactagttgggttttatttattctagggtgaacaaggtaataataacaatagcaataataataaattcatgacaaaggtaaataggcatggctaaataaaacagtgataacgcaggaatttaaataaagcgataatgcattaatttaaatcaaaataattttataaactgggattcaatatgctcaatgatgatatgacttgccttgctcagagagaacggccttccgaaccttcggcgacgaccgcgaaccacgcttcggaaacctctagaacaacagaagctacgcgaagcacacaagcaaagctacaagcctataaagaagcaataacaatacataaaaagaaaagcacaaggttctttaggttataaaaaacattaggagacttgaacggttcgattcggagttcgtatgaccaagatatgatcatccgaagtttaatgttgttacatggagatttatagattattgtaattaggttttgcaactataaaacatgtgtaagcgctagcctggaaaagacaggaaggctgcgctattgacatgcggaccccacatgtcaacctaagggaccacggtagaccgagtacacagagacggtccacgggtcgacggaagcgtaccccgtgtgtcaaccgaggcaagtggccgacaaacggactccactagacaccacgtgggctgcacatgtggaaaccatgcggctaccgagcaggcacactaacacggtcaccacacgcacacacaaacgactaccgacaccggtacacgggtaccggggtcgacaaccgcacaattgtcacgggcgacaccgaaaggacgaggacgggggcagcgagaggacagacccttaccaccacgcaacaaggcgtgggaacgacgacggcgaatgggcgcggcggagatggctcggggacgacgtaggcgaacggcgagggaacgactttggcggcgatccttggacgaaggcgagacaaggccggcacaaggcttgacgacgcggagccgaggacgaagacgacgacggggctgcagcggctcccttgacggacgcggacgacgaacgagcacggcttgacgaagggagggccgacaacaagcgcaaccgggaacgatgagaggacgacgacaaagaccggcggggttcggatggaggggaggtgaggccgaggacgaccttgccgctgtgatgccaaaggtggtggaggtgcggccgaccgttgcaagggcgaggaggaaggggcggccgaccgttgcaagggcgaggaggaaggggcggccgaagggactggcgagagggcggatgggttggcggcggcttgcagcggttttccgggcgaaacagaggagcagccagaggaaaggacgacgctgcgacgtcgacggaggagacggcgacgtcggtcggtgctcgggcacggcggaaggggctgctggaggtgatgcagtggcggcaacgccactgtttaccggtgaggacgcgtctccgatggtttccccgtgaaacggaggcgacgccggggaagaggatgcacctgcgaggccgagggtggcgacagcgcaaccggacggtgcacggtcatggcaggaggtgcggctggaggtcggccggcgccggagagagagaaggagaaggcggggagaggcggggcggccacgggagagcgcgggatggggctaaaactggagaacgggccgagggggttccattttttagatgaggggagggagccggccacgggggaggtcggaaggaaggcgggaatggcggccggcggccatggaaagcggctggggttggcgcgttcgttcccggcgattgggggcacgaatcaagagggaaaacagaggaaatcaaagaggaatcaatggggattaaaaccccccaattaatttggaaagagccggcttgaatggggtggatttggaggaggaatcggcgctagggttcacgggtgagagaggaggccgtgcgggaggaaggagacgaccgggtgggtgggacccactggtcaggcgcagtcagcccgcgtgcggcgtgcgtgagggtcgctggagggaggcggccgctcggcttgggccggggcaggcccaggcgggaggaggagaggagggagtgggccagccgggaaggagggaagaaaggaaaagagagggagggaggagagactttgggtcagctttggcccaaaggaggaaggaggattatttttagtttttctttttaataaactttgttaattgttgttgttgcttaataattatttccggcgttctgaaaatttaagtaaaatttgagagctccttttagaccaaggagaatttaacaaaaattctccgggccacattcaaatttttcttgtatgtattttagtgtttgccaatttcttttcgaattttaattaattctattattccttttaaagaataatttttatttcgggatgaatttatcaggacgtgacaactgagctgtcaccatcagcggcccacctctcatccgcagcatataacaccaaataatgatatcccgtaatctagacacaaatgtatatagaaaagtattctaataaaagcacaaagcttacaaaagagaagagaaaagctactagagccatacccgaactcttccgaagactttcgtactcctgatttctactctattcctattccaccagctagatactactaaactaaacttgtgagaaatgagagagatcttgcttgaggtgtgtgagtgaagtgagaaggtgaagtccatatagaggtagttatgatggttgtgaaaggggaattgttcgaagtgccctccaaccgtcattgggatgcaattttggacgtccacgccgaaccctgcatccaacggtgccaggatgggctgggccatcctggcccatcttcgggtggcggcctcctctattgcttcactatgcagacttgtaaattttggcccagatcatcgtgttaactttgagttcttggcctattcatgcataaatctgattctcgacatcgtccgattgattttatcgtttgtgttgtcaaaatgacaactgcatacatcgaaagacatatttactcaaaggtggttggaagaaaacgaagtgtattgaattttgatttttcacttgggatccccctattacatggccctaggggactatttatagccccattacaggttcttactactagggtttaggttatacaggggaatttacatgattacccttacgaaagagacatttacaggggtacataatgttataggggctcatgggcccctgatgggccgtctggcgattgccggccctatagcccctaggcttgatgggccggaaaggcttcttcagccctcgcgggggcgaacttgccaaggcgaagtcgccttccttcggcagatagtcttcgccttgcacccttcgcccgagacgcctctggcctggcaaggcactcgtacgactcttcgcctcacaccgttcttgctccatagccttcgccacgggtttcggcagatgtggttgaagggcctcatgccatccgccaacaagcctctcacgggcaagggtgagattggagcttcggccgagaccgtgcaaaccatgtggtatggtatgcggcgccccctttcgaccgatgctcctgccgaaacctacattattctgcgaatgaagtttgttatttgtgcggcttgtattattttgccgcactttgcctcctgcgttgggc

SEQ ID NO: 51516 - DNA, 4341 bp, Oryza sativa
  unsure (1)..(4341): unsure at all n locations
ttcgccgtctttttggaggcagggctacggtttccctgcaacgtgctattgccggagatccttcgcctcttccaggtggagcttccacagctgagcccgttggcgcttgttcggatcgctatcttcgattgggcgtgccggacttctgggtttgagcctaacgccgagctcttcggcgccatattcttcgccaccgtgaactcaaagacagcgattaccccggctgggacgaagaaaacagtgttcgggagcgtgaactttaacgttcgtcccgagcggtccgatctctcaccggtgaacgctgccatgtcgaagtcggaccgccattggatagctcggtggttctatcacaccatccccttcgaggctggctctgacttggcgaaagcccttcagtgccggcgcaaggtgatcgcgccgaaccggaaacccaagatcgccgtggatggtgctatggagacgcggttcgtcctgctgcgcagggtctgctcccgccttagctgccgtgacttggtagaggaattctgcatacttcgtatctttcccctttcccaggcatggcaagtcacggttgatcaaggcgaagaggttgacggtttgccgaacctgatccttcctgaggggacgaacagtaagactgttctcttgctatatactgttgtgctttgttattttgccttgtctgacttttaacatagctacacacttttacttttgcagtgttgaccctcgaccaggctgaaaacgaggcccgcaggatgatcggcgacgtgtcggtcgtcgagtatagccagctgctaacacgacaagcggctgggcgggcgaaccaggtttacaacggcgaattgcctcctcgggcaaacccccacaaagcagacgacaatgcagggccttcgtgaaagcgaatgcgcggacaagtgaagcttgcccctaggaagcgaagggtccctgcttcgtcggactccgacgccgacgacgaggacgataccgaagaacgcgacggcgaggagaaaggagaggaggaagaggaggaggccgtggctgataaggccgcgaaagagacggttgaagaccgcgtcgatacccccggctacactcctaccccaagtccaggtcacaacgagaccggggtggagtcgaacagctccccccttcgtcggaaggatttggaaggggcgaaggctctagttgcgttctcctcgggcaaggtggcgaagggaggtccggtgaagaagatctctgaaaagaaaggactcgtcgacatcgcccgcgttttcagcgacgacgagtcttctgacgggactccaacttcgcccgctggccgcagcttggacctttcgactgctcccctcgctccgctaggcgctgctggggcaggcagtaacgccgccgccggggcttcagcctccgccgaacggatcgcgtcgactgcggcgagggttttcgggagccctctgcgtgagccagctatttcgccgctagtcaaggcgaagtgtgcggccgccaaaacatctgcctcggagtattcccttgcagcgccccacttcgcccctggtgatttcgagactcgagcggacctttttccctttgtggagggggttagcaaccttgtcttgctcgccggcaccccgagcctgttcaccgaacttaacgagttcgggtatgccttttcttccttcttcgttttcctcttcgtccctctttttttacgtctcacaattaaccttttgttcctttcgcccaatcctatctttcatctagattcttgtggctcactgttcgacggagcgaaccatgcgggcccgttttgacggttttaagagccgtcttcaggccaaggacgatgaaataagccgcaagaatttggaggtggaggccctggccaacactcttaaggaggcgaaaactgaagtcaaacgccttcagtccgagctagataaggggaaagaggccagggccgaggttgatcgactcaaggccgaactggagaaggagaaggcccattcggcggtgctcactaattactacaatcttactgagccgaagatggagctcttcgccagaaggctagcagggccgaagcgagcacccacggaggagtcgcagcggttttcgtgggagatggcaaagaccgccgaatccgcgagaacggcttgccaaacgctccgcctcgcccttaccgacatgggcgcgaaggtgcggggggtccctgccgaggatgcctcagccttcgacttctccgagtggacccagcaggctggcggatcggtttcggactgcgccaccgcgtacggcgattgctgtgcgcgtgtatcggcggccttcaccttaggccttttgcagcagttcggctgcgagcacgtcgcggagttccctacctatgcgaagggggaatgggagattagtgcgcagaacatttcgcccgctcttcgtgcgtggcgaaaacagttctggcagaaagacggccggtccgctgccaaggcgcgccttctggagcaactggcgaaggcgaaggcggcaggtcggggcgaaaaaaagggcgcggcgggcgaagaggttggaggcgatgcccaggatcacccagaggtgtgaggccctccgccctttctttagagttttgtagttttcctccctcttttgcgttcacctagagaggcaaatgatgtacattcggcaagttgccaccaaaccttaaaaaaggcttttttctatatttggaatgtatgacacaatgttaaatacttttttaatgatcaaagtctttggcttattatttcgctcatttcgcatcatgccataccgcccccttctttcgcctaatcctactatataagccgtgttttgctttttctgcgctgtctatcagggggttcgccgaaagttgtgcattcggcccccttccgggagctggcgaagccaaaacgagaaatttgtggcattgaaggacctgccgaaggtgcgatgtccatttcaccctgtttatcacgaaatggagataaacggtcggagctataaggttttcaaggttgccgactggctgcggtcgcaccccgggcgaaccttagaagattacgatcttgttcattcaagacgtttggaggatatggctcgcttttggcgaaaccatcagaggactaaacgtcaggaaacgatctttcagcgtcgttacagtttagtctgtgtttcgccccctactcctcttaagattgtgtatgatattagtagtgatgacgaacctagttcgcctgatcattccttagggagggatagtgattatgggggcgaagatgtaatttacttgtaaggtgaattgtatcgtgttgtgaaacttctattcttccatttttttcgaagttaataaagacgtgttttatttccttttcgctattgtttgaatcgtcgcattttgtgcttttgttaggtcggaacatgccggcccctttgcgtatattagcgaaataggtgtactgacttttaaccttttcgttgttcgttttcgatctgtagcgttctgtgtcgaaagaaacgcttttgcttttatgttgatcgaacgtaacgtcgttcggctagttattttcctagacaagctgttgcggtttcaacgttcggcaagcgatgcttcggccgattcgtttcgcccccctagcgtttttcgctgatcaggcgtttgccttggggtttttccacaaattatcaatcacacgaaaaataaaaagaaggcggaggacacagagattttatactggttcaggcctccatggtggataatagccctacatccagtttttttttctcttttttctctctttcttctttttttgtgttgccgaaaggcttacatagtgccgaagggcttacatagtgccaaagggcttacatagtgccaaagggcttacatgatggtatgtacatttttacaagttggcgatttgggtgccacccattctagacatagaagcgcttgagagagttggcgttccaggaatggtcgaactcctcgccttcgagtgtcgctaggcgaaaagatcccgtcctggacttgtgtttgatgaggtacggtccttcccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51517 - DNA, 2712 bp, Oryza sativa
agtatttcttcaagtacttgccattgagcgctcgtccataaacttctccatcaagtccttgtagcatgtacactcctttagacacaaccttatggatttgaaaccgtccttcccaattcgatgaccacttgctgaatttattatcacgagttcctatggcaaaatcaactccaaacaagttctccctgagaaaaagatttgggcaccacttttttgttgtaatgttgagcaacgcgttccttatccttggtaacttttgcaagagctctcaacctagactgaactaagtcttccctttcatcagccatgagatcataatattcatcggctgttaactcattttgtaattctgttctccttgagccgattcgagcttcccatggtaaaaccgcctcatgtccataaacaattttataaggaggaacttggatcgaaccgtgacaagccatccgataagaccacaatgctttggctaacctagtatgccattgccgaggataatcggaaatctttctcttaatcaacttgatcaaacttttgttagatgcctcggcttgccctttagcttgtgcataatacggtgaagaattcaacaactagatacccatgctatcggcaaactgcacaaactcatcggacacgaagattgagccttgatcggttgtaatggtctgaggaatgccaaatcgataaataatatgctcttgaacaaattggacagcatcccccaaatcactttcttcaaaggaatcgcctctacccacttggtaaagtaatcggttccaccaatataaatttgcgtcccttgctcgaaggtggattaatcataccgatcatatcaattccccaacctctgaatggccatggcttgatgataggattcatagccaatgccggtgctcgttgaattgctctaaatttttgacaatcttgacatcctttgtaatacttgaagcaatcttccaacattgtcggctaaaaataccctgcacgtcaaagcaaccacttcatcttatgagccgattgatgagttctacaaattccttcatgtacctcgcctatcgcaaccttggcttgatcggcactcagacatttaagcaacaacccatcaatcgtccgataatataactcatcatccaacaaggtgtacttcaaagccttatagcgcaatttttgagaagccgattgagatggattctgcatatattgaaaaacatcatgtctccaatcaccggctattattgtggcaacttctacatcaatatcttttgttatcggcttgtatcctgatgctccctgagccaaatcattagcttcaacattttgctctcgagacacatgttttaaagtcactagcggaaacccatccatcaactcttggcacttctcattgtagaccatcagtgtatcattcttacattcatattctcctgccaattgactgatcaccaacaaggaatcacccacaatttcgatagcatcggcttcaacttccttaagcaactgcaaccctttgaggaccgcttcatactcagcctgattattagttgcataaggcttaatagtgtaggcaaactcgaaacctgccccccgaggagaaattataaccaaaccgataccacaaccatgagtgcacactgattcatcaaaaaataaagtccaaggcacaatttcaaccgagccgattgagacatcacgatgatccacaataaaatcggctatagcttgtcctttaatcgccttcagtgactcataccgaagatcaaatttcgtcaaagcaaatatctactttccaacccttccttttagaatcagagccgataacataaacttgactacatcggctttgcatatcacagtgcattcattggacaataggtaacgccttaactttgtgcaagagaaatataaacacaaacacaacttttccataggagaataccttgtctctgcatccaaaagcctacggctcaaataaaacacatccctctcctttccctcaagctcctggatcaaaactgagccgattgacttgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagtctaaaatgcgtaaataaattttagtggaattttcagagcacaaataataattattaagaaataaacaaagttaaaatggttttataaaaagaaaagctctaaaaagtcccttttccctccctctccctcttgggccggctcggcccatctccctcccctccctctcctctccccgcggcccatccggcctctccccgcgcgcgcgccgctaacgggcgggcccgcccgccaccctcgctgacgggtggggcccacccgtcatccccttcctcccgccgctcccgccgcctcgcccgcgccctagcgccgacgccgccgcgaatcccgccgcctcccgccgtccccgcgtgcaatcaataggggggaattattccccgggatcccctccccctttccccccttttttccctccctctctccctcggattcatttggaaacctctcccctaacctcgaccgcgctattaatggcggccgggtctcccgcgcccatttccccgcccttccgaccggcctctcttactcccaaaccta

SEQ ID NO: 51518 - DNA, 4224 bp, Oryza sativa
tccgccgtcgccgccgagctccggtccgccgccgtcgtcgcctcggaccacctcccacctcggcgccgctccttcggcttcgccgcatcctcgccgacctcgtccacctctccgtttcggtcgccgaccgccggagcaccatcgaccccgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatggccgccgccggcgactataggggcgcgggtgcgccgcctcccgccggccgcaccgacgtggccgcctccgggcgcgcctagcggctgctgcgtggggcccggctgtcagccgcccgcgccctcgggtgcggctgacgcgtggggcccacggcgccggccggtgtgagccgggtgcacccggtccaccgtggaccgtggggctgccgcgtgggccccactcccgtggacccagtccgcgcgcccctcccctcggctgacgcaataaaccctttttaaaattaaaatttaaatgaagaaattcgcaaatattcatttaaagagcatataaacttcaaatggccatatcttagccatttgaactcggaattggaccgttcaagtctctaatttttccttaagaagtcaagaacctatttttgtgctttctttcagctggttatacggattttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcactattgctttatttaaattcccgcgttatcactgttttatctagccatgcctatttacctttgttatgaccttattattgttaatgttattatttgcttgttcaccctagcataaacaaaacccctactagtggacactctactcatggtaccactagtaggattttaggtagatgcttcgctggttaattaggcaacattaggtggttttacaactctagactgtgggattttctcatcacctggacactatggaatggttggattattgtggaattggattcacaccgccccctctattcaaaatccccaaaatggttttaggctggactcggggtgcatggttttgatagtagcacctcggccatttaaggaccgttcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcacggtagtcgagatgtcatggcacagggccggtgtcctgctgctaggggctcagtcctgcctacctgtcccgggggttctggccgtaggtggggttgggtcggtactcttgtctatggctaggatgggttggaaactatgtcacgtcttccgtccgtataccgtggtggtatgtggcacgtggctacacgtgaggaagatgtgtcttgtgggtaaagatgtacacctctgatcaaagtataatctattcgaatagccgcgccctcggttatgggcaagccgagcaatgtacccaagttagtgttttaattcttaaaacctgcttaacaactaaaaggtggaacggatggcctgggttggcttgggacgagctgggacccagggtcgggttgccagttcggtctgaatcatcgtaggccttgggttaaggcaggctcgtgtgggttcacggccttgattaataatattatatagctctggaaacgtgtttacaaaatagctttgagcaactaagtgtcttttaatgctgtttactgcaaaccctaaccctttatatcataacccccttgtactcctttacatttatcctgcacttgtgggtgtgtcttgttgagtacagtggttgtactcagtcttgctcaatttttccaaacccagaagaggagtccctggaagatgaaggctttggtgtctagctcgtgcctgccgtcaagcgcctgtggtcgttgccctagtcttccgctgtttctcgtttgtctttgtgtgtgctgggccttcgctgcccatgtaataaattagctatttatgcttccgcttgataaactctgaaatgtatcaacttttggtgtaccttgcctcctgggacaaggaataatacacgcacgtaaggaacgcccgttgagttaattccggtcgtgacatgacttctcaccggctgaaagatataacctgaaaggtatccccttctgtggaggaattaaaactggaggagaactaagatattctttaatgttgtccaaagctttctgttgctctgccccccaggtgaattcttgatcggctttcaatctcaacaatggtgtgaaaggctctatcctgccagataaattagagatgaacccttctaatgaaatttgtcttgctgatcaacttctgcaacttcttcttatccttcggaggttgaatcttcttgattgcattgatactcctttgagttatctcaatccccctttcatgaacaagaaatcccaaaaactggccagccaatacgctaaaagcacactttgtcagatttatcttcaggccatattttctagttctctcaaaaacctacctcaaatcggctatgtggttttctattccctttgacttaacaaccacatcatcaatataaacttcaactaaccagccgattagatcgtggaaaatgtaattcatagccctctgatatgtagctccagcacttttcaagccgaaagtcatcacaacccactcgaacaagccgattgcaccaggacatctgaaagctatcttatgaatatcttcttctgccataaaaatctgattgtaacctgcattgccatccataaaacttaatatcttatgtcctgaagcagcatcagctaactgatcggcaaccggcattgggtactcatcttttggagtagctttgttaaagtccctaaaatcaatgcacaccctgactttgccatttttcttgattactggaactatattggaaaccagcatatcggcatggaggaataaaaccagcatcatataaacgtgtaacctcagccttgactgcctcgagcatatcggctttgcatctccttggcggctactggtatggtctaacccctggtttaataggaagccgatgttcgacgatcgatcggctgagccctggcatctcataatactcccaagcgaagcaatctctatattcttttaaaagctctatcaacttggttctaaattcaggagataaattcttactgatgaatgtcggccttggtgtatcgcctggacctatatcaatttcttccaaatcattggccgacatgaaaccttgtccttgcttgtcatcgagatcatctaccgtgtcctaggtgtagacgtttgaaccctccagacgccctcaaaataataattcgggctctccatcttcaattggctgtacatcacaatcggacacttttagaaaatctccatcccaaacttttccagataggcaatcaataccatccatctcccaaagagctaaatcggcactggcaacgttaactgacctgtcggctggcacgatcttaatcttgtcgccctgccattgaatcaagcattggtgcatggttgagggaatacaacaattagcatgaatccaatctctcccaagcaacaagctataggaacccttcctatcgatgacaaaaaatgttgtagggacggttttgctgccgactgtcagttccacattcaaaactccttttgtttctgatggattgccaccaaagtctttgagaaccatatttgtcttgatgagatcctccgaattccggcccaactttctgaatgtagcatatggcatcaaattcacaacggccccaccatcgaccattatcttagacaacggcatcccattgacatagccattaatatacaatggtttaagatgccgattctctttcccctctggtttctaaaaaacagcttattctggtgacaaaaccaatttagcagaggcttcctcaacttcatcaacatcgact

SEQ ID NO: 51519 - DNA, 1150 bp, Oryza sativa
agggttagtccacataggttatgatcagagttgaagaattcatagagaaaatcttactggtggagctggcttgggtggtgctgctacagatttcttctttacagcagtcttctttttctgcaaatacaagatttatgagtaatcggttacgaatataataattgcaaaaggaaatcaatgtgagatgtttacccttgagaagtgagctggagcagcgggagttggagcagtttgcttgcgtgaagccaatggtgttttttctccttcactcaactcggctaccgcctaatcgacatcttccccgatttcttcttcatccaaggcttgctcgatagatggatctaaggcaggcaagtcatcggctggtttgggcttatccttcttggtttttttcttgggagctaaagccgatggatcaatagccgatgttttggttttcctcttcctacccacatcggctggttctctcatttgcccttgaagtagacttgacgtcctgggggcatggtagccgatgacagggggagctagtccacctccatttggtagaaggcttggagcatattctatgtccctgccacggttgcttttgcgaggaggggaggattctgctgtctgtcgaaagagggaaaaagttagttaagatttaagtcgcctaacaattattcaagcaaaattgacaaagtaaagatgtacctgagggacaacatccggatatagatctgtcatgtacatagaggctggctgatggaatatatgttgcttccattcaccccaccatctgtcaaggttcttactcctgaaccttgccagctctatgttctatatactgcctaaaggaggtcctgggatgttgatcagccgatcaatcatcaacattgatgagatttctcctctgcactggatcttatcggcaaagaacaagccgattggtagctgtcccattccaaactgcctagctgagcttattggatggtagaactcataagacacctgtatgtttctcccttggtggatgtcaacagaaaggatgcatggactaatggcagccgagaagacttctttggactagtaaaatttcttagagttgatgtcttcgaatctgaagtccgatggaaggtcgaaattcactgaatcctcatatggaaac

SEQ ID NO: 51520 - DNA, 2806 bp, Oryza sativa
aacgtttggtatagatagccgagaaggattttgcccaggggaaactgcctcttggtttcaagggctttggctaagaattgccagttggtggtaggaccgtagcttgatctgcaaaataggaacttctcaagccacatcaaaaggaaggcagtatgctctcgaggggtgacagatcccttgcccatatatgcggccacatagccagaccaaccacctatgctcttggtcctaaaatcaaactagttcttggtgttcaagctcatagggttagccgatgaagttacatctaatccagtaatcatagtgatgtcaataaggatagagaagaagaaaaaaaagatgacaacaagaagagatcaatctatagggtaaaaaagagtatctagccgatgggtacttacctctgcatactcggccgatggcgtggcagacgggctggcggaactcgacatcgccgcgggcggaaatttggccggagaggaaatctccgtgggatcgcctagtgcgccgaggggatcgccgtggagagagaagacaaagttggcttaagcggtgaaaaaggaggtaacagtgtgaaatttctcggggacgatggttagtatttaaagcgaggcggtaacggtcggaaaaacggcaatgagcgatattcttggaggaacggatatggcaattccaaaacattaccaaatattccggacttggggggcatgtgttaacaaccaaatttggtaatttcagtatcggagatggagataaaactgacgcagaatccaagatggaaatcatttcggaaacagagaaaggatcggctaaagtccgaatcggctgtgaccaggatcggcggaatccgaggtggacaaggtttgccgattgagccgagtccgacaatgtgatgcggtacacgttgtcgggttgagttaatgcacttgatgaggattgccatgcatagattgagtcctgagaaggcaattgtatctattaattaggatatttcatgtaattttcttagagatatgtttgggcaaaagtctgccgcaaagacttatagtatcttagagtttgttagagataagagtcgtgtccgacacggacatattttgtaatctcgggtataaatagaccccaagcctcatgtaatacaacaacacacgttcaaaaacaatctcggcacatcgccacccttttactttcgctttgtttcgacgagttcttgctttcgggttgagctgcatcgatttcgatcttcaactagagctaaaacttgttatggcggcttccgttctcgggattagtgctttcatcttcatgatactctaatcttgcttatgtaattcgtcgagttatcatatatcttatataatctttgacaatattgctatttaaccttcaatcggctaacgtctatcattggaaggcagccgattaggttaaatatcaacgttggtttagattatataaggtatctaccactttatgaaacttcaaatggcttgattgtctagattttgttcttcttttcatacttatagctgcatcagttgagtttgaccttataagtcgtgattagaaccatgatctccagcctgctttttagttgccgattagggtagagtcggggtttcagccgatcttacctgatttagctttatattttatgtgcttgattgatatactagatctgccctttacattaagatcttgttgcatttaagtatattaagctttttgtttgatatattttccctgctttaatatcttagtataaattggtatcggagtattagccgatacatgctagatctatttaatcggctaggctatgaacatatataatttcattgttaatatatatttcgatctaagtgatttatactgtctcggcatggcgaccgatctatcccaatcacttgatttaagtatatatcgacataagaattatatattgttagtatctacagccgatcgaacagatttagttctttcttacttattgaaaactgtcaatcgatccaaatatgacatcggctcagagataaatgatatgtcatcggcaactagccgattggctatcatttatggatttaaccgcgatttctttatctttatttcttattgattgtaggatcaaatcaactggtacactcatagatccaaaagcaagatttcttggacctgcactggagttaagcagatctcccaggcctcgtgtttttctcatcaacaatattagaagtataggaatagattttctttctattttctttccacttagcttagataatatatcatgagaatgagtagttaatgcttgtgtgtcactctacccttggattatcttaacccctacttagaatatgattatcacaactaatatataaattattagtcaagttctctctacataatctttccacgggataaaataaatacaatacccttggaatactctcaggtgaaatgctacaatggtatatccgtgcgcttgtggataaactctgtaaccataatttatcaggagtatttctgcgccattgctaggaattatatttctagtaatgtcattaagaaataccaacacaccattggcaaaggtgggcgtgatggagtatggatggacctatatttttgtctatgctacttccggatttacctaggcccatcggggattgctcatcgcctgtatagggatggggatgaaaccgggggtgggtgtgttggttaggggtggttatatggagggttttgtcgcgatttcccccttcgcagtatcgtgggggtacttcagggtatggtaacatgtgtggaa

SEQ ID NO: 51521 - DNA, 9932 bp, Oryza sativa
ggtttgggttgggcctatcgcaacgtggtttagggttggacaatgatgatgttaatattgcttaattacctactgttttactgctttcaacttatgatttaacaatgatgatgttaatattgctttcaacttaattaccttccccttgttatgacttgttgagtacggtagttgtactcagttttgctttatttttcccaatcccgagaaacagagaatctatcgaatggtgagttctatgaggcttgtgctagacgttgaggttttgcctgtggattatggagaaagcttcgctttgctgtgaagattatgttttgatggtctttagtttttccgctggttttctgagtttattttatatttttgtaagacgtggaactgtatcaaattgtcatctatgtactctagttgatgcttggatagacgttaaatgcacagatagccggtgattcgggttgtcgaatctcggggtgcgacagtcaggttcattgacggtgttcgttcaactcttggactcggatttggagagctccgacagttctcccgagggtatctctcctccttcccttgacatcttcgtcgtgctaatgatggaggaggctaaagctaaggcacgcgaatgtgaggctgaggggcgctgactgaagaagcagcaggacgacctcgataggcaccaagaactgcgtcgtcatgatcgggccgccagtgatgccatactccaaaccaagatgggggcgcacgatgttttcatgacgccccaacacaacatagttgtgcccaaagctctagtcaacaccatcgacttacccgagaaccccgtcctcaactcgtcatggcctaggtgaaggctatggtcgaggctactgccatccaacatcaagagatggcgcctaccgtcgtctctaacatggccagcgagtcatccaagcggctgttggtatttcttaacaacgttgttggtatttcttaacaacgttactaagcaacttaacccctagcaatgatgctagaaatatgggcggtaattatttacatttacaaaaatgaatctgcaagcgcacggatttaccaatgtagcatttcatcccggagtataccccaaggtattgtatttttaattcatgcctatgacagatcaaaactgttggtatttcttacgatcatagatagaatccacaaacgcacggatataccgatgtagcacttcccctatggagtattctaagggtatcaaatccaagggaacgtgtgtgattaattcatcctccggttaatccaaggacaccaagcgaatgtaggtagatgatagagaggatttcctagtgtgaaacattgtctagggaaatattaattttaattctaatggaatacttcaggcactagcaacccgctgtttccagatgtcgctctactccgtacccggacagggaggacttaagggctcttgagggctgtcaccacctctacacccacctcaaacgtactgtgggatacgcaacaattactggataataattacctaaacaccacgtctaagcaattaatatctactttagtgtttataactcaccaaagcaatcactatattttagttggttgtagtgaacaataatcccgtatgctaattaggaactaagagataattctcacaagataaatccaaattactcaggaagataattctattaatagcagagtaataaacagaatagacgaaccaggagaagattaccgacagctccggaattcctccgacttgttctactctactctcttactaattctagtatacaaatagtacaatagagtctcttgtaattcagctcaagcttgaaagtgtgtgtgtgagtgaatgagtaaagctccttaaataggacagttaatgacggttggcgaatgggaaatgtccgaagtgccctccaaccgtcatcaggggtgcatctgggacgtccatgccaaaccctagcctaaacggctgagatgctggttcggccgaaccttgcctggctaggcccatccggcctggcttttggcctatctcccccactaatcctgctctatccaattctcggagttttggaccgattctctagtgttttgataaagttcaaaacccatccttgtatggatatgtttccttctccactccagtctgattttcctcccaacttctgggttcatcacctgcattgaataaataccaacacttgtggaatatgttagaaataatccctaacactatgttggatgtttcattatctggactttatgcagatgttgccggtataaatttggcactaaacaaccgccaacaaaaacctatgcaggggttaatgatatccagtcaaaaagggcaggttgacacatgaaacaccaagaagggctactctcatactaaatgaataagcttagtatagtagaaagaaactagcaaagaatcctatctatacttcagtataaagttgtctagtatacatttactatgcactaatcatacagccaataccccctaactacgccctcctggtatattgagagaccacccctgattgccgagttccttacgacaacccgtcatggccatccgaccggtaatgaatacggaggagtacccacaccaggaaaatgtcttacgattatatacgaacgtggaggaatacccgtactgagctatcaccattagcggcccacctctattgacccgtgacatataaccccaattaatggtatctaataatctaagcaccgcgcttacattacaaaatactactctacatccatgcatccgacatagagcaaccaagtactcggacattaaaccaataccaatgcgtatctctagtaagctacccatacgattgacacatatcaaatttataccaaagcaagtaattaaactatataaatatagcataatactacaactatataaagaagagtatttcattatataatcaagtcttacaaaggaagagtaaactactaaagacatacccgattccttcggaaagacatggagaactttggaactctactatttctactccattataactaaagacgaaatataagctaagagagagcttcttggacttgatgcatcaaggtgtgagttaatggagtgaggtgaggtccttatatagcctcccaatgatgattacaatagctggaaaggtcgaaaataccccgcaaccgtcattggggaggcatctggattgtccacgccaaaggagagagccaacggttgagatcagggtttggtcgaaccctagactggcccatttggcccacaaatcggcaggtgcactcctcattgattcctcagcccagcagtgtagtggttggacccaattgatattattttaatgggtttacaggcccatccacccataagtctgcctctttacggatttcgattaattgttcggttatgttccgtcgattatgctccatttatgaatgcttctcatgcatatatgttagtagcatagcatatagtggaagtagatattttatttggaaattatgcattgcaagcatagctaatctattaattgggtaatattgacggtcaaaattggtggataacgattgtcaacagtgggcatcccgttagccggacagccagcctccccatcaacaacactctcacactgctagctcgttgtcaattgttgtcacgaccggaattaacccaacaggcatttcatacatgcgtgtattattccttgtcccaggaggcaaggtacaccaaaagttgatagaattcagagtttaacaagcggaagcgtaaatagttaatttattacatgggcgacgaaggcccagcacactcgaagataaacgagaaaacaacggaagactagggcgacgaccacaggcgcttgacggcaggcatgagctagacaccaaagccttcatcctccaggaactcctcttctgggttgggggaaaatttagcaagattgagtacaaccaccgtactcagcaagacacacccacaaatgtagaataaatgcaaaggattacaggggattataatataggggttaggatttgcagtaaatagcatttagaagacatttagttgcttagggccattttgtaaagacgatcctagagctacacagtgttattaatcaaggccgtgaacccacacgaacttgccttaacccaaggcatatgatgattcagaccgaactagcaaccagacccaggtcccagctcatcccaagccaacccaggccaaacatttcacattttagttgttaagcaagttttaagaaatataccactaacttgggtacattgctagacttacccataaccgagggcgcggctattcgaatagattatactctcataagaggtgtacatccacaagacacgtcttcctcacgtataaccacatgccacataccaccacgtcatacggacagaaggcgtgacatagttcccgacccatcctagccataaacaagagtaccgacccaaccctggctacggccagaatcccgggacaggtaaccaaggttgagccccttgcagcaggacaccggccctgtaccatgacatctcgactaccggggcacagctcgtgtagccttcatttgtcctagagatgtccatcgagccccgacttcgtccatccctatccgcgtacttttgcccatgactagactgagccacaaactacgccatacccactagacatgtgaaagtacggtagtgctttccaacagaggcccgaagaccgatccttatagtggccccatgtggaagtacgatagtgctttgcaacaaaggcccgaagaccgatccttatagtggccgatgtgctactatcaaaaccatgcacctcgagcccagcctaaaaccattttgggggttttgaatagaggggaaggtttgtgtccaattccacataagccaaccattccataatgtccaaatgatatgaggactcccaaagtctagagttataaaaccacctaaagtttgtttaatttaaatggcgaagcatctacctaaacttggtactagtgagaccgtaaaacagtacccaccagcagggttttggttactctaggcaataaaaacaataacaataatgtgaggacgtcccaaagcctaggtggtgcaacgctccaaggcatgtcagcgcgaaatatctggatggatggggtctcaaataaaacccaaataaatacggtaaccatccaacctcatcgcagaccccgacatgtcttgaagagtgcactacataggctctaagccatcggatatgaaatagaagacacaaccattggaatagccacagcagtcatctatgtcatacgcccgtcaaccactcgatggtggcgaccaaaagcgtaccctagagactcgatctcaacaaaggcatattccccagttatctcaaccatttcaaacccatcctcatgtgggactagttgcccaggaatgcaacatagtctcacataaatcatctcaagcatgatatccaaataatgagtggttctaagcaataagcataaataatcttaataaggttctaagtagtacttggcgacaagccataaatattggttcatgcggtaagcgtgctacccaaaagcccataggcaaaccgactagggtaaatccctagttagaaccatcctggaaatctacaacatcacaagctgcatcaaactcctcatccaaacagtcattatctgcagcagggtctgagcataaacaagtaaaagaaagcaagaaatcagtacattaatcaaattaatgtactggcaagttggaaacaatcctagcatactacatgttggccatattcaaggataagctgtgtataggttaatttgcataaatgccaactttagttcacaacatgtttcgcaatggaattttataacaatagtatagagtaagtaaaacttgtaatgtgaatgaataaataacacacatctacccctcgaggtagatcatcaccactctccatcatctcatcaccattcacggaactttacccaagttcaaaaacaaaacattccaaccattttccaggttcacaagagtttatcaaaatcacaaattatactcatgacacttcaccatgccgctcatgaccgtgagcacggctaatcgattagttttagactctgcagagtttgtacaacttttaagcccacatgatatggatcactctagtttttccgatacccgtcggtatcaccacactctacacattgagtgtgatctagaggtcataacggaaccattacaatgtttattgtctagccttgcaccagcacgatgtgtattttacccatgctactagcaaggtagcgccactaggtagcgggcccacgctttaacctagcgccgtaaggaacctagcctggaatccctcacgaggcacgacaccgttgtattggagagactacccgctaaaatcatcacataccacatatcattaatcaatttcatcatatcacaaaccataggaagttccgataagttaccaaaacccggtaacccatacccttcggcctaccaagatgcaaggctaaactctaaacaacttaataggttgaggccagcccatacttagcacatgtggtttgtactgttttcattagttggtgacatagagtggggtccttaatcgacccgggcgaacgctccccctatcggtgtacaactaccaccatacgtacaccactcgccacccaagtctaaaaacaagttatctccattttcagttcacaatactcactcatttaaatttctgtccagcaacatcaaaataaccattttcacatataacatttatcaaaacgagtaatttgcaaggcggtaaccgaatataagcatatagcggcaatataagcatagtataatcccaaagaacacaataattgtattcaaaagcactctatggttacaaccagcaaggattcaatatttcaaggtggattatgcagcaattaggtcatatctaccattcccacatttatatatttttttaccaaaagtaatactagctaacgtatgcatgtttgcaatagaatcatttagcccaataaaacataggatcaatgtgatcaaaggaggtgcaaacttgccttcgtttgcaaactcctgaacctgctcgtcaacaaactcaccctcttcttcttcgatgtattcttcctctatagaaaatacgcgtatacgataaatacaaaaatgcataaaaaccaaaatgcatgaaaatgcatgaaacttatgcagtgagtgtgtgctggtcttaggtggtctctggtgaaggaattttaattttgtcactttttattaacagagatatgccatttacaattaaaaaggtttaaaaagggctaatttttattaagcaacatttttgtacagaagtgaaaaaattacttttacaagtacaacgcctttattttagaaaagtttaaccaaaatcggtttcccattttttatacctatattcaattggttatggattaaacaagtcttaggcaacattatggcaaaccaaaaataaaggaaaagtttgtacagaaagtacccagttttatatttttgtaaaatagctcacagctctatggatctaataaaactggtttcacaatatttgaagttaaaatgaagtttctacaaattttagaatttctgctcattctctgttttaaaccaaaatagaaatcaattttcgaaattgaatccagccgggtccacagtcagtgaaaagagatttgcacagaggccctcggaagttgggggaatcaacccgtacttcttctgccacctggacaataaactttattaagagtccttattcttttgtttatttccatcaaggttctgctatagtaatatgagtcatggcagttttcagattggatcatagtgtcgatcaaattcaagaaatgaagtccccagctagctcacatcgggagcagccatggctgagctcggtctacggctcaccggcggcgatcggtggatcgaatcgttcgaacacaaaagagaaaatgtagaggacgttcttgcgcatccgtgagtggtggtggtgagggaaatggtagtctgtagcccatggaacatgagctacattggcggtgtgtctcggtatgcccatgcatgtgcatgcagaggcttggttagtgcaaagggttagtgcatgtgctctcatatggtaccagggtgctcaccaagcagagaaacggaggcagcgaggtccagggagcggcggaggtggtggttgttggccaacggcggcaaaactccagcgtcgacgtcgccgggtcgactcaaggcacgaactgcaacttcgagagtacggtggtgttagagatgagccacagagggtgcatgcacgaggaatccgacggaaactcaccggagcttggtgttgcttcggtggtgaggaacggcggccggagcggcgtcggcggttcgggtggccggcggcgaggacggtgacacccaccacgtgctcgacagattggtcctagggaaaaaggggtacgggtgtgctcggcgtgatgcgtaggtcacgttccataggagggaagagagagggactcaccggggatgcacggcgacgacggccaagtcgccggagccgggtaagacggccgagctctgggcattctgtgcgtggggtgtgttttcttggacttggaacacgatgtggggagtgtgctgttgcttctggtgctttggcttacgatataaggaagagtggagtgggggagtgagagagaggtggctggtgctttcattgtgttccttgggcatccattgggcatggggcacagtggatgctgtgaggggagagtgggaggctgtcatgtgggtcccagagggtgtggggcccactgcagtgaaagaaattcaaatatagccttggaggctaagtcaaagagggttgctgccaaggatctttggagggatcaaggtggattttgtgcagcaagaaatctgggctagatatcctcttggtcaggggtgatgtgcagagtaaatgtgctgaagtggattgggttagaagtctctggtttaggtttgatggagtgatgaatatgtattgacagtgttggttagcagcagttgacagtgcagttagcagctgattggatttttggagggagagaagaaagggttagagagtgatccagggtgtgccactcctcagggtgttagaagaaagttagtaggagactttggctgaaaccaaacttcaaaaagaggttttgaaataaattttacagagagagcaagtttgaatctgctaagcagttcttttcaggattctagacagattaaaggagatcaacaagttagcaaaccttactgaaaaactctgaaaaattgtgggttgatttctgacatatcaaggtttttttttttgagaacttttgtggaagttttggatgcatataattaccagattaattgtttttgtgactctaggcctatcaagatgcatatgatgagatgattaagatccaaaaacaattaaaatcactccacaaccacatgatgcatttaaattaaatttagttctcaggtttacaggcttgggtatgttacaaataataataaggtcataacaatggtaaataggcatggctaaataaaacagtgataacgcgggaatttaaataaagcgataatgcattaatttaaaacaaaataattttaaagcatgggacacaatatgttcaaaggagatgtgacttgccttgctcgctttcccaaacgtcggcttcaatctccacgtagagcagatcttccgaagctgcagcgtctacacgaccaacagaaagaaaaaggcttttactctaataaactccatataaccagcagaaacaaagcacaaaaacgggttcttgacttcttaaggaaaaattagagacttg

SEQ ID NO: 51522 - DNA, 4873 bp, Oryza sativa
atgcttttatgcatattttctttaagaataatctatctccacttgtacttggaattttatttggttgcagagaactttacataattggaggagaatcgatggaaattaaccgaacaatcaatcgaaatccgtcgagaggtagacttatgggtgatgggcttacaaatccagtaaaataacatcaaatggcccaaccactacactactggaccgaggagtcatcacacaacgcacctgcaaatttgtgggttgattgggccaggctagggttcggctgaacccccaccagcgccggtgatcgcctcctttcacatggacgtccaggattgctccccaatgacggttgcgggtatttcggaatattccgaccatcacaaccgtcattggcagcctataaatggaggtcccttcgctctactccaacacacactcaagaaaaagatcaagaagctctctctcaagtttagtttactgttctagtgctagtggagtaagaatagagtagttctcttagacctcgagtctttaggagatttcgagtaaggctctagctcttccttcttttgtaagacttatagtattaataaaatattcttctttatatagctttggtcttttacttaattcatactattcaagtaccgactttagttcgtatttgtctcgatataataatgtagctagcttacgagagatatgcattggtgtgggtttaatgttcatttctatgattgctctatgtctgctgcagtgatatggagtagtatttagtaatgtaagcgtgacgcttagattattagtaccattaattggggttatatgctatgggtcagtagaagtgggctgctgatggtgaaaactcagtacgggtattcctccacgttcgtatataatactaagacactttcctagtatgggtactcctctgtattcaataccgatcggatgtccatgacgggttgtcgtaagaaaaatggcaatcagggttagtcttttgaaacaccaggagggcatagttagggggtttggttggatgatcgtatattagtaagtgtaaactaaagatgactatatattagaagtacaggaatgaatcttttgttcttctttctccacttagcctagattatagttcttagttatttcttttgtgtgtcaatcttatcctaccccttgaattgattaacccctgcatatactttggtgaatacaagtaatatataaattattagcatagtactcttttagcatatctccccttgagattaaataaatacgataacttggaatacttccgggtgaaatgctacaatggtatattcgtgcgcttgcggattatatctataaccgtaaaatatatcgggaatatttcaacgccattactaggaattatatttctagtaatatcgttaagaaataccaacaaacatttctagcgccgttgccgaggaagtttaatgattaagagtttactacatgctaataatcttatatttaccttggtataatcactgtcctttacaggctacccttgattgtttttgttttattatgaaaacaggatagtacatgattggtttcaatttgccgaaaaacttccatgacaacacaaaagccttctttaggagcgtcaaaccacgtgttgtccctccttagaagactctatcgacagagaaaccagccatccaagcgtcaccaaccttcaataccatggctcagaacactctccgcgagttcgttgctcactctgttgacaatgagcccattgggccgcaagtcaagttaggagacggtgactttgacttgaaaaccagcgtaattacgatggcacaagctaacccgttttgcggcaagcctaacgaggatgctagtgctcatttgcaacagtttctcgagatcagtagcacctagaccatgaaggagttagcccagatgccattagactccgcctgttcccgttctccctccttgggagagctaaacaatgattctatgccaaccgtgcaacggtgaacacgtggaacaaatgctctacatcattcctctcaaaattcttctcgatgggcaagaccaacgcccttcgcgagagaatatccagctttcagaacacgagagatgagacgattcctgaagctcaggaagggttataggagtacgtcaccgtctatcctcatcataggatggacaagtggcttatcctgcaaagtttctataacagactaactccctcgtcccaggatcacctggatgctgcagctggaggagccttcttctacgagacggttagaggcgccgtagatttaatcgagaagatggtctcgaacatgggttggagcgaggaacaactccaaacccgtcaacgcgacatgcacaatgttaaggagacggaaatgcttgctgccaagttggatctcctgatgaaacgactggacgatcaagagaagaacatgcctcaaggcaccgtcaaggccttggactcacacatcacatgtggagtctgcagcaacgcggatcattccgggactagtgttgtggataacggttggtacggccgtatattcagatgtcaagacggtggcactgacctctccgccacattttagcaaaacggtgcacattagtcgtttcagctagtgttgtggatgacggaatacggatgtcgtcggacttcctccgaacataagttccttgcttccgatgatgatcatgagactgaagtttcagataatgatgttgcacttgatgatgattctttggagtaactcgtatcttattaatttgggaccttgttttagtgtcacttatatagtgttacctgctttcggtattcctttatgcattacgaaccaaacctatcactatttgatgcacaactacgagtgttcagacctatattttactatatgtcgagttaacatcatgttatccttatttttatttaagaataataggtatatacacagttatatgcatttatctgtaaaaaataataagctattatgagttatgtacatatatttgttcaaaacgttaaatttccgtcaaattccgattattcgtccgtactccgattaatcgtttagcggtaccctctccatccgacatccgtattccgattgttacaaactttgcaacatgcatatttaaattgtagttcttattatttggtaaaacattcataaacccatttataacaaaagaaaaatgctaactgccgtattccatgcccaggtgacaccggccgcagggcccaagaaccatcaggttaacgctgtcagggactttcggctcaacgtacttccttgcagcggcgagggctgtctcggcctcccggagagcctctgtactcatcttcctgcaccgatcataggaggagcacttcctgtcgtaaccaggggaggtgtcaagcgtcaggtgttcgagcgataacgctgcgatcacgaggatatggcatgtcagctcgaccaggctattcgccgagcagaaaccggtgatggtcaccttcctcaggttgccgacgatgccaccattgcggagtttgctggcctcccgccccctacatgaagctccatcgtcaggattcccacggttctggtcgttgtaccatctgataccatatgcaatctgtaaacatgaatttgattaacatgtcataagttacaaattaattatagagtaaatttgagaaaaccctatattttactgtcaaagttacagaaaaccctaagtatattacggttctaaagttttacataaccccacccacgtaaatgctgagcatggatttaattaaaattctaaaccataattattaatttcttcactaaggtagatagtttaactcttcactacttcgcaaaaaaaaaaaaactgcttcagatattcttgaattaatcaagatttcaataattgtggggatttataaaacatttagatcataaaacataaaaactatggttttgtgatttttttttattttgcaattttgaccataaaatatggggttttctacataaagagttgagagttgtgactgaggattgactcgtaaaatgaaggtctccaaggcaggacaagcatcaacgaaactagccaaagagagaaagtcatagcctgcgcaaaacatagttgattggccaaggcagatgacgagatgcttgagttgttggaatttgtcatgcatcactggtgccttcaacctctgaacaaaaaaagaaaagagatcaaaacattgaattactgagcacgcaaccatgcatgcttaacatgcatgattgcacaaaatagtctcaaccgctcattgatggcaatggtacctagtaaacagtcgacagcacaagcgtttctagattcagcgcggcggaggggagcttggagccggcatactggataacgtcccccattcgagtggcatgcacctccagatgcgtcctctcgagcgcgccaccgagccagaacctcagcagcggccacccgtcgtaccagaccgtggcgagcatcggcgcgccgctctcgatggtccgcagcatcctgcacgagcgcacccgtagggaccttagccgccggagtgcactaggtatcttgagggcgcctatcgaattgcagaaggacagatccagccgctccagcacaaggcagccggcgaggaagaaacccagctcctcgtccgtgatggcgactctgtgcaagcacaccgtcgacatgctcttccagcagccaagcagtgtggtcatcccttctgtagggtggaagccacaggaggacagtgaaagagactgaagcgacgttatcttgtcctcatcgtctgagagaagcgagcagggaaatgtgtactcaggcagacaatcatgaccgtagtagtagtaacagtcgt

SEQ ID NO: 51523 - DNA, 799 bp, Oryza sativa
agccatgaaagctgtcaatcgggccatccgtgacagaagccgaatttccaaggttaaagccgattacggatgacgatggagaagaatgcacccatcgaagatgcatgtcttatggggaatatgcatccacaccagccaatgccggagcaaagttatcggctgagccgctcaaggactggttctgcatcttttatgaaggctttcagaaagatgcccatgtttggttcttttatgagaattcagccgacttggatctcccatcggatttcagattcgaagatatcaatcatgagagataccagaaatccagagaagtcttttcagcttcgataagcccatgcatccttcctatcggcattcatcaagggagaaacatacaagtctcttatgaattttatcacccaatgagctctgccagacagtttggaatgggacaactaccaatcggcttgttgtttgccgacaaaatccaatgccaaggagaaatttcatcaactctgatgatggatcggctactcaacatcccaggacccccttttggtagcattgagaacatagagctagcaaaattcaggagcagggcatttgacagatggtggggtgaatggaagctgcatctattccatcaatcggcttccatgtacatgacagacctctttcctgatgtcattcctcaggtacatctttactcttgtcaattctgtttgaacaattattattgaaatttgactaacttctcttgttatcttgcatataacagaatcctctcctctcccagagtaacagtggtagggacata

SEQ ID NO: 51524 - DNA, 1117 bp, Oryza sativa
atggcatgtcattgtaagactttataggattttcaatgaatgtcataacaaaatccttgagatcactgatgcatctgtcatacgagccttcaaggtaggcgtccgagttcagtacaccatccaagagttggcgacacaaaacacacccttagcaatgaggcttttccagattgccgacatatgtgtccatgttgagaaagctattcgacacaatgatggtaagataaaagcaggggaggacaatgcgccgagcacaaaaatagaagcaagctactcaatgaagctgaagcagctagcccatgaataataataggaagcgcatgatagatagagtggtattgcagtggatacaaaactacctcaacctaggcacttcgaatctcaataaagataggctcccagcaaaaagatgtgcccaactcacatgacaagctcacactctctgctggaagtcatatctttcacaaagacattgtataatatacacatcaatgatttacaaatattattaaattttcatatttttcaacgtggatttgttctttagcacaatgtagggtaaaactgcaattttctcatggtattcttccactcttccatctccttgttatctcattcttctttattattgatgatgatactgatagctttagccactaaaaactcccggttggtttgtgtgcccatggtttgtattatattatttgtaatttttacatgagttagtagtaattatgtatgcttccaagttgattaattagtttttagaatttgagagatattttttcctaaatataatctagaatgttcttaactaataacatatataggtgagtaacatttgttgtaaatctaatgatcatagtgcgctataaatattgttcaactgagttgtgtctttcactatgtataagtatatcatatgttatattatatagcgtaaaattagtgatcatggtgtaacatatatactacctccgttttaggttataagactttctagcattacccacattcatatagatgttaatgaatctaggcacacatatatgtctagattcattaacatatatatgaatgtggacaatgctagaaagtcttataatatgaaacggag

SEQ ID NO: 51525 - DNA, 2776 bp, Oryza sativa
ctcgtctctgccgatagactcttttcttcttcctcgcctctccttcttcctcccgtccaccccgatcgtctttcttaatttcttcacctcctcttcaacaaaaatggatctttctcccttcatagaacagattttgcatgaggatttcgtgtcatgagaggttttgttcccgctactcagccatggtttgtttgtcctgttgtccggaacacgccgccatccttcaccctggcaccaatgctgttacagtggaggtagttgcgttgcggcaagaatctttctttcaatcatctacatgtcctgtctcatgcatctgaactaactccacatgtttccttctttttgacatattttcattgttaatggttttcctgtactgagccatcgagatgccaaaaataagaggatgggttgtaattggacaagattcaaagggtcaagcacgaagcaaacacctagataatgctaggaagagataggctgaggaaaacactttcgggtctgagggagaaatgccgctgcgattaccaatagcgtcaagatacaacttttgtagcccgaaatccaaggtgggaataaattgtttgtttctgttgtttctaactgttttgtgagttcgatgattgatcattttctgttattgccttttcttgcgggcatttcctttgctctgaaattggattcgttgaatcgagttcaatttcttctgcaaagagtcctgatttcattttgtgagttcgatgattgattattttatgttattgccttttcttgcaggcatttcttttgcttggaaattggaatcgttgaatcgagttcaatttgttgtagaaagagtcctgatttcattctgtgagtttcgataattgattattttctgttcttaccttttcttgtggacatttctttggcttggaaattggaatcgttgaatcgagttcaattcgtgctacaaaagagtccagatttaattttgtgagttcttgatttctctcccatataggttgcggaggtacaacggggccggagctggcagacagtgcaaaaactcgtaaactcgagttataatcaagaacatttaaaagaccggttctgtttgacatgcaagctcagcttcagctcacagaagtgtttggaccataggcttcatcatccagttaaagagcgagataaccttgtggtgttggagattgtgatggaagatggatggagtgtcaatgtcttatctctggggaacaactcccaataggttcttgtgatagcatagatgtaaatttttaagaccagtttcagttcactggtaacttttctatgcaatgcagaaacaaaaaaaaaaaaaaaactagttctggattgatttgctcaatttcaccgcgcgtcaagcttgtggacggccagtggcggaggacccggtatggcgaggtctggcgctcgccataccttaggctgcctgcgagtaccccctgctccggccttcagctccagggtcaagccgggcagcggccatgcgcggcgtccagccgacgtgtgacgcgatggcgtcggcgtggtgttgacgaaaaacacgaggcctgggagatctgcttaactccagtgcaggtccaaagctcgccttcgggtgtgttagcgtgccagttgatttgatcctgtaatcaacaagaaatagagacaaagaaaccacggttaaacctataaatgatagccggtcggctaagtgccgatgacatatcatttatctttgagccgatgtcatatgtaaatcgatcggcggttgtaaataggtaataaagaactaaatctacccgatcggttgtagatattaacaatatgtagttcttatatcggtatatacttaaatcaagtgattgggatagatcggtcgccatgccgaaacagtataaatcacttagatcgaaatatatattaataaaaggactatatatgttcatggcatagccgatcagattgatctagcatgtatcggctaatactccgatacaactctatgtttagatgttaaaacaagcagaatatgctaaacagaagcttagtatacttagatgcaataatatcttgacataaagggtggatttaacatgtcaatgaagcatatagagcaaatatagttaaatcagataaggtaggctgaaactccgatactaccctaattggcaaccagaaggcatgctagagattgatatgctaagcacgacttaatagatcaaactcaactgatgcagcattaagtatgaaaagaagaacaacatctaaacaatcaagccgctggaaatttcatagagtggtagatatcttatataatttaaatcaacgttgaaatctaacctaatcgactgccctttaccgatagatgttagccgattgtaggttagataacgatattgccagaaattatgtaagatatatgataactcgacgaattacataagcaagattagaatatcataaagatggaagcactaatcccgagaacgcaagccgtcataacaagttttatcttttgttgaagatcgaaaccgatgcagctcaacccgaaagcaagaactcgtcgaaataaaactaaagcaaaagggtggtgatgccccgaaattgtagtgaacatgtgtgttaattgattacaccgggttcggggtctatttatacccgaaaattacaaactatgtccatatcggacacgactcttatctctaacatactctaagataccataagtctttgcggcacacttttgcgcccacacatctctatatggaaatta

SEQ ID NO: 51526 - DNA, 8776 bp, Oryza sativa
ccgattcttgctctgttctcgaatcgatctccgccttcgactccacttcgatctaatcttcttttccgatgccgatattaccaaatttggttgttaacacgtgggcaatgcatctaggctaggcggcgagcatctgcaggctgcaggccggcatggcggtgctcgtctgctcctagtgtcgcggtgccacctggcatgcacggctgcgccaggggtgaacctagcatgggacatgggggtacatctgtacccccaaaatttttgactaataatctttgaattaataggtatattacctatatatatcattagttgggtcaaaacagctattctttagcctaaaatcacaatacaactcatagaaaacggctctggcagaacaacacaagctcctcgatctcgtctcatgaccctgaatctctggtttgtctatggggcttacaaccagaataccgagcatattgcatgccttcctatggtttgggacaaccaaccaatggcagccgtgtgcaggcgctgctcgtggtcacggagagaagccgagaacaagcagctgatcgacaagccactgcactggagaagcaacctcatggctcaatgggttgaatgtgttcgtatcatatatatttttaggctcctaactcatctttctgtagttaatgtttgattcaattgatggttgcttttaggaaatttgattaatgtgcatatctgaatttatatggtagagcagtcaaaaagttaaatggtagtgcaaaaatctctatggagtgtttgggatgaaaacatactatctcttctccaagatttaatttttctttagctattttgcaatgtttctatttttatttgttctagcaagaaaaactttctcattacttttcctactattaagctttagtttctttatggaacaacgatttgataactctgtacaccatcttcaaaatcctgtgtccgccactgggctgcacgcagcaacccagctctaagccgagcagggcagctacaccaacaagtcagcaagggcaaggcagcaaagcaactggcccgattcagcacaaatggatagaaaggggaaaggaaaggctttggcatcttaaaaagataacatttgttgagtatttgacaaatgacaagtgaaaacattgcaatttgcaaaagttaatgcacaatttgtcattgattcacatgtgtgtaattttgtttgtagatttgaagagctatttcaccaggtagtctagtagttgtcgagcagtatgcttttactgttttacgtttcattcaacttgtttttaaagtcgcataagtggtgatgccaatttaaagtcacatattaccacttattataaaggtctttttggccctcttgatgagtctgaccttcagtttgatgagaattatgttactgacattcctcaagtttcacaattggagaatgaagccttaactaaggattttactgaaaatgaggttaaggatgctattttccaaatggaacacaacaaagctccgggtccagatggatttcctgctgagttttaccaagttttctggaatgtcattaaattcgacctcttagaactgtttaaggactttcattctgggagttttcccttatattcgctgaactttggtactatcattcttttgcctaagtgtgttaaggctatgaagattcaacagtatagacctatatgcttacttaatgttagctttaagatttttaccaaaattgctacaaatagaacaatggatatcgctcaaaaggtaattagtcctactcaaacagcgttcattcctgggagaaatattatggaaggggtgcttattttacatgagactttacatgaattacatcgcaaagataaaagcggtgtaatttttaagattgattttgagaaagcttatgacaaagttaaatggccttttgtacaacaaaaaactttgagaatgaaaggcttttctcctagatggtgtgagtggatagcatcttttattcaaggcgatgatgttggtataaaggttaacgatcaaattggtaattgttttcaaacttacaaaggttttaggcaaggggatcctttatctcctattctttttaatatagtagctgacatgcttactctattgatcaagatggctaaagaggtgggactattgaatgggattattccccatcttgttgacgatggtttgtctatcttgcaatacgcatatgatactatcatctttttggagcatgacttgcaacaggcaaagaatctgaaattgatttaatctgtctttgaaaagttacctagcctaaaaataaattttcacaagagtgaattattttgttttggtcaggcaaaggaatgttatgagcaatattctggtatctttggttgtaagttaggtgcctttccttttaaatatcttggaattccgatgcactttaggaagcttactagtaaagattggaaacttattgaagagagaattgagaaaaagcttagtagttggaaaggcaagcatttatctgttggtggtagattggtgttgattaattctgttcttttaagtttagccatatttatgatatctttttttaggtgccgaaaggggttcttcgtaaaattgattattacagatcgcggttcttttgacaaggggatgatcataagaaaaattacaggctcactaggtgggatgttgtttgtcaacccaaggaccggggggtcttgggattcataatctggagatacaaaataaatgttttttaagtaaatgattgtttaagttaattaatgaggaaggggtttggcatgacttattgaagaggaaatatctttataataagtctataacccaagttgataggaaacaaggggattcctattttttgcctggtcttatgaatgtcaaaagtactttcttaaatatgggctcttggattgttaataatggggaacaaattagattttgggaagataaatggctaggcaacttggctttcaaggataaatatccgtcgttatacactattgtccgaaggaaaacatactctattgccactgttatgggatctgttccgcttaatgtttcttttaggagagctttagtttatcagaatcttgtttgttggcatgagttgtgtgcctctatagtacatatccagttgaataattcgtctgatagtttcatatggaattcccatcagaatggcttgttcttggtgaggtctatatacctagctttaattaataatggctatatcgagagaaataagtgtatttggaagcttaagttgccacttaagattaaaattttcatgtggtacttgcttaaaggggttgtgttaactaaggataatttggcaaggcgtaactggaatggcagcttgaggtattctttttgtttgaagaatgagtctattcaacatctctatgtgaattgtcattttgcgaagttcatatggatagcagttcagttctcttttggtttttaatcttccagttagcatatctcatatttttaagaaataagttcatctgaggtcccttaacttgtcaacgaatccgattttcgtccctaattcagaaaaccagacacaacgggtccctcaactatcaaaaccggtgcagattagatccctcggcgtttttgagagtggttttggctgacgtggctcctacgtggctaatttgactcggtcttcatctgatgtggattgacgtggcgcttacgtggcaattcgatcccgaaaaataataaaacccgtgggacccacatgtcaatctcacacataaataataaaaatgggggacccacgtgggccccacatgtcagtagaactcacccttcctgttcttcctcctccctcccagggcgctacaagataattgagctattgccaccaaattattacaacaaaaaataattcgtagcaatatattatagtattgcaatgataatttttctgtggcaaataattattttttattgcaacgatctacaatcgttgttttatttagtacttttgttgcaatagaaaatgagatattgccacgaaaaatcgtactgttgcaaaaaaacatgttctatcgccacaatttttatttttgtggcaatttatatagtacacagtacttttcactattttttgttgccatgatcaacaaaattgttgcaataaaaaaattgccatctcataatttaactttattttttcatatggacacggattgagacaaattttatatggaaattatagctctcgacgagatctacaattttataggtgataactttttcatttgaaatcttttagatatcaaatctatgattcaaatctcagttagctaggctcaaatagaactatatgcattttcgaacagaattgatgtgtagttgagttggtaaaggagagcacacctgaaggacaggtcttgggttcgaatcctagccaagacacaaaatcaaaaaaaaagagtagataaatagataggatgatagactaatatttgaacttttaacttggtacgtaaaactaatgctacatatggagtggtggcaataatttttattacaacgatgtgaagtgttgcaatatgactttttgccacatccattccgtggcaacatctaaatttattaccacaaaataaaaatcgttgcaataacctattaccacgctgtttattactacggctagcaacgattttacaattgtggcaacatgtatctatttccacaattttagtattgatgccacgatttttttcgtggcaacaaatgatttatctagtcgcgatgtgctccagtaggacatggcggcgcgagcacatggtgcaagaggagcggaggaagacgtcgggagccgcgaagacggtgatcgaccctggccacgccgcgagcaacgttgagttggcgaggagcggcgccgcggaggccatctcgttgtaccacagcgaggagagcaccctcgccagctgctccagttgctgctcgtcgcccaagcccgcgaccccggcgtggactggaggcggagggctcgctacgtggcagtatctcgggagcggaagtgtcgtcgtggactcgtggtcgtggccgtggccgcagcaggttcgtcgagaacaaaaatgcctggatctctatcaactggttcactcagctcattcactgtactttttattaagcattcgactgtctccagagcttcagactcaatacagcaagaagagaaggctctaagtctgtctttcccacaacaccctcctcggccaaaatagcctttacacgatataagttgagaaacacagtcctgcacttcatccactgacatagcaccaccaaggatgaccttgatgagcactggatttacttcaaatttgtattctgattccagaccagcaatcaggtttgtcagagctgcctcaatgtgttggtcagttaaatcgtacattcgtatcccaagagaaggcatttccatggccccagccatgattcctccatgtctctgttcaaaaggaacataacataccagaaccaaaaagttattaaaaatatgatcgatttcaacaacagaaaattcaaacatttttttaaggaatgcatcaagcgttgtggaatcaattttcagtttttgccataacatgagaaatcttacttcagcatcttatcaaggtggttgttgagcttgctgaggcgtcgatcagcgtcggggttgcctcctccgccgccgctccgacagcggcgatggcggcctccccggacggagcctcggcagcggcgggcgcggcagcggccgcgaaggggtcgagcatgtgcagcgaccgcggccgccgcagccagagccacttcccgccgccgattcctcttctgcccacaaccgccggagccgtgcctccgccgctgcgcgccgctcccttctctcccgccggccgccggccgccggccgccgctgcctctccgtcgcctggagagagcagaggagagagacgaagagaggagagatggggagggaggaggaagaagaggaggggtgagcatgatatgtggggcccacgtaggccccaccatttttattaatttgtgtgtgaaactgacatgtgggtcctaccggttttattatttttcctgatcgaattgccacgtaagcgccacgtcaatgccacgtcagatgaagaccgagtcaaattagccacgtaggcgccacgtcagccaaaaccactctcaaaactgccaagggatctaatctgcaccagttttaatagttgagggacccgttgtgtctagttttccgattgagggacgaaagtcggattccttaacaagttaagggacctcggatgaacttacctctatttttaatgggtggcttttgggaattgataagaaaaagagtaaactgatacttgttggagcttctgccatttgttgggcaatatggctaagtaggaacgatatggtttttgaaaaatcaccatcattttcctatatgcaggttattttcagggcaacatattgactccggtttcgggcacaactacaaaagtgtgatgaagatgaagagtttctgaaagttgcacgtcgaaagttagagactacggttatgcaactttttatcaattatggttggagatttacaaatagacttcaataattgtgatctccttacgttaggctggattctttgttattctctagatttacactctgtttttgattgctactatgtaataattggttgtagctcttttgagtaaaggccatctaaaaaattcaacttgtttttttttaagttaatccatgttaaaggtagtcttttaatccatctttactctttcttttgcatattctatatatatttatcatatctatcgattatatatgtattgctaaaagtctgaaacattattctttcaagtatttttcagtgcctacccttttatttatgcatttatgtagatgaattgtggtttagtggttgtttccaggttgaatttaccgttttgacaacttgacataatcacataacgtagacttgctgaaattcttgtgtgtcctctcggtctcaagacctagtccatatgccacaccacttttttttccgtcctcctgcagggcgctaaccacccacgacggacacggatgcaggcacatcgattgccaggaggaggtgacagtttacgcccattcgattttgctatatatttgtcgacaaattttccctcaaaaatttgacagatgtaattacagtacaatcgtagtgtaattacactgtaacttgcatgtaattacactgtaactatagtgtaacttatatataactttcaaaaatctctccgtaacatgttatttcggtaaaatggaggtcgtgggaacaaattctttcatatatgtgtgtgctatgatttgttttcttcctcaccaaaacaaatcttgtaataaatctaataattcaaaattatgtgaaacttatatataagttacaatgtagttacatgcaagttacagtgtaattatatataagttacagcgtaattacattatgattgtacaataattacatctatcaaatttttagggaaaaatttatcgacaaatgtataggcagtccaacggccattatattggtgcagcatctcctgaagaaggaatattgccgcaccggtggtggcaggtgattgaatcgatcttctcatcttccctgcactgcagcagacggtcttcctcgacgacgcccatggagtctaggtgagtacttgcgctcagacatcctcgtccccttccctcactttctacgattctactcggccatcaccggcagcaagccgggaagaagtcgctcgcggtcgcaccgcgccatggaagtcaagcagagtcagagaggatgacaggtgggctcgtgccctttacttccactggcacgtgggtcccacctgtatcctataatatcagcccttcttcttccttggccagtagcctctgaccgcgccgccgccactccactccactcctctccaccgatgggtttcagccaccgccacatgcaggcagctgcggcctcccctcctccgatcccttccagttccagcacaccacccgcccctccctctccttctacaccccgcgctgcctcctccgccacaggccaccagcctaacccccgccgacggccaccgcctctaccctcttcatctcatccagcgtctccttgctcctagccgaagacgccgagcaccagcaccccaagccctagatccgccgccacctgcgggatgtgtttgtgcggtggcactatctttgcatttccttcccatggaggctttgtgcgttgtacttttgggggcttcaatttggtgggggttcagggggaatttaactatttgccatttttacgtttaccaattatccaaatacccttctttcttaggtttgtccttaatttttttttgcccctataatgtggtggcatcttaactatttgccactgtggcatgccaacatggcaacacagtgtaaaaatcgatgtgggacccacttgttagccgcacagctatcctctttccccctctctcgctctccgacatacccatcggcttccgtcgctactcctctctttcccagcggcggcggtggcgatgcgccggctcgcggctgcggaggaggagggggagccgagcgctgctcctctctttcccagaggcgaaccatgtcggcagcggcgacggcgtgccggctcgcggcggcggaggagggggacgagcgccaccgtatcgaggatgtacgc

SEQ ID NO: 51527 - DNA, 2890 bp, Oryza sativa
tcctcctccgcaactgcaagccggtgcaccgccgtcgccgagaggagcaacgctggcagccgacgggtaggccggagagcgagaggaaggggatagctgtgcggctcacaagtgtgtcccacgtcgatttttacactgtgttgccatgttggcatgccacatgggcaaaagtggcaaatagttaagatgccaccaccttaaaagggcaaaaaaaattaaggacaaacctaataagggcatttggataattggcaaacctaaagtggcaaatagttaaatttctcgtttcagagagattcatttccttatcatctgaaacaaattgtgaacttttctttgcaggcaacaaaaggatctagagaataagaaacagtaacctctgaggtatgcatcttcagatgggaaacatctatgttttcttctgataggtgtcataatttagagatactactatgtctgattttatccaagagcattgcttcagaagttgtttaattatattttacagtgttgctgtgctcttcttatttcctagtcctctgcatgacacttgttttagaactctgatccaacagaactatgtgtgtgctgttttatgctatgctctttgttttttccctggggaaaactacggactttgcttgatatatatgttgcattgttctcctgttaaatttgacaatgccatgttatcactgaatcctaatttcacacactactataacattttttttttgcttgccaatattcttgctctaatgatattttgattaatgttctccttgcataaatcatggcttttcatctcaacatatttagatgcaaatggtaacttaatctgagggatgcttcatcttctagcatatattcactttgttagcattttacttttgttacaaactgaggaactgagaggtcttattatagaggattccgacttcctatgttgcttgacaatgatgccaaagcacaataagctgatctctttcacagctatgtgcagccattggccttgatttcaaagttgaaggaggagaagagttctgccattcaacagaacatgaagcttcaagaagaactggttagcttgattatgcaaacatttaatgacccattatattttttaactttggcagtaagaactagattaacttaccccccccccccccaaaaaaaaaaaaactagttaggtttgagtaacagctttgtcgctaaatttgcatctccaataaataatcaccacatgatttactcattccctgttcttttactgtggccagcagtgaccagtccaccggaaaaaaacactaatacaatttttagctttgagttagatagatagaataagcagtttacatgcgctttatttatttttttttaacttttttgtcaagtttatttgcaacccactaatttctacaagtacagatgtatttcgttatctacaaatatcatcttgtttgtctattatggctttgtgcatcaatgaaatctgaatctgaactgcaacactcacgtagtttcatttatcttctattggaattgaacaggatcttctaaggaggcaaatggggagtcagaacggtggtttctcactagtttttgtgctggttattgctattctgagaatcctgcttggttttctcattaagagatgagcgtctgtgatcatatatctttgttccacttttctgtgaaagagttgatagtcgtgggtcttgtctgttgtgttagccatttgtaccaactcatgatcgtcttatcttaggacctgattcatcttgtaatttctgactatcaaattccaatcagtggctgctgcatccagtcaataagtcgtctgtccattatcctgttcgagtataagcttttttttggtcaattgtattcatcttttgacacctgtaaatatgacacttcccctaatattgtggcttgcgatatgtatatgctggatccttgtgaatcttacggagcaggattttcgttactgttggttttcaatatatatgaacaatgttgcttcaacattatggtcccagcttttgtcatttgtatgtgtttgttcaactggttagctttataccaagagggtttctctgtataacaaacaaaacaatggctgtgtttagatctaaaatttggatccaaacttcagtcctttttcatcacatcaacctgtcatacacacataacttttcagttacatcatctctaatttcaattgaaatccaaactttacgctgaactaaacacagccaatgggttaaagcataaaatggccatgctaagctgtcaattcctcctttccaaaatacaagcatctcagctttaatggtccctctggctcgttaattgatgagacaagtatagccgagtttagttccaaaattttttcttcaaacatctaacttttttatcacatcaaaatttttctacataaataaacttttaactttttcgtcacatcgttttaattttaacatatttttaattttagtgtgaactaaacacatcctatcatcaaaacaaatcacgcgacagattcgtagcaaaatggaaaaaaagaaacaaaaaataggagccatttcgccgtctccccaatctgaaacattcaagacgcgctgccgccgtagcctccgccgccgcgaatggactggtcaggcctccccggcgacctcctccgcctcttctccggccgcctccacgacccactcgacttcctccgcttccgcgccgtctgccgcgcgtggcgcgccgccaccgccgccgcagcggcctcccctcctcccttcctcccatggctccttgcccgccccgcccccatcaaccccaccgccggccccggcccctccctctccttctactccctctcctccgccgccctccg

SEQ ID NO: 51528 - DNA, 21994 bp, Oryza sativa
  unsure (1)..(21994): unsure at all n locations
agaatagctagctgattagctgtgtgattggaatgtaaagtttgggtactgctaatcagactgataattgccttcattctcttcacaaatgtgtagaattgtggatacttcttggagttcgagatagtcagttattttcattacctgtgaattcttcttgatatcagtgccaaccttgcgacattgaagcaaattcatgtatgcaaatatctatgattagataaatgggcagaggaacctaacttctgacacagtgttaacttgtgttagatagttgcttattgagttattcccgctgtcattttgtgattttgaattaaaaattatgagatctctgttcacttaaacttgttaagaagtcctatactttcattcaaattttaccgatatgaccataatttccgaaataatttgaattcttgaacaaaatttggtcaaatatgaacatttctttttatcaaattcacaaaaaattccaaaagttttagttgaaatcatttcgtgttggggggttcacaatttcgaatcctgctttaatgttaaaatgaagtgatttgccatggtgaaatttggcaacatctctaaactatagtttagtttatttattgtacaatacatattgccatattccctatcagaattaatcaagagctgacactccatatttaatcattattaatcttgtggcactatctttgctgtgacactcttcttgtagcatatgtgtggtctaggacctcaaggtccaacctattgatgccaaaataaaactttccaaattttggtaagttaccaacatggtaggctattttttatgtgtttagtttagtgcccagatatacattaccaaattttggcaacatttggcctgtccagattttggtaacttactatgatgttgccaaatttcataaacattagtgcataaccaatgtctggtagcaaacctaatgcatccacatgttagattttatcaaaaagatggtatggattaaaatggcatcaatctgaatgggtcctgaatgtttttatatgctatgtcagcacagatagtgcctattcccgtccggcgatgatctcctgtgcgtgattcggtacttcaggagcaagaacagtgaacaagcaggagaattgctggaggattgctgtgcattggaggttcaccggctagagattgcgggggagaaatcgcggtgggttcagatgaggagcattagagacagaatgctgttcgttggtctctaccagggattctcgctccgcgccgcggatttcgcggggcttgaggggaattgtgtttacttcttcaagatggacagagccagcaggtctttcatctaccggttcaggatggaggatggccaaatcgaagagttgcctggcccctcgatgcatgcttgcacttggtttgtgccaagtttgtcatagccgggctatgatagccctcgttcgtatagacttataaggtaatcttcagatagtttgggtcaggcgttcctcttttcggtttgaatgcattgctccaaaataattcatgaaaatgctgctttaagacatgcaattttcttgtgatatgttaatcgaatgaaatgttggctgataatttgcaagtttgcatcataaattagaatagctagctgattagctgtgtgattagaatgtgaagtgtgggtactgctaatcagactgataatagccttcattctcttcacaaatgtgtagaattgtggatacttgataatgggcagaggaacctaacttctggcacagtgttaacttgtgttagatagttgcttattgagtttttcccgctgtcattttatgattttgaattaaaagttatgaggtctctgttcactaaactttttaggaaaccctatactttaattcaggattcaaatatttgttttcgctatttttatcgggatcaccgatatgaccataatttccgaaataatttgaattcttgaatttgaacatttcttttcatcaaattcacaaaatccaaaagttttagttgaaatcatttcatgttgtgggggggggggggggtttcaaaatttcgaatcctgctttaatgttaaaatgaagtgatttgctatggtgaaattcggcgacatctctaaactatagtttagtttatttattgtatagtacacaactacacattgccttattccctatcagaattaatcaagagctgacactccagatttaatcattattaatcttgtggcactatctttgctgtgacactcttcttgtagcatatgtgtggtctaggacctcaagcctcaaggtcgaatctattgatgtcaaacaatggctgaaatttgatagcctgttcagattgatgccaaaataaacatttccaaatttggtatgttaccaacatggtaggctgttgtttatctgtttagtttagtgcccacatatacattaccaaattttggcaacatttgacctgcccagattttggtaacttactatgatgttgccaagtttcataagcattagtgcataaccaatgtttggtaacaaacctaatgcatccacatgttagattttatcaaaaagatggtatggtttaaaatggcatcaatatgaataggttctgaatgtttttatatgctatgtcagcacagatagtgcctattcctgtttgagctgaatattttatgttgaatgatggccagttatgatatactgtatatctgaaatcaagattgctgcagctactcttctacttgcttgcccaaggtccataacctatgtcctaggaacaaaattctgaagtcaaacacaagaaataagtcacaggtaggtctaaacatgctattataggcatatagagtttgtcatgttcagaaatttagcatatagagtttgtcatgctcagaaatttagcccacattttcagtctattgtgtataaacctttgtccaggaaactatgtcagggtacataaaacgacaaattaatatacagatctaaatgtaaacaaagagtaaagggggactcatgtgaaaactcctttttattagcgtgttaggctgaaatcatctcttgggcttggcgagcgtgcggaagatgaatcaaaccccacccctatacattaagaaaacaaaatgtattacctctctttcatattttaagtcgttttgatttttttctaagtcaatttttttattgatttcaccaagtttatagaaaaatataccaatattttcaacacaacacaaaaaaaatatatgttcaaccttagatgtaatgaaactaattagttctataagtgttgctatatttttctataaatttggtcaaactttcaataagtttatcttagaaagtcaaaatgacttatgatataaaacggaggaagtatctcctatttttttttaagaaaacgaactattacgtatgcaactagtgaatcaatgaaacaaaaataattaatagctaaaggtggttgagtgaaaaaaaataatatgaaatgaagggaataatcacagtcataaaatttatatacacttgaaggcagattcatggaacccactagaaaaagatctttgttagctcaaaaggcaactgaccgccatgggtctcgtttttatgacaagggagacgcaggtcgcagcttgggatcaggatcctctgcagtcactgcaccgtgcctttataattgacatgtggtcccgatgtgtcgtcaggcaggatctcaatcctgcggcttgaggccacaggtagcggttgtggtgttgccgtgctcagattggaaacgagttttttttattactccatccgtcctaaaataagtgcagctatgggtttcagtgtccaactttgattgatcgtcttatttaaaaaaaatttatgattagtatttttgttgttattagattataaaacatgaatattattttatgtttgacttatgttttttattttttaaaaaaaattaaataagatggacgaataaagttagaaacggaaactcatgattgcgcttattttggaacggagggagtaagtgattgtttcgtttcacatgtgagacacgtttttctaggcaaaatttgctctaggacactcaaaaaatgtgtaattagctgtcggacaccgtaaagacgtgaatttactctaggacactccaaaaatgtggtaatttgctgcaggacactgggcgcattaaaatataatatatgcccaactaatgagagagaaaccacgtgaaatgactattttgcccttatcttcttccttctcctagtcttcttttgttgtcggagggtgtgaggtgccagcacacgggggtctatgagccctgcctacgggagcacacagcaaggaggaggaggagaaggcgtgttgcttctcgaggagtcctcggcgtagcatccagtggcggccggctgccaccgaagccgacgtgcacgagatgcagcaggtggtatccatggatgcgctctgtgtggtgtgctacgccgacgatcgccaccatcgttacccgccaccgcaatgctcctcgccgctgtcaagcccgcactcgtcgagccgctccttctcccggagaaggttcgaattaaatttgaaaatatactgtttatttaattttttctcaataatattcgagatgcaaaactttttacacaaatataccatcggtcttggtcaaaccgtgcgggagagtgaatgtgggaaagacgtcccgagcggtctcgcggaatggaaaagagagaccgaacggtctcgcaaaatcaaacagcgacacagtcggacggctcgatttgattagtgattaattacttaattaaccattaactaataataattagtgattaattatcctaattaatgattaattaataattaattaatcactaattagaatcattaatcactaattacatcggcactggaccggtatcgctcgtgcaatgagcgagaccgcgagatgtctcttttagtccgctcggtctcgctattccaatccgcgagaccgtgcggtctcatgctttccctgcgcgataccgtccacgacgtctttcctatgtcactttcgcgcaacggttgtgcgagaccgacggtatatttctgtaaaatattttgcatcccgaatatttgtgagaaaaaatcgaatgaacagtatattttcaaatttaattcgagaaggttctccatcgtcttcgactactccgtctaaaaatttttggaggcctagtaaaactagcaaggagtaattagttaatcaacaccataatctgttaattagccaagaaatcagcagcatcatcaattctgtacttaggtgtaatttccctcactgtacgttaatctaagaaatttgcacacgtgagaggagcgacggaaaaagacaggaagaagagataagaagatgagagtaaaactgtcattttatttggtttctctctcatcaattgggtggatattatattttaatgcgcctagtgtcctgcagcaaattaccacacttttggagtgtactagagcaaattcacgtctttgcggtgtccgacaactaattacatattttttgagtgtcctgtagcaaattttgccgtttttctattaccgacggtgaaaatactattaataagataaatatttgcttgtcttttcccgcagttatgaatagtagattttgaaaatacctgaataggttctctttgctgttctttttttttaaaagaaaaaactcatacagcacgagaggcatgtgttataaaatcgattccgtcatactggtttgtaatttacaatagaaaaaaatacaatcaattctccagccaaaaataaattaaatcatgtgcacatgcgggcatggctagggtttcccaaaccgccggggccagggttaccgcgtcccagcggtaagtacggttaccgcgcggtaaccgtgaaaaatcgtataaaaccgtgcaaaatttatcaaaaattcaattttttttaaatttatttgaatttaagaaggttaccgtgatatttatattaccgtaccccgcggtaagcccggtaaccacgcggttatcggcggtaaggtaacccgggcagggcaacttcatccttggatattccttttcaggccagccaatttgtttgtacagtgtaaagaactgtccagtttttgtgcttccacatgtaccaggctgttataatcaataactatgaaaaaaaaaagtttggacactacaaatatgaaaaaaaaaaagtttggacactacaaatatgaaaaaaaaagtttggacactacaaaatttgtccaattttcttgccttccactacatgtgtcatgctggtacaataaacaacgaaagaaagggtttggaaaaaggaagttgggaggaacatgctccagagtcccttccgtgatcctgtcccattcatttgcacataaaacgcagccctaatcatctccagtactgtacttcctttccagcaatgcctcctgcatccattctgcccatcaatgtcaccagcttgctgataaacggttcaattcggacatcctgctcaggttgatcccatccattcgaaatcttgatcacatacaaatccaatcaagaaaagcaggagtagaaatggaaagcatggagagcaagcagccacatcacatggccccttgccacaataacatcacaatcacaggtgccaatagcatcacaactcttgatgagtgatgacaaagcaccaatttgttgccacacacacatgcagcaattcaatccaccaacatggagggaaagagatcacatcaagaaaataattaaaaaaaaagaaaccatatcaaagaagaaaaagaagggaaaagaaccaagctgagaataaggacagacatgggtaagcaaggtacagcagagacacccacatcccttgggatgctaagatagaggaggcggatatcaacatcatatcatgaacagtcctaagaaattggatgaagaatcaatcatggctcgcaatntacataaatcatcacaattatcgcctcagcttaacaaggatcaccataattgtcaacagcaatagcagtaacaatagaaaggggggaaaataagaagaaattagaaagaaaagcaaacagaaagaagaggaaagatttcaaagcctcaatttctcaatggtcctaacaaacttcttggcgctgcatctaaatcgccgaaggatcacgcgcgcatctggcgtctcctcctcctcttcctccgccgaatcacggaggaaggaaggaaggaatctcagccccagttcagcggtgcgccgtgacgagcgtctcgatgaatcggaggccgtcgaaccgcggcgcgaacttcttcccctccacacgctgctcccccgccgccgccgccgccgcgcgttccgcgtcccttgacaacgacgaaccctgacgagccaaaaggagaaaaggggatcagaggagatcgaggaagaagagagggggagaagaagaaggggatcggggaggcaaacctggttgtggcggacgaggaaggcgtcgcacctcccgacggcggcggcggcggcctcctgctgctgcggcggctgatcggcgcagtcgcaggcgagcagctcggcccctgacgcggcggccacggcggcggcggacgcgacggcggcggcgatcccccacttcatggcaacgagacggctcctcctccttcctccggcgacgcgccgaccgaagcgcggcgtggcccaccggcgtccggtaggcgcggaagattcgggtgcgtggtgtgaacgcgaggagatgcggtaggcggtggaggaggaaatggcggagtgcgccgtcggctagtcgcgttttaattatagcggaggaggggcggatgtggcgtgttgggggaattaatcggattggagttttttccgcgtcgcgtccggtggggcccacccgctcggcgcccggagctcgtctgtgcgggtggttgagacagagagcggcgatccgcagacgagcggagcggagcggaacctcggtgaatgtgatggctgcctgccacgccacggccggtctgcatttgctgctcctccacgtactgtactgtacatttcgttgggtcaactgctcgtccactcccacctcgcgttgacgagctctgcctcgggggaaaaatctttccacctgtactgttaccctttgtactgtggctataaggttgtccatgcgaacgtttcttttaggaccggatccatctctcgtaagaggggcacgacttctctatgagacacacacctcactgtgctactcggccccttttcatcaagccacggagctaggctccatgttggacgatgtcgtggctaagtctttcatggtctctgctccgcatatgtatctttcccttctacccttggccggaggtggtgaggtagtggacgagctggaggcggtgcaacagcgacaacctagcgacaacgcagcaacccactagatccagcctcccgaccaaccgtggagagagagagagaggcggtgactggcggaggaagaagggaaccagcaaccagcactgtcagccaccccgcgctgccagccacctcgtgcaccgctcgcccctctcgttgtgaggagggagagagacagcggtgagcggctggagagagaggcaagcggtggcgaaagagatagagagataggcgacgggtgacggagaaaaagaggccgggctaaaataaaacgtaggggtaggatagtaaaatgcacatgggctccatgggctagagaacacacgttgtgggacattgtgggctagtgtgtcttcggacacttgcctcagattttttgtaggggcatttggagtgtcttctattgggagatatgtttctcatgtgtggtctcagcttgtatgacccatgtgaggccactgataggtgtggcttctattgggataccctaacagccccatcgtttgacatactggaggaaaatgcgaaacggtatatttgtaaataaaaaaataatttatgaataaaacttttatatacgtgtttttagtgatcttaaagcaaagaccgaaaataaactatgattgaaaaatcccaaaattaactttaaatttaagggtgaaaatttaaattttggctgattagtataagcaaaagcgaaaagatgatgttgcaagttttttcagactaggatataacctcggtttgtgttattatacttttcaaataaatgatgtggtttttttaaaagaaaactatataaaacttgtcttaaaatattaaataaatatatttttaaatttatattagttaaaatccaattaatcatgccttaataattttttagtttatctttcccttaatctttctcaaacaccgtcgtttgtttgcacgatacattgaaacattgaaaatttgtgggctttaaacatgtatttggtctgaggaccaagtagggtataatggaaccatcactgtttttggatcgaattagacttttttttttttgttggagagacagggatggactggagctacttcgatcagtgatttgtgaatggaaagaaactaacgtccgtgaccaacttctctgtggttttcgataaacccatacctatttctgatcaagtgatcgatcatattaggttggatccaatgatgccaaagtcgggagcggcaaatggcagaaatggatgaagtgctcgaggaagaagttgaatgtgtgcggtaaggaagagaaagcggagaccgcctccatctgcgacgcgccactgccttcactcgccgtcctacctttccgacgccactgactgccccccgcctccgctcgccgtctgcgttcgttcgtgacgcatcccagctgagatgaattgaatagaagagaaaatctaatcggctaatcaataagggtctattcggttcacaggattttaaaatcataggaatatgaaaaacgtaaaaataatttaggaatgcacgtgcaaaacaaaggattggaacacagaaatttttcctatacttagctaaacaaaaaaggatggagtggatgttgtcatttctgtggaattagtatattttggaggatttttggaggattggcatagcgtttctatggaaaatttttctttgaatcctacaaaccgaatgcatggatagtgcttattgcataggaattgagatttcctttaggaatccttcgaaacgaataaggcctaatcatctgccctgccttgcttccttggctcggtgccactttccgccggccaaccaccgtacgtgcgcccgtgccggtgccggcttgccgccgccgccgttgtcctctacatatgcacgtcgcgtggccaccccttgctgcggccttgccgtcgccactcgatcgtcggccccgatcaccgcacgtggacgctggtcaccgagaaggatcaggcatgccaaccaggccaccatgagccctaacagtaacaagtaggccgatacgcgaggcgagcagatgatacgcggaaaagctaattagcacgcacgcacgcaccgntaacgcgcattttgatgagttaagtagctagttagttagttaagaataatgacaaaattaagaggatactatttttttgggagaaatttttactaccaaattgaaaactttcaagttagatttaaaattttggacttaagattaaactttaaagtcaaattttaaaactttcaactcaaactttaaaaattttcaattctgtcggagatatgggcccgggggtatgcggagtaaaggagtatgcggagtaaaggagagctgcttccctttccagccacgtggctctgcgagctggtcccacctgtatacctcgtgagtcactaaggcgatggggagagcctcgggggtcgacgacatcccctcgggggtgacgtcaccccctcgggctctctcgtcgttttagcccgaggccctctctcggggggaagtgtgagaggggagtccaggctaggcggccataaatgtgcagcgccccaaccgtcccttgctgcattcaatgcggcgagggcagacgtgcggcgtgcccgaccgactcctgtcagtcggatgcgaccggtctgtgaccagtctattgccggtcatggtcgattgaacgggtggtcgtgcccccacgtcgcctctgtctccgcggagtggcggtaggtacgccccgtcacatccgggcgtcggtcgatgcagggctaccgcaagtcctcattcatttatgagggaatgacagggctgccccccgtgtcaggcgggagacggcgctgggccccactcaaggaccgaccgatgcttagcttccagcaaaaggcacgggttgaaacccggtggcagtagggagaagggccccctcccctccctccgatggaggggaagggtagaaacggcgcatgtggtatccccttaagctataaaaggaggaccttgcccaccaaaagaggggggctagagagagaggaagagaaggaggcaaggggaaccttgtaaaaaagttcattgataatcccaaacgcaggagtagggtgttacactccagagcggcctgaacctgggtaatcgacttgtgtgctttctaaccgggaatcggagggacgaacacgcgacttcggagagatgagtctctgacctcggccgaactcacgaaaggggggtcacgcgactccccgcgatcgggggtcttccctcgacaaactcgaaatttaaatttgtaacacaaattttgaaaactttcaactcggatttgaaaattttcagctcgagatttgaaaactttcgaaaccagatctgaaaactttcaacttcaaatctaaaaactttcaacccaaagatctaaaaatacatgtgctgaagattaaaaaaaataaaaaaaaacaccaaaaaagtgaaaatcacaaaagggaaaaaaaaaagaaacagaaggtaccagctagggcgcgcgagacctccgttgctgacgtgcgcgcgccagttagcaacccacatgatacggcaatatattttatgggattttttttttgccgtacctacctacatgggccttgggtcggcaattttttaggtggtccggggaccaccagaccatccatcagatccgtcggtgattacatttcctaataatacgaatctagacagataatgtcccattcatctaaaattccttatatttcgagaaggggagcgtaattaatatgtctatagcacagcagacccgcctaacctcaaagaccaagggaggatgtcggcaattggcaatttagcatgtttcatgggccacagttcagtgagacccgctagctgaacatcatcttcggagaaaaaagaagacggggaaagcgaggggaagtaacgtcgtcgtcgccgtggaatgtacgcatggctgggagcatcgcgtggggagaaagcagtccccagccgaggaaggcgcccaaccgatagtagatatgctccatatttgcatcatacgcatacttccccgttatgttaatgttagtgccgttccattcgattgatccattcacccggcgcctcacgcaagcgcttgcgtcgccacggattgtgacaaccggcctcatccaaattgccagttccatgggagttatttttatatacagtttcagttttagcttctttcgcttttgttatatattttttttcaagcttgatgagtggaccacacatgcatcatggctagataaatgaacgacctaataatcataaagaaatgaaattaaggccctatttagtttacaaacaaaatcttttcaccaaacaaaactaattacacagattatatgtaaattgcgagacgaatcttttaagcctaagcgttctatgatttgataatgtggtgctacagtaaacatttgctaatgacagattaattaggcttaataaattcgtctcgtaatttacacgcaatatgtgtaattagttttttctatgtttaatactttaaatgtgtgtctgtatatccgatgtgacacgccaaaacttttcgtctagcgaaataaacagagcctaaaagttgttgaatataaatatgtaaggatcatgcatcgatcaaccggggccgtcgctgttgttccgtcatgctgtccctccctcgtcggctttctggtttggttggacgtgcttttcggagataggggcagtgcgtgtgcgtcgagaatatacctccctccaaaatgcattcctgtacacattttttatgtgcaaaagatggagtactagattaattaaaggagaggaaaaacaagatgaggctgcatgagagatgctatatgtccattcaaaagtgcgtgttgggatgaattatccaaaatatatggtgcacctcgatcgatcgccttgcacctttgtgatgcgttgtgatggataattggatactgtgtacattgtcatcgctagcttatgtatggtcgaactgattagacatgcatatgcatccgccggttctatatccaatttaggatatccagagattagggataagattcaaccagatgttattcatgtataactagaaaaatatccggggaaaaccattaaacataaaaactgaacctaacggtttctctaaattcatggaaaaaatattagtataggcatgtatactagataaccaactaatcaatactaagttaatgtcaactttatttggtaggaaaataaattagattaagtaacatgacactattaaataatcatcactgtactgctgttaatttctaattgtcgatgaaagacttgtcgaaaacaactattacgggcgaggaaaataggtgtgctcgctttgacttgagcaaacaactattatccttttcttttcaaattcctttacagtagacaatcatataaaaattttagagaaaaatcagtaagagctggtaccttttgaaaaattttctttaaagtctatcccttttatttgattccttcattttttatgtgatatactcaaatattatttctgtaattttttatgttttctatttctctattttatagtcgtatttctgttaaaattatatgttgttcttttagtttctatggttttttcaatcctaaattcgaagaaccacccaaaaacaaactgagaggctgttttggtacagctccaactcctaaatttaactccaggagttgggtatagagtggagttgtgcagctgcctaaacccagctccacaactctagttcattttgtgagagagttttacccagcttcattcccagttttgatagagctaaaactgtttagctgagctccagttctaggagggatggagctggagctgtgccaaactcgccctgaattccaaattcgtgtggagaagaaccgcggggaaagtaggcaaggcaatttgcagagttccagtggtgggaacagcgcaaacgtggacagagaaagaggcataggaatacagtggatcacggggcagagaatctgtctgcgttcacactcacttgtgaagatttggctctctttgcgtggtcggcgcgagatgccccacatccattttcaccttgggttactttatttttcacactgttaccattagtattactcgctctcttgccaaatagtactaagttgtttaattttttcttcttctgtttattccaaatactagtaaattaaagttagtgaaaataaaaataataaatgtattagaagctgataaaataagaaatagttaatttaataaagtgagcatctttttagttttataatgaacggacgggagtagtattcacctttactagcaggcgaggcgaccatgtcatgtgtacttgaagcctgacatttagcggaaagtcaactttaagtaattactccgaaaaaaacaaaccctgagtttccgtatctctccgtaaaaaaaaaggcaaaaccctgggtttccgtgtccaattttgactgtccgtcttatatgaaatttttttataattcatattttcattttgttagatgataaaacatgattaatattttatgcgtgacttgtccttttattttttttttaatttttttaaataaaataaatggtcaaacgttggacacgaaaacaggtttgtcttttttttgaccggaggtttgtcttttttttttttttttttttttttgaccggagggagtaggcagcagtacttctactaggcatcgaatactcgaaatgcgacgcgagccaaatcaatatacctgcccaagaaaaaaaacgtttgccaaaatttgcacaaaattcaaactcagattaagcaggaagaacagcacagtcaattaatgatggtagtagtaactaattcgttcatctttcacccatcctgaggctaactgaaatccattctgctcttcgcgaatgctaatctagctacctaactaagccatgaatcctgctctgccatggcggttcaacggtgagcggtgacgagggtctcgatgaagcgcagcccgtcgaaccgcggcgcgaaccggtcctccgccgcgctcctccgcccattccccctcgacgccggcgacccctgcagaagtaacaaacaaacacgcgcgagcgtgagcaatccacacccagccacaaggaacaaaggtctcgggatggagcgtgccgtgggattggagcatggggtgacgcagcgctcggtggcggcggcggtggcggcggacgcgacggcggtggccgcggccgaggcagtggcggcggcggcggcggcccacttcatctccggcagacggcgagggggggaggagagaccgccgcctcctctggagaagagcgagtgagctgagactgtgatggcggctgctgctgctgcagtgctcacacacagtcacacttgcggctatttatggcgggggaattcggcggcggaatcttgcggggcggattcgggcggattggatggcgtggcgtcacgggcggtcggtcggtggcgccggcgccggccacgtgggggcggcggtacagtcgaggcagtggactagtggtggagtgggcggctgttagcggcaaaacgaaatgtagcttgtctagcaaaacagaaaggcagcttttctggattagagcttaacattaaatagcaagttacaagaaagttaaacgtggccatagtggcctcctaattgtgcgtgccacactccttgccacttcgcgccatcccacgaactggagcacaccacgcacgacaccacggactccgcacgaacgcagcgtgcgtcaagcccactatgaacacaaacaggatgaacagatcatgtacaagactcaacgtaaaaacggagggaaactaactactctgagcagctagacttattactaacaaatcacccccttaagtctgaccgctcttgtcaagagaacagacaccgatctttaaacgaagctcctgaaacctggttctgcccagagatttggtgaatatatcaccgagctgctccgcagttcccacgaacatcatttcgatcagtttcttttctgcacactcccggatataatgatatttgacatcgatatgcttactccggtcatgatgcactggattttttatcaatgatattgtggactggttgtccaccttcagcagcggtgcggcgatctcgtcgcccagcacctccgctaacagccgcgcgagccatactccttgacatgttgcggcggctgcggcgatgtactcggcctcacaggaggacaatgccaccaccttctgcttggaggactgccaagtgataggcccgccattgacgaagaaaatctggccggacgtgctctttcgctcatctggatcgccagccagatcactgtcagagtaaccaaccaacattggcaaagcgcaccgtgcacctgggccaaatcgaattccccagcagcgagtgcctgccacatagcgcagtatgcgccgaacggctgcgagatgatcttccctgggtgactccatgaagcgactgacatacccaacagagaatgccaggtcgggtcgcgtgttgacgagatagcgcagactcccaaccaagctgcgatacaatgtagcatccacaagtggaaaatctgaaccctttctcaatttcaaacgtacctccatgggagtctgacagggattgcagtccttgagtcctgccttctcaagaatcttgccggcatatgcggcttgccccagcgtgatcccatcactgtcctgggtaacctcgatgccgaggtagtatctgagtgccccaaatcactcatcttgaagagcttcatcatctctcccttgaagctgcggatctcgtcgtcgtgatcgccggtgatgatgaggtcatcgacgtagacgcccaccgtcagtcgtcttcctcccctggtgcgtgtgtacacaccatgctcggagctgctgcggtgaaagccgagtgacagcaaggagctatcaagtttggcattccacgcgcgaggcgcctggcgcaagccgtaaagagctttgtgcaggcgatacaccttgttcttgtggttgtcgtcgacgaaacccagcggctgcgagacataaacttcctcgagcagctcgccgttgaggaatgccgacttgacgtccatgtggtggacttgccacccttggtgcgcggcgacggcgagaaggaggcgcaccgattccagccgggcgacaggtgcgaagacctcgtcgaagtccaccccctgtcattggacgtaccccttagcgacgaggcgcgccttgtagcgcacgatcgccccctgttcgtcacgtttcagcttgtagacccattttagcccaattgcacggtggccatggggtaggtcagtgagcgaccaagtgtcgttgtcgacgatcgcgttaagctcgtcttgcatggcgccacgccagtttggatccgcctcagccagtgaagcaggttcgtcggcgctcacaacatggagctcgagctattccagcacccgcggagcgtgtccaggcggtgaggcattccccagcaggttatccaccaggcggtagcgaggcacgacgtcgtcatctgcgtcggcgtccaggatggaatcctgggtaggcggcatgacaaactcaaccgcctccggcaacggaggcgacggaggtgccggcgtcgtgggggccgacggagccggcgatggtggcgagggcggagtcggcaacgaagcaggtgccgtcccgatggtggtcgtcaccacctattcgacggtgaacggctcgagctggggagcaccatcgggcgtcactggtccccagtcccaggcggcgtcttcatcaaacaccacgtccctgacacatggacgcgctcgctgactggatcatagagccggtaggccttcgagccttgcacgtagccgaggagcaccattggcgcactccggtcatcgagtttcttcagcccgggcttggtgatcttgacgtgccccctgcacccgaaagtgcgccggaaatgcatagcgggccgttggccataccatgcttcatagggcgtttggttgtccaagcttttcgtcggcgaacgattcaagagaaagaccgctgtggacatggcctctccccagaaccgcccaggaacacccttcgccttcaacatgctgcgggcagtggcgacgatggtttggtttcgatgctccactactccgttctgctgcggggagtagggcgccgtcaactgccgaccaactccgagattggcgcagtattccccaaattcgattgaggtgaattcgccgccacgatccgtgcgcagtgcacggagtttgcgcccggactccacctctgcacgggcctgaaagtgcttgatggcgttcgcggcctcatccttgctcctgatcaaggttagccacatatagcggctcatgtcatcgacaagcaacaaaaaataccaattaccagccggcgttgcaggttcgatcggcccacagagatcgccgtggacgagctccaggtgttcgtcagcgcggtacttggactacgtcgggaacgccgctcgccgctgcttcccgagcaaacagccatcgcagacttgagtgacttgttgcagcagcggcagcccacgaaccatttcctgttgcgcgagcttgcggagagcaggaaagttgaggtggccgtacctggcgtgccaccgccacgccggctcggcgctccttgccgcgaggcagaccggacggtcgatgtacagattgatggtgtagaggcagtcgtcggagcgtcggacacggacgagtaggtgccctcgaggatcccacacgcgcaggacgccgtgatgaatcagtaccttgctgccggaacgatccagctgtccaaggctgacgatgttcgccatgagccgcgggatgtagtagaccccggcgatgccgcggtgttccccgaacctgcaggagaacaggacggtgccgcggccctcgatgcgaaccaccgagccgtcgccaaacctgacagtgccggtgaccaccgtgtcgagctcggcgaaagcggagcgggacccggtcatatggttggttgcgccagtatccaggatccacattgccggatcatgttcgccaccgtcgtctagctgcgcgaagacccttgcctcgactacggcgagttcgcccatcggcgaaggcgccctcggcgcgctcggtggcgagacgacgtttgtcggtgcagcgacgcgaggacgcggcggatccagctgcaccttggctaggagcagagcaggctcttcgtcctcctcctgggctacgtaagcttgctgggccttgggcttgctgcgacagtctttggcccaatgtcccctcttgccgcaattcttgcaatttcccgggttacggcctcccgggttggctggcttgggctgggcctccttcggggctccaccgtccttcttcccacgccctcgaccccggtggtcgccgttgccgccggaggagtgagcggcgtcttgcagagaggccgccttgcggaatttcgccagccattcttcctcggtgaagaggagacggccattggcgtcgacctgactcgatgccgccgcagtcttgcgctgcttgcgttgctcgacggagcgcagacgcccagtaacctcctcgagagacacctcattgacgtcgagcaaggtctcaatcgagatggctatttgctggagatgttctgggacaacctgcaacaatttctgaacgacctcagcttcagtgatattatcacctaaggtgcgaaggttgttggcgaggccgccgatccgcatcgagaagtcgtcgacggtttcaccgtccttgaagaggatatcaccgaattctcggcgcagctgctgtgcattcacctcacgcacgcgctgcacaccgatacggcgagtcttgatcgcttcccacgcctcctgcgccgtctccttgacagcgagcgtggcgagcatctcggcgggcacggcgcgaagtatcgcggcgagcgcctgccggtcctgccgatagtcgacgagatcatcgccctccggctccaccgcgccccacagaccttgggcctgcatgttcacccacattaccagcgcccagtcttggtaatttgtgtgggtgagtgtcgggtagacgacgctgctcgtggtcgcctcgcggacgacgcgttccaccacgacttggccgcggctgccatgacggccacggcgcggagacggcgagcgccagcgacgacgcggtggtgagtgggagacgcgtggcgttggtagcgacatcaggaaccccggcgatcaccgaaggctctgataccaattgttagcggcaaaacgaaaaactgtagcttgtctggcaaaacagaaacagagcaacacagagtattttggcgctgcattaactggcagcttttctggattagagcttaaccttaaatagcaaattacaagaaagttaaacgtggccatagtggcctcctaattgtgcgtgccacactccttgccacttcgcgccatcccacgaactggagcacaccatgcacgacaccacggactccgcacgaacgcagcgtgcgtcaagcccactatgcacacaaacaggatgaacagatcatgtgcaagactcaacgtaaaaacagagggaaactaactactctgagcagctagacttattactaacagcggcagcggtgggtggcgtcgggaagccgcgggcgcgagcaccgccgtgggctggacttcacttgactttgggctctctctctctctctctctgggccctgttcacttagatggtcgtgtgggctcggactacgagggcccgtcagataaaactccctcaactgtcgtccgagtagcattcatgttctccagccataaaattagatatatcaactccttcaattattaaaatatgtgcaaacaatattcctagatggttttggaggtggtttcggctgacatggcggtcttgaccgattctttgtcctacgtggcgcttacgtggtattaaaataaaaacaaaaatcttatctttactatagagttataacctactaattctaaagctcaacatgccacctcatcatccactagcaataatacatacaaaacttatcatagtgtaacatgcaagcatgcaacatcatctataattcattgaattctacaaatcaatatccaatcatcttccttcacattatttttcacaatatttttaacatatatatatccattatttttataatacttaacaaatattcatccatataatcaaagtgcggaatattatatttcatacagagtctactaaatttatttctctattaacatagtttcacaaatcagttttatttgtttttaataactaatagaatttttatttttagctagattattacaaaatataaaagttacttagtaatttccgcagcaaagcgcagggaatcacctaagttaaaaaaaaatgtgggacccgtatgtcattcacacaaaaaagtattgtgggacccacatgtcatcctccctctcgctctcccttatctctctctcggtagctgcggcggtgatggtggggacgaggcggaggggagcgacggctgcggcggtcaggaggaggaggagaaggca

SEQ ID NO: 51529 - DNA, 6939 bp, Oryza sativa
caagactgccaggtaggcgccacgtcagctaaaaccacctccaaaaccacttagggacattgtttgcaccggttttgtggttggaggacatgaatcatactcgggcgatagttgagggagtccaagtatactttttccttagataaaatcataaaaggtggtctttaggacttggcaaactcttcttggaaaaagtagaccgaaggtccctcaacttgtcatcgagttacaaaatcgtcccccaaccgcaaaaccagatatccggcgtctcttaactaatcaaaaccaatcacaataggtcattctgtggttttgaccccggttttgtcctacgtggcggctgagtcagcgtgggacccacgtgggacccacatgtatggatgccacatcatccttctctctcccttcctcctctctctcactcttgtcacgttctctaggcaaagccggccggtggcaagggaggaggcgccggggagaggcgggagaggaggaggtggcgggcgacatggcggcggcgggtcctagatgatagtgccaactcttttatcttctttctgtctcggcaatggttgccgacagagaggggctgttgccggcctccttccccttctcttctctccctaaatgaaatcgacggctggcagaagatgaagaagatgacgccggcctcatcgccgaccttccctcctccttccttgagctcctcgccggcgcccatggccaccccgccttcctcttccttcaaggcgcagctcgcgtccgtgctcggctgagcgtcggctggctctgtgtggcggcagcaatgaaaaggtggggccggcgccggggtggtcgtggaggcggcgcccgtgcgggccggcctggccacgcgcggggggggggggcgctttttcaagccccacattagtcctacgaggtgatcaaataaaatataagaaaaaagtacgaattaccccctgaacaattacggtcgacctaattattacctccctgaacttgaaaccagacatagctcaccctaaattttcaacaccggacgaattacccccctatgcaatttagagtggttttatcctacgtggcgtacgcgtggcaatccagtcagcattttcttttttttaaaaaatgatgtgacccacataacatacctcctcttccccaattcccccctctttctctctccttgcgtcgtctggcgcgggtgcaagtcggcggtgggcgggtcacggtcgggccaatcgacacgctgaatcagggggtagcaggatcagctagagttagtcatcctgcttcttgagcttgttgacacgctgctagagctggtcaagcctgacgacgaggaaggtgacagggaagaaggatccagtagaggaccagcgcagtggcgatgaggagcgcgctgcgctgcggcttcatgatggatttctggtggcggaggtgctcggacggggtgcagtggtgctcgtcattgtaggtgggccgcacctcgtacttccagtagatgtccatcagcaggaagaggcagaagagcaccatcaacatcatcgtcttcagcgcgctccgcaccacggagatcatcccgcaccgggagcctgtccagcactggcagcgtcagaagcagcaccatgatcgcctcaagcaccacccactccaacgtcgtcgctgccgaatcgaaactctcggattcgagctcgtggaggaaaaggaggcgagggatatggggtgagcgccgcgtcatcggcatgggcgcaagtcgagcggcgcgcggcccattccctaaaacttcccgggcgccgccctccgctcctcctctctccctcccgcccccatcccctcctcctccatctccacctcctccgactccctccaccaccgcgcactcctggccacccactctgtcctggccttctccacctctgcctcggcagcggcggtggcagccgaggggcccaccgcctccgtgtcttgtgcgtcgaccgcccgctttcgcgcgctgccgtgcgccgctgtgcgcgccggcgcgaggagagagaaaaagaggggtagaggaggtattacacgtgggtctcaccattttttaaaaagaaaatattgattagatcgccacgcgtacttcacgtgggacaaaaccgctttggattagattgaggggggtaattcatccggtattgaaagtttagagtgagtgacgtctggtttttaggttcaggggtaattgggtcgactagaatagtttatggggcaattcatactttttttcaaaaaaataactttattcccaatctacattaaaacaatatactaacagataagattatatcctcgaatctgtactaacgtgacaacaaatttcctcgaaactgtgaggaatatttgatacaatataaactatcactaatacaatatgtcttatctagttgatgaaaaatgccactaaaaataataagaggatgatactaataggatgaagatggaggaaagaagacaaaaagaaataccatgacttacatatcctagcacgtttgctttatagacagagaaattactatattagcaaaatatcatagttagttgagtcatttttttactaatcacactaaagtttggttcaaaagcttaaatatgcataatatttataggcaccagatttgaattctgctaggtggagtcatgcagccacaactccaccaccacgccaccacggtcatttgagacaaaagtttaaaattatattgccattttaaaatgttaaattatatatgctattatatgagaaaaatataacgatgctagccgcacaatctgcgcgggtcctatactattttagtcggtttcctctccacatgatgaaacaagtagcgtcatctgttgactgccctgccacgggcacctcccccgcgcgcacgtcacgcttttgtgcgagtttattcaaattctgaggcttgccgatttgttcgtcaacaaaacaagcccatcaacacacaatcgttaaaatggtagcccaactacctgatagcgtcacacctgtgcctccttgtctcctaatcacatcatccttttattcagagcaagcaacatcaatggggatcaatctatatacacacaacaagcataccttgtttgtagaagatctgcaaacattacagaaattaacctactgtactaagcttgtcagcctctttacttctttagttcttccctcattctgataggctgctccaatcgatcccgcaaagccagtccgcagtgtcctcttccgactatcgtctttagccttctgtgtcttttgttcagagcattagcaatggtcagctcagatgtggtactttcttgtagaaaagaattagttactcggttgacaaaactaacataaccttgattaactgttactaactgacaaatttctccatcaggttagcatatgagggtaatggggattgttttgttcagtttttactatccacagacattccaattgaatcaccatgcatgggtgctgttaaggctatcaatggacattttgccctctatataagctgttagaatgcgcagcccgacccatcaaccgtaggccacccagatcatattgggcctgttctaccacaggcccaactagccacaactttagtggtgctgggcctacacaatccaaaaaaactagtcgatataggtgaggactgtccccaccttttaagtcatgcttcccatcatcaattaccaattacaacgtagcttcctttatggattaatacttacactgacaaaactggcattgttgatttcggttagtttaaaaggtacttagtgacatatgctgctacatgcttctactaatactttactagttcaggaatctaaagtgcctaacctagaaaactgcaagctgaaactttaatcaaaactacaagaactagtgaaatgttgaaataggtagccgacaaatctagactttaaataaaaaggaaaacaaagtattgttgctaaaaactaggtgctgttcatacgaaaaaggacaaaactaatacggctagatgagagctgtggtacagctgatcctaacttgaattaaatttaaaaatatactttttttaataatttgcatttatatacctgggtggtaaagtttagcaaacatatacctcctccacgcgctggaaatgcgggagtaagatagtaacacagggcacggcgcgggaacgcggtaccgtagcctgggagtgcaggaccggcacggtcgcgcagaccgggggtgcggaaccgagccggtcccgcgtcacggctgtgcgagttggtgttgcacgcgggaccggccaccggcccgaccggtcacacagaacgcagccccaaacggtagcaccgagccggtcccgtggggcatcgatgccacattcctagcgcgcgggatcgcactactactccgcacctccattctgcgggaccgcatcgaaagttgttttgtccaccgaaagttcttttgtcctcttgctccatttggcattctcagccagaaataaaggagagagtgattctcttctctagtcctagcatttttcaggggatgtccgccaaaagtttgttgtcgtctggttacagagcctactcgttgagtgcctataaaatgaaagttacgaaatgaaagaaacagactcaagtatagcatataattcatattcgtagagtctatcattggtgtaagcttcaataagttagtgcgctttgcgaattcacaggccctatcttgtggtatgaactgagtacgcgatgatttatggcgcatattgggggcttaccaaaagataatgctgtgaatttgcaaagcgctcaaacccactgaagtgttgtgtaaaggtaaatatctgtaagtgttcgtgaagggaaagcgggtaaatatttcgaatttatttctttagaaatgtagctgacacattagaaagtttgaacacacaacattacatattagttcgaaagagcaaaatataaaatcgttccactcattagcctcatcatcaaaatttcgtgatgtgctagtgtcctttttctttccctttcttctagcactagctggaggtctgcgtcttgacaaagataatctttcaggtgaatgtcactcgcggacagacctatgtgccaccttaacaccgctgaaatcaacatgcccgtagtcttgggtcagctgagttattggaggtggttcatcaatatgcgacggtcctatctcgtgtagtgctgttgacgacccccaccgtagctacatggttctctgtaggactgtgtgctgtcggcatatcctatcatttggtcggcagtgtacattcctacaaaacatggaatccaaagttgtagcccactaacatactggagctaaaatattttaaagtatattgtaatttgtacatgttgtttgtggttgcatgataggtgattgactgaacaaccaatctccttggcctaacatgtccaaaaagcttggtccttgtggttgtacattttcagttatggacatttggtagatcccctgcaggtgcagcgctaatttaatatcgcaatataaggatcgtcaaaaatgaaacacattatgtacgaaccagtgttgtatgtggaagctccataccactgatcgttcatacccgttggaaacatgagcatgttaacttaaggtacacctgcaaaattaagcaaatatgtttgtgactaactaaattacaaaatgatgaacattaacatgcgtgtttattgaactaccggaaaacgctacgtgccctggaaagaactgtaagcttccatcttctgtacacatcagagggaccatttggctggatcctgcgaaccacacaaaccctccctgccattcactggaggtacttacacgcagaatagaagggatcactgctatactacctgcaataatctctataggtgaacattgaatttaaaaatagcaccagttgatccatgtcggaaaaaaaaataggaccatctaatggacaacaaataattaagcttggtttttctagagcttttcaactcctgcctcacatatatgagagagcaaagaaaaaaaatgcatagggaatagaacttgcaatagaactatagaaataaaaggctttccaagcaatccattgtcccacacagcgcatggctgtagaaaggtttgcaaagttcagaaaataaatggtaaaacgaccacctaatttcagtatattctgaaaattagtccataaaaatagtgtgtattgtacttttaagtccatagattaaattagcattaggcggaacaattaattctataagttaggccacttgtacttaaaaaaactgtgcatgaaatgagctaaattttaggacgattttcataataatgcgtagagcttttggtttaatttagagaaaggttaccataagtataatgattaaaaacaattcgtgcatctaatataattcatatattttcatatacatagcttgtaacatgttgattaaagtagtgtgaatgctagactatatacagttgtactagatgagaagttaacaagtcatccatgcaaaaatattttgtgaaacagtttctacccggtaccgatgtgaacccttgatgccactgtgatcctcctgttattgttggtataggcctaaccacttgcgtgctaacaagttaacaagtagtatgctcgaaaactatttgtatcataataggctttacctgcattgtccgatcggtttatcgtagacggtgccacaggccttgccgacgtccaggacgtgtggaagctgagggtcttgccgatgtggaaggcctagaagaggtagacggttgttccggtagggggtccgcaaacctgtgtcctgtgggacggtggacttctgatgcatgcctgtactatgcccccgcataatacgtttgcatttctgtcgcattcggtctagagcagacat

SEQ ID NO: 51530 - DNA, 28560 bp, Oryza sativa
  unsure (1)..(28560): unsure at all n locations
cttccagaatcctacccgttactcagtagagacatcgatgcatggcaccatgcatggctaatgtcttccagtcgtccaagtggtatgtcggtcttcataacgcggactttcccaatgtggggagtcgacgaacgttggttaccaaggtaactaatttttttacacacttacatgaatttttgttaatttttttgctgcaattattgtaaattttgtctgacgcaacaactcgttatgcaaggatgtcttgttgcaggcattcttctttttgttaggatgttgcaggctagagggcattacgattacatggtagcaagacaacaaagtgcacgccgacggaaagcaaataaaagggaagacactgacgaggaagatgaagatgtgtcatctagagacacacgccgatagattatacacaagggacttctaactgcattggtcgacagatggaggccggagactcacactttccacctcccgtgtggagagatggcaattacactgcgagatgtatccatgcttatagggctaccacttgcaggacagacaattgtcctccccgacccacctgtggaatggagggatgatattattggaagatatgcttacattgttccagaggatgatagagacatgaaaggacttttctataaagatgaagcgcgcggccctacgttacactggctcatccagttcgaggaaaaactaattcatacaaaaaacttccattgatgatattatgttttgttattgaaattttctgtgtacctttgtaggtttctttcacgagagaggacgtagaaaattaccatgtggaattgcatttggaggcttaccttctatggctttttggatgggttatgttcacaagtggacacggatacatagtggatgcgagaatgatttccatagcaagatttattgtgcagggcaacatagaaagttttccctagtggagttggggatcagcagttttggctacaacttaccgagatctatgtgaagcatgcacaaagacaagctttaagcaacctatgtttactggttgtccgttgttgttcatgctatggtcttaagaacgcttcccattgggacgaccatacgtgcctggaactgtggcatattctagcttatttggtaacactacagatgataggcctacttatggcatgcgttggtgctagggaccggtacgtagaaatttttttttgtacatttgcatttagttcgtacagctataatcttactatttatttaataacatgcaaccacagtggacgaacgttcaggctcgaagcgtgtacgagtacttcactgaggcgttcgatctacttaaggaggatacgttcagtggtgtccatacacggaagaggagacacaacgtcgtgcccctgccgacctcagtatactctacttgcgtgactcgtcttactggctgatgaaaaagatgcttgtctacgatatagccgttgaggcgtacaatctacagcgtgtaatgaggcaattcagcctttaccaagaagtgcctctcctgcttggtgaaacagtccccccctccaaaaaaatacacttataagttaaattcaattggattcccattaattaccgtgtgtccgaattatactacttaactcaacacctaatgatgagtttttttgttagaaaagaggaagggagatgctagcgtgtggcgaaatatcgttggtaagatgaccccttgggtcgaacaatgttcgagggcaacattcgatatattaacgaatccagaccgtacgaccgtcgtatgtacgcgttgtacatgcggtggtacatcgcataaacacgcgtatgccttgtgacaatagaggatccatatattcctgaaatagccgacgtggacacgctgtaccctatgcagtcagcgccagttacccacctgacggtaacatattatccactaaatttttaatgaaacaataatcttaccgcaacctgtaatcattgtaacatttattttcgtagggcgatattgcggaggaactatattctgacacaacctcactgtgggagaagctgcgtgacaatatagctgggtcccttgaggagatgatgtctgctctggaccgaatgcgacagaaatgcaaacgtattatgcggggggcatcgtgcaggcgtgcatcagaagtccaccgtcccacaggacacaggtttgcggaccccctactggaacaaccgtctacctcttctacctcttctaggccttcgacataggcaagaccctcagcttccacacgtcctaggtcgtcggcaaggcctgtggcaccgtctacgataaactgaccggacaatgcaggtaaagcctattatgatacaaatagttttcgagcatactacttgttaacttgttagcatgcagttggttaggcctataccaacaacaaaaggaggatcacagtggcatcaagggtttacatcggtaccggtagaaactgtttcacaaaatatttttgtatggatgacttgttaacttctctagtactattgtatatagtatagcattcacacgactctaatcaacctgttacaagctatgtatatgaaaacatattaattatattaggtgcacgaattattttaaatcattatagttatggtaacctttctctaaattaaaccaaaagctttacacattattatgaaaatcgtcctaaaatttagctctttttcatgcacagtttttttacgtacaagtggcataacttatagaattaattgttccaccccatgctaatttaatctagggacttaaaagtacaatacacactatttttatggactaattttcagaatataccaaaattaggtggtcattttaccatttattttctgaactttgcaaacctttctacagtcatgcgctgtgtgggaccatggattgcttggaaagccttttatttctgtagttctattgcaagttctattccctatgcattttttttctttgctctctcgtacatgtgaggcaggagttgaaaagctccagaaaaaccaagcttgattatttttccccatcatatggtcctttttttttgctggcatggatcaactggtgctatttttgaattcaatgtttacctatagagattattgcaggtagtacagagtgatcccttctattccgcatacaactaccaccagtgaatggcagggagggtttgcacggttcgtaggatccagccaaatggtccctccgatgtgtacagaagatggaagctcgtagttccttccggggcacgtatcgtttttcggtagttcaataaacacacatgttaatgttcatcattgtgtaatttagtgagtcacaaacatatttgcttaatggatttttcattaatccggcagcccccacatgaacagatgtgataaatttcaacgcataaatctccatggggaatactcaccttggggatcgatgtggcctcgttgttcattgatggtccaagattcaactcttcagcggcgagatccaacagaaacacctctgctgcctggccctggctgcgccacaagcccacaaccaggagctccaaccggcggagaagacgccgacaacatcgaggtcgctgcttcttgcttcgccgcatcctctctcgatctctctctcaccgacagcttctcttgctttcctcccattcatgcaggagaaattggaagatgaggatttatgtttttgaactgtagcttgggctcgtttgtggctgaagggaggacacgccttgggctggcttgtgcacaaatcttgaagaaaaatcccatggccacaaatccagctgacaaaagcgcaaaaaaaaaaaaaacagcaggcagctgtctaacaaatccctaattttgtaatctgctcccggtaataaaccctttactaaactagcggtgaagatgcagctctagatccaatccgtccatctgggctttccccttcttcctaccatgatcacagccgtccatccccctcgccctcgtgccttcgcgaccctgctctcctcggtgaccgtgtaggcttgccgccggcaccatcagtgactcgaccagaggcttctcgttcccgcgcttgccaccggagcccagccggagcgtcacatcaaccgtggcactcgccggctcacccgtcgtcggcgaggacgatggcgacggcgacaacaagctgctctttggaaagagggatcccggcggccacctgtgaccaatctgcgacggcggcagcggcaagaagctgagtcgcacaggtgtaagacgccagaagagcaccgcaagttgcacggttagagcaaccaccggaagcggtggcggtggcgacaacgacgactgcggcggcggtggcagcagctgcctcgcggacgtgatcctcgtggcggcggcagtgatcctcgtggccggccatggcttgctgcgacgggaacctcttgccgcacaccctgcacgcgaacgacgacgaccttcccttgggcggatcgcgagcaccaccaccagctggcttcgtcgccgtcttctccttcttccccgccaccggcgacgtcgagctcgcgctggaggagcgcggcctcatcggagacatggctgccggccgcgatggatcgatgaaaatgggtagtcgtagtgtagtagagtacaggaggggatttcgaggcgatcatcgtgatctacgtgtcatacgatgtggtggtgctagctgcttgtcatgcatgccacgcgagaattggcggtcggatccgctggtccttgcgtacgtgcgtgtacgcgtgtgcagtcagggaggccatctgcaacgtacgttggcacgcatcggtgcatgcatctgagcatatatatacgtgtacggagagccagaggctgcaagcgtatctacggttatcaacaggcgtcaccagtcagcgcctagcggcaagcatgcatctcatgtttagtggtggcatgagacagctaagctagtgtggcatgcatgcttgtgggctaggccgagctcgacgctgcccgcaaacaccagtgattctgttgggctttcacttggcagtcagcatacttgtttgggggaataagttcactttgagtccctcaaatataggttcaatttgatacgcatccctcaacagtagtaccagatatattgatccttcaactattaaaatcggtgtaatttaacttcctcctcgatttcgagagtggttttcatgaacgaggcatgttgacttgtctaccggtgttggtgtggtagccccatcacaaaatatcagtgggttccacatataagtgactagtgaaaaatttaaaaactggcggggcccacttgttaggtcccttctcccctcctaatcttttcttggagaagtgggacgggcggcagctagcagcggtagggcgacggtggcaaacattgtcatatgcctcctccgcatgcaccgtggctatcgtgacacatctgatacgtgcttgattcgacacagtgtggtgggcccatcgtcgcacatggggacgctgcagaggtggcggaacagcgatgacgtgtcgtgatgtctcctggttggtgtatctatcagccacgacgaggacagcctgttcggcaactatggcataacgacaggaaaatataagtggaaggaggaggagatgatgaagatgttgcggccaatcgcccaccttgttggatttgctcccttgcccacgacaaaatctacgacggcctcaagccagttgacgacctaagtcggcaagagcatgatttgtcctacctcctcgccgtcaccactggcctactgaagggacccccacaacgccacggtgaaatacgagcttgaggaagttgggcggctttagggttttcttctcgacagtatgattatggctgttagggtctgctcaccagggtgttgccaagtggtggtcaccatggaacctgcccccttcttccttatcctactccacgccttgcgcgctcgcgcccgctctccttctacgtgtcatcaccatcgtcgttcgtttgtgtccaccgaccacgtcatctgccatcatgacgaaccgctccctctcccacagctgcagcgatgctaggacgaggccaccggtgctagacatgagctgcactgagtgtggaggatttgggaaaaatatagaggggaggatttgggaaaaaagatattaagtggagaaagagcctgacaagtaggccctataatttttattttattttgtccccagtcacttacacatgggcctcacttctattttgtgattgggatgccatgtcaacacaagcggaccaagtctagtttgcatccctcaaccagagacggaggctccttgacttatgtcgtgatgctcctttctcctctcctcccccaaactgttatgttgtaggagtttgtcggcgcctcagcttctatttccagctttactctatttgggcaacacctacatggctcgagcataacctattatcggctccgcgtcatcacattgaagctcttacaccattgagcctcgccccgaatcttgctatagacgctgaccaaacgcacaccactccctgctcctctctactcaccgttgtaagtctcggtgccacagcattggcttcgaggagccacacaccaacaggtcctcctcacctccaagatagtggaacttgcattctctcgttcgatccacggtctcctcctaatactgtgctgaaagaagttaagaaaaaaaaatttatatatggctagaaatgaaaacaataaaaaacgatattattttcttacgaaaactatattggtacgggaggaatttccctacagttctcatcacgaatctaaacaccgttttagataaggatgaaaacggctcgaaaacaaatagaaatcacatctaccacagtatggattgtctctcgcaggaagttaaaaacagtcccaccaccaactctatgttggcaaaagaatgcgaccagcacaggatgagttaacgagcttaggtggtgtactactactaactcttctctaatcttatccgtatctgtatatttgcaagtggtggagagacaaaattaaacggtacaggtccctgtataaccccctccgatgctaacaataaattaggtaggtgtcgaactgtcgaccgatatatggatccgatcacgtgtcacgcgatgcacgattgtaccaacacacagacacagttacgggtagtacacaagttagttagctagatgtgagagctgagatctgcatattgccttggtgagccagcgaccgtaccctggaaagctgaggccaacacatgcatctgcaaaagctttgtgcagcatatgcagctgtgtgtgggcgcgtcgcgtatatgcgatgcgaggcgtgcaagacgcttcgggccaatcaagggcaaatctttagttatgctctgagctggggttcgtttctaccgttgatgaaatagtatgaggttaggtggtagaaaacaaaataaaaatcattaagatatgattaattaagttttaattgttataaatttaaaagtggtttatcagatattttaaagcaacttgtatattagaaagttttcgcacgaaatatactgtttagcagtttaaaaagcgtgctaacggaaactaagataaaatccatatcttaatgaaaaagagacaaccttatcaaatttagacaataccaaatttttttataagttttgacgttacctaaattttgatagtgttgtatgtgtttagtctgtgccttttcaaaatctacctccgttttaggttataaaatgttttaaccaaactgcttcaagtttgactaagtttataaacaaatatagtaatatttacattaacaaattagttttattaaattaataattaaatatatttttagtaaatttatcttggataaaaatattactatttttttctataaactttatcatacttaaaacaatttgattttgaccaaacttaaaacatcttataacctgaaacggagggagtagtggctttgtgagagaaaagtttgggaactactatcaattttttgatatggacatctgtttaatttattagcttattaaaacttagtaacataaaattttcgtttggttgaatgaaacaataataaagtgaacaagtcctgcgtatctgaatgccggtgacccctcttcgtggtagcagtcatgattacgcccctggctggccaccatatgggccatggccggtgcaagcagggtggacagcacagcagcaacaagcttgagagaaaaagcttcaggatgcacgttgcaatgtatggtagatggtgactgcttggtgattggcaatttccttggtatttttagatcctaaccaaccaataatatttataaaagtaagatattttaaataaaaataattatatattatgatattttgtttaatgataaatctagtaacatcaattttacatgattgatcttttttatttctttgcaattaatagttaaagttaaaaatatttgacttgtcactatgctacaaatgtttatattttaggacggagttagctccgtggggaattccgattagttattttgagaaataatctctctgtcccaaaataagcgcgaccataagtttccgtatccattttttataattagtttttttattgttattatattataaaacatgaatagtattttatgcgtgacttatatttttttagttttttaaaaaatgaatttaaataagacggatgattacagttggatacagaaacttatggctgcgcttattttgggattgagggagtaatactactaccgtacagctgtattttccaattacatgggaaaacataaatgcatgtacgctttcattcgaccaggggatgtcctggccgcttcgtttgttagaaaccatcctaatatttatgaaaattagcaaaaatatatatgtactctcctcggcccataatacactaatctatgattaaatgtgttattatttaggacaacggatctagacatgagagcatgtccaccaccactactagagacttttaaagaagtataaaacatctttcttttaaattttttttgatgacatatactacatataccacttcacaaaatcctaaatcgacaattaactcacacatatggagtgaaaaaaataaattcatcatatccaaatttatcttttcttttctcaaacttgttttttttaaaaaataatagatgccacttatattctatattgtcaattgttttaaattttttgtaaatatttatattgagtttggagaaaaaaatacccatggaatatctgctcgaggattagtagaatccattccccatcattcacactatgtcagtttagtttgcaagtttaagttgtgtgtataagtttagatgacaagaagtgaattaaattggcataagcgcaatgtgcacatatgctgtacagctgccttaattcgttggctagcttaattagcttgctcctcagtaatataattaaagtgagtaacatctagctgcacatttttggtttctgccggttgttcgattcttcctcgtccataatgataacgacaatcctagtgcttaattaaacgatccccaaactttgtcaattaattaatgatgaaaccaaacaaattttaagaaatctagtactccgtacttactaaaactactagtaaagcaacatttcacagtaattacctgctgacgcgtgagggaagaagtgtcatagtcgtttggcaccctacatggatgattaattcctcccatggctgacggctgtatcacacttacacacaactggaatataactatatttacttttttggcagtatcacacttacacacaattggaatataactatatttatatttttggcattttctagctgtcctgacatcccttaatctaacataatgcttttctggtcacagtgtattgcatgggtttcttgcatgagtagccgatttgtgatggcagcatgtggtggaatttttcgtgttaacagttgtggacctactgtggactttgagtgcatactcactacctttttttccttgttatgatatagtggccaaatccgagtagaaaagaatctgggtactactccatagcatggttgttcaaaccttccaaggaaatagtttacactaggaataactttgttagtcatgatgaaccaggattttcttcgctatatgtgtcttggtacccatcatatacatgtgactcaaatagttataaaaatataaaaaaaagtaatactaattgtgatgatataagtttatatacaaacatgcaagactatatttgatctataactagagaaacaaaataataaaattagatagtgaatagtgcccgtacaacgcagataaaaattgttatttttttcttcatgtgtagatcgcatttagaattgcatgttttgtaaagtgttttatattatcatcgtctatattattaaattttacgaaatttttatataactggttaaactatatgcatttacctagttgccaatacttctgtagtcatgatgccgagtttgaaacttgtcttaacgactcaggtttagtctgaaataaattattaattaagtgaattgttacgttgaattatctactttattatggggaataatttaatatttaataaataaaattaagaaataatataaaacaactggtcctatattggaagaatttttttttttcgagaaaatgtatttttcaaagcgtagagtagtagataattaatttaaataatttaagtaagtaatccaacaagaanncntaagccccttaannaccttttctaannatttcnnaaagtgttnnattgcccacccgagtnnntgttctaattgcccaagtcatcaaaatctaaactcctgtacttatgatggacgcaaacatgcagtcatgtattcacgacttcttccatgtggaggcttccttccccttttattgaacaagcttattgtttttagcagtagaatcagacgtagacgtatagtgtggttgccttgttcttttttctgactatagtcttcaaagattgtagaattgtattttttttcctgtatcaatggaaacgtatattgtttacacttaactgctacacgcagacaatgtcaatgggacagtgagatcacaaccagcattaccacctaataccacagcaaaattccaaaggtaaaacccacaagcaattaacccagcaataatcaccaaccatcagcagcagcagcagcagtgccaaagccagtgagagtcagtgaccatgtggccacacacaccatcatcatgagcaattgagcttcaacaacaattcactccacttttccttgcattctctctctctctctctttccctctccacctttccccttgcttttctctctcaccttccttgagccgctgagccccactcctcctccattgatccatccactgctgttgagctattttatcactcatagagaaggcacaagaagcttgaggaggagacagatggggagggtgggggaaggtgcattgcattgccaatttgcacaccaagattgatcgattgattggcattagggagatgagatgagattagattagagagaagagggagaagaaagggtgggagacaggtggacaaaaagggtaaagcgagaggaggagtaaaggtggtggaggagagtgaaggaatccaatccaatccagtcttgatcgatccgtcgcgcgtgcgtgcgtgtgcgtgcgtcgtctcgtcctcctccccagattgggagcagagcagagtagagcaggagtgcgcgcgaagcaaagcgggaggaggcgccaccgacaccgatcggatcccgcattccgccgccgccgcgcacgcccggagtgggtggttcgaagcttcttcaagctcgcttgctaagcggtaagcatcgctctccgtgttcttcgctgatggtttgatggtttcttggggggttttctttgctcttcttgctgcgcggtttcttggggaggtttagctgcggcctgcgggttgcagcaatcttgattcttgaagttgaattcgaggttcttttcttgattcacctatgcgatttcttgtgtcagtttcttggccgattcttttttttctctcctgcgaaattgattcagtctcatcagaatttcgtgctgttggctccgcaaaaaccttgatgaaatccctccattttactgaaaatcttccgattgttagatacaagtgcaacgccaaatcccgttaatctccccaaatcgacaaatgaattaaccagaaatggccattaatccctgccattgacggccgtacatgcgggttttactccaatcctacgctttcctgctgctgctgctgccggtggcaattgatgcattgcctccccagcagagcaatcaccagtaatggagggtgcaagtacaggagaaagtggccggagcaaggaggaacacatgggggcatgttctacatttactcatccatgccatggcccccggcaactgtggctgtggtctcttccattggctgcgtctgcacccatggtgtccttccctgtgggatgcagcctgttcttgccatgatctgatgaaagtgtgtgtgtggttgtacaattgatactttgatgcggttgcggctaattgacgcgacaatgcccgcacgctcgtgtcgttgtcaatcttgtggcgatgatcggatcaatgtggctgctaatcgattgagaaattgatttaaggtaggctggatgatggtgacatgcctgtcttgttttgttgttaaaggccacattctctgtgtgcctttcagggtttaggaggaacagtgtggtgttggtgtactagtgacaaatgaatgatccgtgccgcgtgaccaaaccgcggatcagtacacattgacagacagatgcattgccagtttgattgctcatggtgtttgctttaaggatcagtttttagggggggggggggggggttactttgctttaagaaggtggctaattgttgtcatgtataggcgtactatatgattgtgggtgcaatttgactaaagtattaaccacttgtttaattacatctgctttggatgcgtgtgcttcctcctgcaaggtcatctgtcctatgtctgaaggtgtatgcttgtggacgaggcagaagttgttgagtcgattatctgcatgtccttgtcttgatggtagtgaattggatgccatgcgtgcccagcaataaaccaggtcttgactgaaggacttgtatatgcaaattgatttcctgctgcggtgttttccgtagaatccgagtcgcctaaaattatagtagcttgtttggtgcttgccaacttgtttggacttatatgtcagttgcattggttgtttattccttcgtttctgttttctgtacagttggttgctggttactggataggttagttttacttacttttgtagccttctgaatcctgcatcgttatcttgccgccatcatgtgatagatcttcattctctttagtttggctagctgaaggtattgaacatacttgatcagagagatagcgggggatggatcgaagaagctggccttgganaaagaagtcttctgataaatcatcagctggagatgtgttgaagagttccggtcaagcagagcaggtttgtgtccattctttggctttccttccttgcaatcttgatcagttgatatgctgattcattcagtctatgcatcactcatgagaaaaaaatagcttctttcttgtcttccttttttttaagtcaatgatcttcgtaaatctaaacaacatattttgtttttattcttttatttaatctggtcatcagtggctactatgaaagggttcatttattcgccaactgtactcactttttttaacaagaatccttttgtaaacacatatatacaactgatggctcttctttaatctgccctttttcttccaaagaattatactgtgctcccttatactctgtactttgtgaaattgataagcatcctactacacatggtgtgtgtggctttgttgggaaaattgtgcttctttgttatatatctacttgatacttttcatgcttttatttttccgaaatgaatatattgcgcatcaacccaaataattatgcttgtttttatttgctatccagtatattgacttgttttctatttcagtatctctgcatattaatatgctatggttacacagctttgtcctgcattagtaccaaatcatcacctgcctgtccataggaaaatagagggaactagtcacaaactttactaagagatgctctttttcaatttgatttttaactttatgtgatactgatacccaactgatgtactcaaatttaagtctgtgtcatgtaccacttttgttatggtaatgtgtcatgtaccttagattgtgaactaacataaaattgctttttggtcaagcctgctgttaccctttaagtagcaggcagtgcatttactcgttagacttaaggtacactgattttatcgttagtgctaaatgccatcaattacatccattcatttaatatgtcaaaaactaatgctgtttgtttgatcaacatggtggttaaatactcatcttgattgattatccttttcttaaactattttcctgtttttcaggatgaacaagtaccaaaatttgtgcagatttcaccagaaagatacacaaatcttactgaatcagaagagcaagtgaagattctatgtgataaggtgaatgtgttgaatgaaaaactatctgcagcacaatcagatattactaccaaagatagcctagtaaagcagcatgtcaaagtggcagaagaggctgtatcaggtttgaagctgattgctgctattctttacttttttttttgttggatagactattgagtaaattgtactgtatcatgatttctccccaggatcttgaacttggtcatttctattatataccttagtaactactggaggtgtgcaacataacattttatttgatgcaataaaatctgtagtaaccataactagtaatctagtagtaagactcccataataaaagtagtaagactgaattttctccaggagcattttgtaaattaatgcgtgtaccatcattgtaggttgggagaaagctgaagcagaggccttggcgttgaaacatcaactagaaactgttacattatctaagctagccgctgaggaaagagctgcccatctggatggtgctctcaaggaatgtatgaagcaaggaggacagtgaaggaggaaagcgagcaaaagtgcaagatgttgtctttgcaaaaaccaagcagtgggagatgatgaaggccgaactaaaagcaaaattagcttcttttgaacatgagcttattagagcaggtgctgagaatgacgcactctcaagatctcttgaagagcgggaacacttaatgatgaaggttggtggggaaaaagagcaagcagaatctcagatcgaagtgttgaaaggcactattcaatctggtgaaaaagagataagttcattgaagtatgaactacatgttctttccaaagaatttgaaattcgcaatgaagaaaagaacatgagtgtgcgttcagctgatgtagcaaccaagcaacatgtagaggatgtcaagaaaatatcaaaactggaagcggagtgccaaaggttacgtggtcttgttcggaaaaagttacccgggccagctgcattagctcaaatgaagctggaagtggatagctggggcagagaccatgctgataacagattgcgacgctccccttcaaggagttctaatttccatcatcctttgtcaccatcccctgataattctcttgaaaacttgcagcacatgcagaaagagaatgaatttctgactgcacgcttgttatcgatggaggatgaaacaaagatgttaaaagaggcgctgtcaaagcgtaataatgagttgcaggtgtcaagaaacacatgtgctaagacagcaggcaagctccgcagcatggatgttcatatggtgagtgctaggcagtataagaatccaacaaattcaaaccttgatgttcaccatgatggtgcactgagcctgaatggaagtaacccaccaagtctgacttccatgtccgaagacggagttgatgatgcaacaagttgtgccgaatcttgggccaatgctttgatatctgagctctcacacatcaagaaagataatggaggtaagggcagtttgacagaaaattccaatcagatggtactcatggatgactttctagagatggagaggttggcgtgtttatctcctgaaggaaaagaatgtggaagctttattgacaagaagaaggccactaaagttcacacaactctcactaccatcactaaacgggaaagtgatagagattcatggccatcctcgcagttcccagatacaccatccagcagtgagcatctgcctgagaactccccactttcaaaattgcactcaagaatttcttctctcttaggttctcattcaccacagaacaatgttggcaaggtcctagagggtatcagaaatatcctaagagatatcaaggaagaagcagaatcagtgagtgcaaaaaagaatcagcctgataacatgaatggacttgctgataatggatctttgacaaagcaatccaagaacctgagggatgtggatcatggtctaagacatgctattttggaaattcttgattttttccagccatttaaaagacaactatatgaggtccaaggtaaaagttcccaccaaaacacaatccttgagaaaatagaaaagttctccactatagctgacaaagttgtgttaaacgaaaatgctcttgctgaaatggtgattgcattaccggaaattttggcaggaaattctgctattaaactcacattgccgagagacagcatcactgaaaccgagagcaataatctggactatgttgataaagtgaccttattggaaaacaaagtgcatcatgagccaattaaagatagccttgctgatatttgttcacttgcgcctcattcgtcttctgatcctgactttgagggttctagggatgcatttgttgtcaaaaccacagtgcagatgtgctcaatggaggaatatgaacaactgaaatcggagaagaggaaattggagatggaattagcaaagtgcaatgaaactatcgaatgtagaaagcttgagtttagtctgatggagaaaaacatggaagagcttacgtcaaagttatctgcatgcgagaaatcgaatagcttgactgagacacagctgaagtgtatggctgaatcatacaaatcacttgagttacacaagttgaaattagaaagtgaaatagaagttatgcatagacaaataaatactttgagaactgaacttgctgatgaaagacaaaaccatcaggacgatttggcgaagtacagagatcttaaggagaagattgaaaggtgaaatacctgtctttccattttggtatttccttagtttttctttgttgaaaggacttagatagactattttatcatcttgtttcctttagtttgttgcatgtttaacagattcttcgttgactttgtttatgtcatgaaggtatgagaatgagaagaatacttcatctgtagatgaggatgcaggtgttaaaataaagcaggtaaaaattactaagcctaaacttcatgttcgtaactgattataaacctatgtagtttgtttactccagcttctttcattaaatatagaataagctggtcgagcattgataccacgagaaattcacctatgtagcgagctggctgcttgcagttagggggaccttgtactgctgaaacttccttctcaatacaaagatacgcgagtcttttgcgtattccccaaaaattaaatatggaataaatttcataaatgtacaggcataactattaacgctcatttctctgaactttaatattccttgttaaagttgcaattggttctaatagacctggccactgacagcctcaaatcatgcgtcccagtgcatccaacagcctatagaaaagtgtccatgtgtgtctatggtgttgagtgatgagaggcaacattagaccctttttagctgatctatgtgcccaatacttatgacatgcgtgtgtctgtgtcagcagcctgctatgcacaagccaacatttcaacaaattggtgaaaacttagaaggtgccaaatagtgccaagaccaattgcttgttgcatgggctctaaatctatagttatgcacaaaacattgcacccaaatctatagtttcgtagaattggttcttagaaatctgtgataatctcttatactatatcagctcatatagtgccaaacacatgaattacacatttattcccttgtgctctccgaataaatacttcctggacaataaacgcttcagtgtccttcaaattctttcttttaaacattattttttttctggtcatgttgtgtattccataatatattcttggttaaaataatggcaggacaaagagatcgcagcagcagcagagaagcttgcagaatgccaggagacaatattgcttcttggccgtcagctgcagactcttcgcccccctccagcagaaccactgggttctgtgttaaaccaacaacctgtgggggtgttttctgaagatcaagctagaacaacccaaggcttgcattttaagaagctgtcaggtcaatttgatacagatcacacattctcaagtgcaccgggaacaggaaacgtatctccgctaaatggatatagaacacacaaaagcccctccaatcttgatggaaacacttacttcgcttctccaaacaactccaagcgtccaaagcacagatcaaggtcttcttcctcttcctcatttactaaccagttcacagagaaacagagccgaggtttcagtcggttattttcgaagagcaagagcgaatactaaccgacttttgagcttgttttgcttgtcgtggcaagcactgcaggtgtatatttttgccaacaaaacctaccacctatttgtgtattatgtagatgatgcctgcacttaccagattctagtagtttttgcttgagattttagctgtatccatattcagtgtggttgtcagccgtcagtactaagaaccatcctttgccctggatttttttgggttgctgttactgcttatacctcatggaacctcactgtaaatttgcctagctacctcgatgaagattgagaaggtaatgttgttagcgtgaagagatttctcttgccaaggttcagttaaccgctagcttgtgttgtggttggttagttctctgtacagataacctgaaaaaagtttggagtttgctgtcaagtttttgattgtaaagtatttggatactctgtgtgctaacagtttggaatgtaatgtgttgccccagttcaaacaatatcagttttatgctgcaaccgagttcagttttgtatattttccccctttttttcgagaacacaagttacttatatatacaacagacaatcaagatttttttttctcatttcagtgcaatatttatatttaaatacgtaagtttattgctcgtgtttcccaatgtagacttagagaataaaaaattcaacaactttatcgtaagttattatagtgatgaatttcttttgacccaaatacagtgatgaaatttgagatactaattattcagatgcactttattgcttactgctgtactatcaacaaaattctcttttttttaatcaagagacaaacgtttctttttttaactttgatgtattataaatttagttaataaggaaaatgattcgaaatttcagtagaaaaaaaaagagaaaagaattcgagatggcccagaaacaaagtgagctaggtggcactgttgatttgggccaacttatccaggccatcccatgcatgcggaaaagcagagggctaagcggaaataagtccaattttactctctcaatatagctccaatctaactttataaccctaaactgtaatatcagatatcttgatccctaactattagtaaaactttataatttaactctctcaacagttttactaatgtggcgcttgatccggcctatcttgctaagtcatcctgtgtggcccacatgtcattctctctctctccctcgtttctttcttcctcttcctgtcttcttcttgatggtggtggtgtctgcctcgaaccccgccgcgcgtctccggctctgccacgccttggtgtcttggtgatcaacacctcaaacgccgagcacctggcgacggccgccatgtgtgtactggctcttgaagtggttgatgtagtcggcggagatgtcgatggcatcggtgggtcggggaggctgctgacgacagcggtggcaagggttcgcgatcgcgtcgcggccccacacgagctcagcggcgaatccatccgcgctgtgggcgaggttgccgatgacagccatggattgcgccacttcgggtcatccgccaccgcgcggctgaaccggaacccgatgacgaagctgcagcacgcgaatgtggtgacctggacgagcaacatgagctcgcactcctccatcgtcggcgtcggcggtagtagctcattacaggggcggatccaggagggattaataggaggatcagaataaactatataaaattatagtccctcttctaatgaatacttcctccttctctaaatgtttaacaccgttgacttttttaaacatgtttgaccgttcgttttattcagaaacttttgtgatatgtgtaaaactatatgtatacataaaagtatatttaataataaatcaaatgatagaaaaagaattaacaattacttaaatttttttgaataagatgaacggtcaaacatttttaaaaaagtcaatggcatcaaatatttcaagatgaaggtagtatatgacagaaaattttagtggggccttcatgagggatcttaggccattcccaacccaatgactaagatgttgtccatagtattaaatacgctgctacataggatgaaaaataacgtggcaagtgaataaatgaggaaagagaaggaaatcatgtcttgcatgagacatggtttctacacaacatccaagacatcatgtgagataagtaccattaaattttagtatagaatagtggtgtttgcattggaagagtggtgtctactactagtttcttgatgatgtggagtttatggaaactatgtctaatgttttgggttggaaatggcctcatcgttacaacaggggtagtaggggctcgaaaccccacagaccccatggtggatccaccactggtaccaggtaccagaagggagcacacgttcactacgtgaaatctcacctatacagaagaaaggaaagggataagtcacttaaagtatgccgtagcaacgggatcccgttgtgtagctgccctcattattaaagctagtgaaatttgactccctcagcggttttgatagtagtttttgttgacgtgacacattgacttggtccactacattgatggcaaaaatacaggtgaggtccacatataagcccccttcttccttctctatcttttccccaacaagcagtaagtgaaggcggcggcgatgctgatggaggtgccgcggggagcggtggatgcagcgggcaaggcgaggcagctcagggacttctccactaggattggctcctccagggtggccagatcttctccccaggctcgtacgttaccctcaagttcaggaccttgtcagctgcgtcgccgcaaggactccacagcctatgaggagagggggcccgaggagaggctagtggtgggggccgcctcatctccttcacgagaccagcactacgttctctccccaccccaccattgcgtcggcgccacgaaggagctttgtgcggagttggccacgtcgacaacaccatcaaggatcagcagtggtggatccaccatggggtctgtggggtctctagcccatggtggggtctgtggggtctctagcccccactacccgtgttgtaaccatgagatccctcatgaagacctcactaaatttttctgtcatatattcattagaagagggcctataattttgtatagtttgttcagaccctcctattaatccctcttagatccgcccctgcctgataccacgtaccataggcgtgcgtgatacctcgtcaccggcgtcactcctctgcaaccggagtagcacatcacaggctggtacctggtaccagtatggtaccagctgcatggtgtgtagtacctggtacatgtggaatcggagagattcaagaggataggacaggggaatcgatactatccatataagccggagaaaaaaatcagcaaaggaaatcatctaccaaaaaaagagaaaaggaattcaaccggcggtgaagcattgccgaccggggagagaggggggggggaggaatcaggcagagtggaaggtagtgcgaggggtacctacaggtatcgaaggaatggatgcgagcagtggcgcaacaccgccgccatggggaggcggcacgccgttgcaccgccgcaccgcgtgttcttgagtcggcaggagtagctctgcgcggcgccgccttccccgacgccggcgaaggagagcgggccgagcgtcctccacgcccaacgtgcaatcccgtgcagctagccgccatcgttgtggtagtcagagagagagagagaggggggggacaggaatgggaagagataaagaagaggataagatgctagatatttagtggtagtagttatcccgtgtgtacaggatactgttgagtagtttttctgttttatacttgggggttgaggtatccggtattgcggctgaatggtactatgtatcagattagatctatatttgagggagtcaagtagacttttttcgggctaagtgtgactgtgtgaaccaagttgagccaagtgcggatcgaaagaaaatttatttttcagattcattatttttatctcagccgagttaaataaatgctgaaacaaaattattctttaagaaaagttgaataagaagggatggaatataaaaattcattgaaaaaaaaacatcagaggtgcatccaattgtatttttttcactaaatagcaaggaggcacaattaattcacgctaatctcttatgttacaaccgttataatgatatactaacacgttgttgacttttgaatataggtttgaccatttatcttattaaaacttttttacataatttctatttattttgttgtaagttgtttaatcacgaaaaatactttaagcatgatgtactccctccgtttctaaatatttttgacaccgttgagtttttaaccacatgtttgaccgttcatcttattaaactttttttgaaatacgtaaaactatatgtatacatatacgtatatttaacaataaatcaaataataggaaaagaattaataattacttaaactttttgaataagactaatggtcaaacatatttaaaaaagtcaacggcgtcgaatatttagaaacggagggagtatatgttatgcatttgcacaaatttttaaataagataaatggtcaaacgtgcatccaaaagtcaacggcgccatctataaaaaaatagagggagtattgtttaagataataaaataataggtttaagattacaacaattattatttttatgtttcaaaactaagcattgtacaaggccccgtgtttagtttctccctattcccaactttctatcacatcatatcacatcaaaaacttttctacatacataaactttcaactttttttttcgaactgccaactttatttaagcttccaacttttttcaggaactaaacacaccctaagttatatttattgtttaaattccaaaattttgtttggagtttgtcaataaatagttatgatggaaggagaatacacccttgatatattagatatttccgaaaatttggaaaatactccatattcggcaacctaaataaatcaggtttcggaaaagtatggttgcatctaaaagctttctgaaacctcaatctatctacaaggaagatctttaatagtatatatattttagaactcttaccggcatcgtgggaggtgctttgggtatcctgaaaatttttgttttggtcatagcgggtaaagttggagaataggtcttatagagcagttattttatagtatacttttcttctctcaattattattacagtccttctacaaaaaaattattacagtctaatttttattctcaacttatattaagtatacatttctcatcagtccaaacaagacaattttagtacacacgtacacataccacaatacacacacataatatcacactcacacaggtgtgaatgcatccttgatctcactaatttgagtgtagtttgaccatcatgcatcatggatggatatattgtctaacactttgagatgccacgttatcccttgagcagtgtctctctggcaccctctcaccagggtttacactttcgattttggtaggaccaaaatttatgaaatttcatgattttcggtacttttttggacccctttttttttggaaattgtgatagattttgaccgaatttgaataaacttgtaccaactgcaacaaaaatttgagaaatcccgaaaattttggttgatatattgatttgccggtgggatccgaaatttcaaaccgaaattgcaatagccgcctccaaaagcccttggcccccacacggctagctgctacaccatctctgtttgatccattatattgcctccaacgttatttgctctagggccgatttcgccattgggctaacatgtcagtctactggatacactacgaaaaaaaaacttttttcacgtggttggctcacccgcctgtcaaaaaggtatgaaaaacaacaatttttttccatgcgggatgtagcctgtccaaactcgcaatacttagatatgcccccattcaaccgaaactctttatattttgggacagaagaagtactatgtatggatgcttctgacctacttaatataatttcacaccaaatagtagtttaattccgctaccccaatgtttaaactccatatcacaaaattatttctctgatctccactgaccactgtactattgcttattggggcagattactttcgtaagacatctatattcttccatgatttaccttaattgatttagaaccgactttttaatttcttcatagcattgagaactgtgaggtggttactagcaggttttaaggaaaccgcttcattaggaccaggaccaaggtcacttttttgtgcagtgttaaccctgactaccattattcttttatatttaaattaaagattacttaaactcaacatcgaaaggcttcattttgaattgtgttaaacttgcgtctttaaaaaatattcctttttttttcatccacaaattgaacgtctctttttctgtttggtaaattgacatgccagcaactaaaagctacttttgtgcagctacaagcatatataacactatagtgtgtaaatcaagtcaatgccaacactacatatagaatttctaaaacaacataagatggctcttcattaataagacatttacttcagttcagggtagcactgaacagttggtaccatatatttgcagcatgcagaaatatattcttttccagctagctactcacattattctactaaaatactgtcaaatatatatagatatgcatttttttcacaccaaacttgagaaaggtaactaatatctatgaagtgctggaaatcaagtatttaatttggcatctagctaatatcttgtgcttatatatattaagaaaagacgttctcatgtgtgatggtgtcgcttatgtatcaattctaatagtaggagaatccaatacatttgatatcacgcacgataaatttgcaaagaatagtaacagctatatggaacttttgcgatccttgcacgcaaaatgtacacattaatgacacgattcattgcatatatgacaactgttgattaatgctcttatttctaagaaagctaattaaatgcattactaatgatccaactaattattacattctttagtttgtacaaataatacttgtttcctattaatgtttatattcttacttgtgcaaaagttgcagaaataatattgttacaaggaatattattgatgctaggtaccagctagttataatagttactaacttaccatagttacatgtcaaatttaccctgctttgataatttacggtagtgacgatcttccttaagaaaaaaaagacctgtctaattaattaacgaatcaaagagtaatgtagagacacataattaacttacttaactagtagcagtatccctattattatgcatatatagtaccatgtatttgcacgcatggccggtcgccacagaaacatcatcttaaattagcttagagtacatgccaaaattaactcatatgcatatgcatgttcattacggtaataattagttacctacatggactagtagtaatcatgaaacttttcaatgcggtttggacacattaaagagctagctaaactgaaacatgtactttcctatggcatcatattattcatatcccaaccgcttgtcattttccaacaattgataacaaaggagtccctgaatacaagggcatatgatataacttcaagcaacataaggagagaaaacattgttgtgtgcatgctgcatggtcttagtcaaagatgtcccaccaaagctatgcttcctgtctgtctctcactcatctatatatcaaactctaaaatataatcccctgccaatcatttagcctcaatataccacgactcttcatagagaaataaactagtttaattaggcttgttttaaatgtactgtgtcccattagaaatagctagctagctagccagactgaatctaagactaaggttgcaccatatgaatacttgcattattgtagttgtagaagcacgaagcaagtaaaaagaaaccaacacctggctctagcctccaagtactcacatatgttcacactttattcagttgccaccatacatatatgttcagttaccattaaccccaaaaatgctcattttgctacttgctagctgttgtatatattatggcaaaaaaaaaaagctcatttgtcatagagagatcagaaagtcccaaattaagactgactacacttcacttcagatgttcagttagaaccttgaaacagaaatcaaacaaacttcaaacacaaccgtaattaatctgcgatgagacaaagattttttttttgtatattgaactaaattagaccaggttttgttttttgcaattagaactgttgcaatggaacagtgatcagggctacagctaagctaacaagaactcatccccaagcttcctcttttggagcaaactcccaagcattataaaatggtgcaagtgggcaccccttgcaccctagcccaagaacaaagatgatacgcgaaaaccgggcaatgcctgttacctaccatctccatccccaacatcaccatcatcgtcttcctcgccatcgtcgtcgtcgtcgttcgatttttcgcctcaacgacatggaggatttggtgaaaaaaatttcaccattgggattaaattctcttcttgcctcaaccaatgcattcatgaatgattaacacctgatcaattagtccatgagctagctagctaagctgaattgatgatcacacacagtgaggaggatcactgtgtgtgaggtggcggctccagcttggagctcgacgacgaccgtccatggcggtcaagaagctccctcgccagcgcttgcaagtcgccgccgtcgctgccatcgtcgtcgccgcctctgctgctcgacgagccgtcgcccatccggtcataggggtgatgatgcagctgctggtggtggtgttgctgctgctggtatagtccccactgcggctgcgccgccggcagtgggtcaaagagggtggacaggtcggcggtgaccggaatgttggccgccgacgacgatggcaggtcggagaagttgaagttggcggcggcggtcatcggcatcagtggctgtggctgtggcggcgccagggtcggcccggcgacgtagggcggcggcgacggcagctccatcgtcgagaggtgaccttgcaggtagttcagctcggactggagacctgccacctgagagtacatatacacatggggaattgaaccagatcatcatcagtaaaatggacagaaaattagtacttggcataatcagatcaagagaaaatgtaggtagctatactatatacaaaaaaatcttaatgaaatgctgatcatattagtaaagaaaaggaagaggagaaatggttgggagctatactagctgcagcttcaagaactactagagattgatgcatcctaattcctagctagggcttgctaaattaccatttttctttt

SEQ ID NO: 51531 - DNA, 7063 bp, Oryza sativa
agaagtccatttctccagattaactcccttgcttagcttgctagccttctctcctccccaaaaaaggactcctttgccttcttcaagaaaaagacatccatccttcctccaaaaaccaaccaaatcaaacccaagaaaccaaaaccaaaaccaaaaccaaaatagaagctcgatcgatcgcacaaccaccatgacgaacatctaaatgactcgccgccaccgacggcgacgatgaggaggaggagatcgagtgagtatgagtagtatatacctggtgttggaggtggaagatgtgggcgacgcagccgtagacggggtcgcggaggcgggcctgggcctcgtagcagatggtgacgacggcgtcgaggcggcggtgcgccgggatctgctgcagcagcttggacacgttgctggcgccgaacaccttgtgcaccgccgcgaagtgcgccgccccggcctccgagtcgaagtagggcgcgaagatgcacccctgcacgcacttccgccgcaagaacttgcacgccccgcacggcccacctcctcctccacctccggcgccgccacctcctcctcctcctccgccgccgctgccgctgccgctcgcgctcacaaccaccgacgagctcattcttggaatgagcccccaccacctagtctctagctctcttctcctacctgctagatgttgttaccttggcttgtgtagggttaaaactaactcaagatcgaccgactagtagcaagagagagatagacagcgaaaattgtttgtttctctctctagaactgaatcgattttctttctcacaaatggtagagagagagagagtgtgtgtgtggagtaagaatggaggaatgaggtgggggcggctgtacatataggagggaagaagggcaaaagcgtaaatacagcagcaaagtgataagtaggctgtttgcaatcccattggtggaggctggtgtatatatccatatatttctatactagtccctacttaattactgccaattttgggcctagctagctttatttactttatttttatttctttctatgttttcttaaatgcatttttatttctttatgttgttgctggaattatacatattaatggaatttttttatttaggtcatatataaatgtatatcagctactaggtggttttctatctctgtgttttctttttggtgccgttgtattgatgagactttaaagccaaggcaaatgcttgcaattggccttggcaacaagtacacttctctttctcaaagggttagaatattgcgtgaagcaaactggcctggctgggggagaacagcaaagaccgaaaattaatgccaattgcatccatccattcgctctcatctctctttttttgtttttttgggttagtttctctctctgtcaccaccatatatattgatcacatttcacaccacctgcacagaccaacaaggatgatctcgtcgcatgcactctctcccatgtgatcctaacatgacattcttccactcaatacgccacacacaaaattgttagtttttttaatcataccagaacttttatttagataaattatagtgtatgtatatattatagttaagcacaaaaataaattataatgcagacagggtaaccccaaatattgactaggatgatgtaaaaatcttattttagcacaaattgagggtggataatcgggataatataccaaatagaaccgctaatgctatcaatggtagcttatcttgtccattcagtataaaagtatacttcaccgatttattaccccatacaatttgagcgagtaaccgacaaaagtttctaaacatagattatcaattgtaatatatcattatttatattttttaattcattccccaaataatactaatgctacgattatcggaggcatcttctaagtttagcgtattggcacactgacatgatggtgattgtccagataaacttctaaacatagatagaactaatgttacgaatcgtaacgtaactatttaatctatttcaattcattcctcacagaaaaatatattcatcgtttaataatcccacataattagagcgattgtggatgtaaacttctaaatatagatagcactagtgttacgaatcgtaacgtaactaattatttaatctattccatacctcttaacaactatatatatcatcatttaatcgttccacataattagagccgtggatataaacttctaaacatagatggataatgacatatatgatacaccagatcataatgctagtgctatatgaattgtaagataacaatttaatcttttgcaaaacatgtagttaaaaagaataaaacggtaggtttatcggtcacatattctaaacttagagctctaacacaaatacattctattaatcatgccatatctagataaacttctaaacatagatatagttctagtgtcatgagtcgtaatgtaactgtgtacgtaatctatttcattcctgatgaaaaaaatattatatatcatcgatggtcctataaaattagagcgattgtgggtgtaaacttctaaattaacatagatagatcaagatataatgacatatcatgagagcgactgcatagatatagactctttaacatggatttcatctaatatggagtggtttaattagtagatttgatataagatggtaatgttgttttacttttatcttagcaaggactagtagtgtcaaggtagaaagccaacttctccaatttactgtttgaatgcagtggtgtaagtaaatggttttattgttcttttagtagacagcataaaataatatatgtaaaactatagcttgtaggtggcatcctctaatcgacaatatcagttttttgttctatattttcgcacattataaccaatatgtggtgatatgatttttcagacatagatataatctataatgccacatatatacattcaatcaaaatttccgcaatataaccgaagtggttgatatgaacatctaaagttagatggagagcaaaatgggctggattatgtatcagtaatatattaccatcataaatagcgtatataatttattattttttgctggctttggattgtatcactaaaaaagtgcagttatttttttcgacgtatctatctagctaacgcaaggatagaaattcaagagctccaaaaagttattctttgagtatgaaggcttaattaaatatatagctagctgccagctgcgtccgtacgttgtcaacgtatgcatgttatgaactgctgcctagctttggactctcttcattcagtgatcgatcgatcaggtgagaagtaaagtaaatgtgtggctctgatctgcattctgcaacgcgctagctaccttaagcttactgcattgctcatctcacatccgttacaaagtgtacgtaccacacatgttaagccaaacagagagaagaaaattaaagcaaatgaaagagaaaaataaaaaggacacgacaatgaccatctgtatccggaaaccgttgcagagcttgcgtgaatttcgaggcatcgatggatcgatccatgcatgcccagacatgcatgggaatcaccgccagccatcagctctagacacttcaccgcctgcagttacgacttacaaaactttatgtttccttgaggttacatttgaccaagatcatatacgcgtaacacgtatatataatcatgcagtagtttaatttttatatgaaagattttctcatatacatataatacatgtataatatgtatgagatatcaagataatgggttacaaaggatgtgattgtgaaataaaaatagatgcagggtcgggataatatggggtgcggtggaggttaaaacttatcctttaaagagtgagataatacttctcaaacccaattttcaaacatgtcatacataaatatatgtatggacaatgattttatcagtttttccataatcacatgtgttattacagcaaagagtacctcttccttgggtaagatatagtaacatgtaaatatgtgtgaatgatgtgtgcacagtttgaaccaaagcatatgctagcttctaggtagatgcagcactagagctggcatgcatggactgtgtgatcactgtacagtatggcctgattgatcaggagagtgtgtaccaagcaaacccttctttctctctctctctctctcccatacacacagagaatataatgtgcatctgagatctatagatggatgcgtggaagccaaaagacggcaccctggctaggtaagaaacttgcatgcttgaccacacctctcaaattcaccacttaaagttttttgtgactcaaacacacaatcttatcacaatttaattaattaattatgggccaggtgtccattgatccatcgttaatttctagttatactaatcatcaaattaattgtcacatcaaactggaattcatgatcaataattgacaacgtacaactgtatcactgataaaaaaaaacatggagtcctagctacaaaattcttcaatgtcagtactaaccatccatatggagaatgctgctaaatagtactgcactctttcatatggagaatatgcgtacatatttagcttataccctaaatatatacatatatcaaaaatacccctggagttgaagaaataccatgcatcaaatagatccaaaagtggttatttcctttttgtcctttcttaagttctccatttccacagaactactatagacaaattaaaccactttttttggttgaaagtatccattgctttattagttgtgcttatatatattacacattaattccttagcaagcatctgctgaattatttattcttttatgcaaggaattaagataattaaaatgaattggtcagcaacagaatttggtactactactttacaggtcaagtgaactccaggcatatatatggatgtacatacagttgagatcacatttttttgtcttgcattgctcctgaaccttttgtcctttgcaatatatcttggacggcagcaaagcagttacttcaactttattctgatatttaggagaaactgttggatggatccatgcaggatccagaaaacatggtagtgatttacaaaagctgtactaacgtagctttctccttggagcagctccaatgtgatccatcgatatgagaggctccagtttttgtcaaaagtattataaaaatatatatgtggctacgtaccagaagtattgtacttgccactgacgccaaattaaaccattcaaactaatataattaaattaattaactgtgtaacgtacgtttaattaatttattcatacatttttaattaactttagtcacgatagtagcaagcttgatgcgttgatcaggtgacctgtttcttgcagcgtttgttctatctggaagctagctggttaattttgactagtttcttgcagccgtacacagccaatgtttccattcatgtttgtatatgtagtctacgatcgacttgatgtatttattcgcatacaaggaatgtaggcagagcactagctacaggacaaaggcaccatatttttccatcgattttaacaatttagcaacttcttaacttaatatgatgcaagagaggaagagactgcatcgatttctgtgtattatatatgaaaaaaaatgttttagtaataacttcttaccgctgagttttctgaactttttcctcacggtcacaattaagcaattttaggggctcctttcaaacgtggaattgaaaaacggagaaatagaaaaagcagaggatttcgacatgtatactaaaggattgtaaaatacagaaaaaatataaaaatagtcgtttgattagacctgagaaaaaacatataaatcagatataagaaagatagtcttgaaggataattaatttttaagatgttggagctcttgctaacttattttgtttttaaaacctctacgggattgactattccatagaaattttaaaggacgattaaatccttcgttttaaaaccattcctaattatttctccaatagaattaaaatccattaaaatttctatgtgtttttccagtaaaaaaaatcaaatggaccctaataacatgaaggcccgtagaaacacagagttagatcatctaggtgcatgcatgcaagaattttatgatagtattgtcggaataaacagtttttgtgattttttttagcataccttggcctagtaacataaaagcccgtgtggcccattgtttagtgttggtgggattaatctccacaaagtgagtttaattaattaagcaggttgggccagtatacgatcgacatgttccaaacataacacatgttaagccttttacatgaagaaatgatctaagtataagtacgtcccaatagctaattagacctagttttatttcaaattttgagatataagacgaatttctttgatagatttgacttaggtacgtttagcgagttttgaggaatttgacttagatttgacatatttttatatcatttaagttggatttgatatacattttttaacagatttgacagacttagatttgtaaaaactactaaacatactcataatttgacagcatccatccttatctgtatatagtttctttctttttctttcttttagaggtattttggtctttttatcctgtatattccatacactcctaacacttggttagaaaagggtcggacagcgagttccactactacatgatagattttcctagacgtcgcccccttttgtttccatgcggtccgtaagtggaaccgcatagaaaaatagggggacaagcgctgggctgtcacccgcacgggaaaatgcattatcccatgcgggctactaagccaaccgcacacaaattgtcacccgtacgggcccacctcttttaaccacgcccgcgcgcaccatctcccactccacccgctcctccacctccctctctcccactccactcctctcctcctctcatcccactctcctctcctctcctctcatccactctgtctcggccgg

SEQ ID NO: 51532 - DNA, 3741 bp, Oryza sativa
gggggcagcggatccggcggcgcgcggcccctcccctccctccccttgcagatccagcggaggggaggcatgggggcccggtggagcggcggcatgcgtcagcggctggcgtggaggtggggcgacggcgtcggcgaccggcggatctatctcccccttccttccctctttgttatttgtgattctttgtaatttgtgagatacgttcttggagttcatttgttgctgcgagatgtgttcttgtgatgtgagagttcatttgttgatgtgagatgtgttcttgtaatgtgagatcattgtttgtcgatgtgcgactacggatccggcgccggcgacgggagcgagcaacggatccatagccagcgacgggagcaggcagcagatccgtagccagtgacggcggtgggcctaggttaggtggcggtggcggattagggttaggttttttttctttttttttgtttcgattttttgtttttccgtgcgggcggcgtaaactcccgcacgcgaaaatcacgattttcccagacgactgggtgcgtgcgggccgccctcccgcacgcaaaaatcgtttagcccgcacgggataattggtatttgtcggtaatacgggcccgggggtacgcacaataaagggaaagaatcttcctatctgaccacgtggcagcgcggcttacttttctcccccctcccccggggggtgggggggggggtcggcggttatgaagtggccggggggcctcggggtgccccggtgcacccctcgggcccttggagcacgatgccacgaggccctcacccggctaccacgtggcggctgagtgagcagagcaggaggcgctgcccagcgctttaaatgagcagcgccgcaaccgtccctcgccgcatttaatgcggcgtgggcaggcatgcggcgccgccctattgacgcacgtcaatcggccttgactggtctgcgaccggtcacaggcggatgggatgggtggcagtgcacccatgtcccgccctatgtcaggcggagtgggggcaggtatgccccgtcccatcggcacgcagccaagtgcgcccttgtacatgatgaatccaccaaagtctccatggaattaagagggaatgacagggatgtcccccgtgtcaggcggggaacagcactgggccccacctaggggcggtcgaccgccttgcttccggttgaaggtatggacggtagcttgccccaggctatgtgggtcccctccaatagggaaataggtaaagacggtgcatgtggtatccccttgaactataaaaggaagaccttacccaccgagaaaggggacgactcttgatagcttgggctctagggtttcccaggaactcaagatctcttgtaagaactcaaccataattccacacacaggagtagggtgttacgcttcccagcggcccgaacctgtataatccctcgcttctcgcacttgttggcaaacgagctagttagccagatcctaggtgaagatacgctcttgatcatcgcgccttatcccccggccgaactcacagaagggggtctaacgacctcccgctagagaggatcactcctcgacagtattgtaatagtgttcgatatgaaaaccggggtcaaatacacaaaatattaaaaaaataggacaaagttggtagttaactaccaccatccttgtccctatgcgtttatatatgcacaagaatgatatgcataccaccatccttgcacttatacatgtacttccttaattataaacattatcttgtgaaagtgctccgattggaaattagtcccaacctatttaatatgttccggcatagtacaccaagattatcaccaagtaactagatattcatgtatgtaatgcacaaacccactacgaggcttttaagttgagatgttttacaatagtctctacagtagtataattaatatagccgttcatcttttctaatctaatgaattatatatatttgcaccaccatatcaattagtatttatagaattgtttttttgccggtagtactcgtaactaaaaaataattagttgagagattgcccctactagtaataatacttggtggtaaaataataccaatagagatcaccgtaaaaacacccttttaattatttagtccttgcactcttaggagtttgcacctgatatggtttccatgtgtgaacgacatttgcatcaggcgtgcgtttgtactactgtgtgtgttgagagtgtacatctgtttttttttttccggggggagattgtaatcgatcggttaattgtatttactgtcaatagatgtatagatgcagtggcggacgcagctttaaaatataaaatatagatggagcggagaacggagatgttcactcgataagagcaatcgaacataacacatatcatattaataacatatcatattaatagttcattcgtataagtatctcaatctattgggtgtttataccttgttatacctaattttgatggtccatgactactataaagggataagggggtcttgagagtgtagggcgatacgagtcgtagctgagtcggtcgacccaacctgcctaatgggtagatccgcctctttaatagacgtacataggataggaggacaaggaagtgacaagtggtaaaatgttccaatataatacaggtacgcatttgggagtgcatggatgcagcaacagcggccagcggcgcggtcgactgacagtcaccggccgggggacaattccatgtatcatcttcctggacttgtctttgagttttgcatgctagatgattgttacaagctgcgagagagtaaaaaacacattacatatatatatcccctcttctctcccaatcctaccgttcatcttctacatggactactcaagagacaggatcatgtacttatcggtataggatattagtttttcactgctacagaatcggtcatcggtgaccaggcatcactaatgggtgaacgtgaccagtcctagatgatcttatctttgccaaggctaataaatacccgtttaaaatgaggcaatgagggataacccatcatagatgtggtgtcatttgtgatgtgtcgtagatagtagtgatccgtcatagaaaattcactacgataaaattcatttgtgatgtgtcaatgagggcactcatttttatcggatgataaatacaacatgtcaaagataaaaaaaatgagaaaccatatctagcgggtcctttttttacccgttactgtaacaaccgagaccaccgtacctcttcttttctgattcccaccgtgatcggtaccaattgaccaagacgatgagaccacaaaaatcttgtcctcttatatctctatctctccctcccccttcatcgattcagacttccactagtcggtaagccccgagtgctcatcgcccgcagcctccgcctccgtccccgagtaccctccctccattggtgcctctattcccgagtggcaactgccgttgccactgagccccaaagacacgagatccgggcttcctgaggtctggttacgctagatctagccaccccgcccccgacctcatgtagctcaatttggcacttgccattgtcccccctcccccaagaacaacgatgacaaattaacaaaaagtccatgctattatatttgcatttcaagctactttcttatattattttgaaacgacctacaccagaaagtgcaaagtttcatattgatatagaagaa

SEQ ID NO: 51533 - DNA, 1132 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggccc

SEQ ID NO: 51534 - DNA, 4408 bp, Oryza sativa
acaagatggtgtgtgaatttcggcagcttataattctcatttttgggttgataaaaatggggtctttctgcccctggggtagttaagttgtgctaatccgagtaaggaaatacactggattcggttggaaatcttgcatgtccattctttttctgctgtttctactaaccaaatttggcctatgctatgtacctagctatctcagttatggttgcacttttgcttgctgaatctcaattgaggaggaatttcgtgcaaaacattgtctggattgcgaggggcaatttttgagaacaaattttagtttagcagttccaagaagaaaatgcagtcgttttccttacacctacctctagatttgaccctccttttctcttcttttttgccttattgttcgttggagcatggcaagaattggtcaaaaattgctatgagcatttcagctttcttttttttttctttcttttcttttttgcgattttcctcttaagatgtcatgctatttactcttgtaaatctgaatccatgcattggtgtctatgggcacttcaaatttcaagtttgctaatgtgtttgtttggtgacatactgacatgcattatacagtgttgcaattaggcccggcgaaaaacgtgtagtaattatttgctctttttcatgcagttactgtcctcaatacgctcttcactagcctgaattctccggggcagctcaaaggttggcaggcaagtggtggagacccttgtggccaatcatggcagggtatcacgtgctcaggatcatcagttactgcaatgtgagcctcatcatgaagcaaagtagtttactacttactcgaccaccttctttcttacttcttacaatattttctttgtgtttgatgttgtagcaaattaccaagcttggggctctccggtaatttggcgtacaatatgaataccatgggttcattgattgagatgtgagtatctgagattattcatatctgatcctgtcaagtgacaattcagttgataacagtcttaattgattttttaatgcagcgatatgagccaaaacaaccttggtggtggccaacagatacagtacaatcttcccactaataagcttgagaggctgtaagttcctcaaatgaagttgtggtttagaaagtacatcagcttttctggtgtctgtgtgctaagtggttattgtttgcagcaatctcgcaggaaaccagttcactggaaatttaccctactcgattttctcgatgtctaatcttaagtatttgtgagtatctttgcaaacatcaagttgattttgcttttaaatttgtataatttggtagagctaaatgttttctctttgtatgtgcagaaatctaaatcataaccaattgcaaggaaatataactgatgtattttccagcctctatagcttgacaacactgtgagtacttttgtgtgcgtggattgtagacgggtcttaacttgtgtattgtaaaatccttctttgttgttcatattcctaatgtctatattcactttccatttccctatgtgatgtgatgcagggatctttcctttaattctcttgctggtgacctaccacaagggttcacatcattgtcaagcctgaagaaattgtaagaaaatgattgtttttctctcatagatatgtctttttggagtgacatgcctgtaatcccatactcgttcttctcagatatctgcagaacaatcaatttactggttatatcaatgtccttgctaatctcccccttgatgatctgtaagaaatcaacctataagtaattaatattttatttgcacgtgcagtaccacatctcatatctttgctttcctataggaatgttgcaaacaatcatttcactggctggattcctagtcaacttaagaagataaacaatctacagtgagttctctttgcttataaacatgtaaaaatgtatgagagatgtaccctgaactaataagatccctgtgtacagaactgacggaaattcttggagtaatggaccagcaccaccacctccaccgtattcagctccacctccaccaaaccgtccaaacagcccaggtcaaaacaatggtggttcaagttctggtggaagctctgggataggtggtggaggtgtagcaggcattatcatatcattgctggtagttggagcagtcgttgcattctttgtgataagaagaagaaaacgcagagcggcattggaagaacattttgaacagcaccagccattcacttcgttcccttcaaacgaagttaaaggtctgtttgcctgatgccttgctgatcatcatactttagttttgttatatattttgtacaattatctgaaaatttgcttctgaaaatgtgcagacatgaagcctattgaagagtctactacaatagatgtagagtctttgccatcccctgcttcatttagtctgaagccaccccccaagattgaacgccacaagtctttcgatgatgatgatttatcaaacaagcctgtcttgaagaaaaccaatgtggcacctataaaggcaactgtttattcagttgcagatctacagatggcaacagaaagctttagcatggacaaccttgttggggaaggtacttttggacgtgtatacagggcacagtttactggtggaaaggtatgctacaattttttctattgctattcctgtatatttctcaaagtaaatgaaaggtagcatgtgtattcattatcacattagtcaaaaggtggaaatgcaaagctaagaaaaaaaagccttaaaatctgtcatgacctcatgaacagaaacaattgagcatagaagtattcctcataaattggaggccgtatagttcttaatgttagtttcagtttttatgttaccgtatttcccctttttgcttttgaagttatttcgagggtgatacaggttggacatttagatataggcaaaattctgagagcttacttttcttgtttacactattcaggttctggccgtgaagaaacttgatagtaccgtgatgccattccattcatctgatgattttgctgaactggtctcagacatttcaaaactgcatcatccgaatctcaatgagcttgtgggctattgcatggaacatgggcaacacttgcttgtttacgatttccacaggaatgggtcactccatgatctactccatctttcagacgaatacagcaagccacttagctggaactctcgtgtcaagatcgcactaggctctgcccgtgcactggagtaagtgaaaaatctctccatattatgttgatctgctgttttggcattatactacatgttattaattttgtacgattttagccatcatgtgtgtccagattgaactaaacaagggccttgtttcttttcattcattatccataaaagttacaaaccaactgatttattactagtttcacaaatttaattagcaatccttttgttcatggcaattgaagtaagaatactgctgtcaaccatatcgtaccatcagaatctcgctaaacttggaaatatcctttgcatgttgtgtttatgtgtagaatgacagttgctagtttcatgctttgtttgaatgtggatgacagttatacattatggaataatagtccttttatatagaattctatgctcattttgaaatatgatatgtgacatcttatcatttcctctgaaaatataatctgtagatatcttcatgaaatttgttctccatccatcatccataagaatttcaagtcatccaaccttctactggattcagaattcaatccacacctttcagatgctggacttgcaagctttatttctgatgcagaattccaggtatggctcttgctgatatatccaagcacccattttaagaggacaattgtttggacagttgtgtgttaattaaaaaaaaatagcactgagatgaaccttcgcttgctaaactaccaagaaaactgactactggacttacagaaattgttggcgaattgatgtagtcatgtagaggctgtattaattttcttaattgaaaagagaagtttatggcaatgatgtcacaccttttatacatcttgattcactagtgattgtattaatgttcgtcacggaaaaaaaaaactatgcaggcagcgcaacagagtgctgggtgcactgccccagaggtggacatgactggtcagtacacactgaagagcgatgtctacagctttggagtagtcatgctagagcttttgacgggacgcagacctttcgataggtaacttgatcttctcatcagtcgtaaccagtttccagcttgcgcataactataaatttagtgctaactgatgaacctcggtataatcgtgtgactttgcattacagcactagaccgaggtcagagcagtcac

SEQ ID NO: 51535 - DNA, 27131 bp, Oryza sativa
  unsure (1)..(27131): unsure at all n locations
attacctaatacatggaacagaatgtctgaatcttatgaaacaaattcatgttacagcctgaaccagaattcaggccaccaatgtcagaggtggtgcaagcattggttcgtcttgtccagagggccaacatgacgaagagaatgctcgacggagatacttcgtcgcgccgaacagacgaccaagaacaagatttcatatgacaaaaactacacccctagcttttcctgttacatctcaaattgtatttattttgttcgcctatcgcctattggagagaagaatggaaggagaaatagaaaagaaagtcagtttcatcagtacataatcacaggtgttgcttgatatattgtaggaccaggtgtgccattgtatcctgtctacagaacagtattctgaattcctgattgttcattaatgccatcatggtagtagattatttggttatatcatctgaaagatccaaagaagcatagtgctgctaagtatagcatcaggttcactggttgttaacaagaccagtagtacaactacaaagcaaatgcttcaatggaggttacaagagactcaatcatcaggtacaagctcatatatcatcacttgtcatttaacaaaaattcgacctgttccgtacaagtttctgacattttgcatgcaaaaagctatggtaattttactctgaaatctgaagatacaacgtcatgatgctaaaacccaagcaaatcaaactgtctgagccgatcgaattacgtcagaatccacacgcttcagtctcatcacagattgcacatgcgctctcagcatatgtgcatctcccaatctgcaagccaaccaaaaaaaaaggaaagacgaaaaaaaacattagcacataattaattaagttttaatttttataaacttgacaaatggatatatttcatattttaaagtaacttctatatagaaagttttcgcacaaacacaccgtttagtagtttgaaaaatttactaccgaaaaccgaggtaaaatctgaatcttaataaggaaagaccggggaatcctccagtttttcaaacagttcttgtacctggcgatttctgcccgtcgcttggctcgctccgcgatccgcgtaggccgccatccgctgctgaggagatgatcggaaagcgccctccgttgttgatgatgatgatgatgggagcgcggccacctggtctccggccgccgctcgttgccgccgtagtctctcctactcgcaaatgcggcctgaagaacgaacagattcattattcatccatggccggcacagatctgaactgaagccatgggcgagctctgaatgaggaaggnaatcactacccaagaacagatcatgctgctactgtacccaccttcttgtcgaacagcaggttccaggcttcgccgctgagcgtgtagcggacggcgatcttgatcagatcgaggggggcgtagaacaccaggctgtcaagccatatcacgcccgcccatccccacccgatcgcgctgatcgacgcgaagctgatcgttgcgtacacgccgatcagtgtagccacctgcagatcaagaaactcatcatccgttactgagaaaaattcagaaaccttctactagcagcagaagtttttttttgattgtttcagagttcagaaaatcttctgcagatttaccaattgtgctaggatgaaagcacaaatcagcagggctccaggtctctcgaggaaggacaagccctgactgcgtgtgacgaatatcagggcctggctgatgatgctgacttgcaggtacatcgctgacgagatctcgtcggaattttgcttcagagatctcaccttgaagtgagactgcaattcatacacacaaaagcttcggctgttgatttaccaacaagatgttctcatgttcaggttcagattcttcagaggttgcaagattttacctcaaagaaggttgttcttgtgactgtccagtagaacagcacggttaccaatgcaaggtaggttcctatgacaactccagctgcgaatatctcattcagtttccagctatctgggcttggtgatggcttcacgcgatcctttgatattgtcatgatagttcctgatcaaagtagatgcccaaccatcaagtactgaataaatcgagtgtctattcctgcttttgatgcagtaaaattcagagaaaaatgatcatcaccgtcatttagtatggctatgatcagaaccataaacggagggaagtcgtactcccaaattgatgccagaagaacaaatccaatctgcatccaaacaagacgatcaatgacgagatttttgggagaattttgtgatgatgaattccagtttcgcttaccactatccttatagtgatggacactgcataaatctgcagcgaagaagaactctgtgagaatgtgaatcaagcaaaagagaggtgaatttttacaggtgatgaggtgagagtgtccaagaactagctcaccgtgtagttcttcatccgctggaagatggcgcggctggtgaggacggcgctgacgatgacgctgaggccgggctcggtgagcacgatgtcggcggcgcccctcgcggcgtccgtcgcgtcggagacggcgatgccgatgtcggccttcttcagcgccggcgcgtcgttcacgccgtcgccggtcatcccgcacacgtggccgccccccccttgaatcatcctcacgatctcgtacttgtgctccgggaacacgccggcgaacccgtccgccttctccacgagctcctccaccggaacagccgcgccgccgccgtcgccgtggcggccgaacagcgacgccgacgggtacatgttggtgcccatcccaagacggcggccggtctccttcgcgatggccaggtgatcgcctgcaatgatcaagaagcttcttggcgttgctccattgacgatcaagaagcagtacgatcatcgcgtgattataccggtgatcatcttcacgcagacgccaagatcaagcgctcggcggatggtgtcggcgctgtcgtgccgcggcgggtcgaacagcggcaggaggccgcagaacacccatggtccgccatggccgtgcttcgatttctctggcacctccttcactcaagccatcagatcagatgaactcaaccatcagacagatattcattagcaacaagtaaactgaactgaactgaacttgatggtgctacgactacctggtaagcgacggcgagtgaacggaggcctctctctgcaaatctgtcgatgattagctgcaccttttcagagatatcatccttgttgtagcataggctgaggatctgaagatgagagacatcagatgttcttcctatctgatcaaggtctgtattactattttctgaattctgatggtaacagcagtgagatttacagtgatggattgaaaagttcctacctgctcaggagcacctttgctgactctgaaccagttaccatcagaatcaacgtatgttatagccgtcctcttatcgacaggattgaatggaaggaagtgaacttcagtgatgctagagcgtgcctggcaatgcaaagatgatatccatgaaccattctgaaatatatgtaggatggtcaaatcaagcaaagatgagttcagaacctctttggggtcagctagcatgtttattatggccatatcaattgcatcttgattctccactcttgatgctcttgcagccagcaggataatcatttccctgtccatttctctgctgaaaaccttaaattacccaaggatggatcataagttgtatagctagtcaataattatgaattcaatacgttgcatttttttaattaatttttctacctcaattaggtttttgtcaacagtgagatggttgagggtgagagttccggttttgtcacagcagagaacatccattcctgccatttcctctatggctgtcatccttttagtgatagcaccctgccaaaaatcaattactacatatttttttccgggaatacgcaaggagcgtattttttccattaagagaaataaaagttatttacaatgcgaaaagaaaaacaagcacgggaccggtattggaggctggggatctaatggggatatctcgtgctagatttggctaccacgacctcgcagaggtaacggaagggacccctgcatttgccgacttccaaagcatggcttcctccgccatcgctttcgccaaattactacgtatttttgtaacaatgatatgtgatatgctgtctgttaattgcagaaacatgataacaatatcttggcacacctgttgagacaggtgatgagaacctattgcaagtgtgactgacagaacagtaggcattgcgatcggtatccctccgatcagaagaacaagaacattgttgatcccatcccggtatgaccggtgctggattgggaacatgattataacctcaacaatcgcaccgatggcgattgaacagatacagaagttgcctatggaggtaagaacctgaaaattcagtagtcagaaatagcttacagcacatccacttgtgagattcttattacagtctgaagatcgatgaatcaccttctgaaaatgcccaacaacctcagtggaatccactagatgagctgccttgccaaagaaagagtgtatcccagttgcaatgacaacagcttcaatctcaccatgcttgcatgttgagccagtgaacactatgtcccctgttctttttgtgacaggaagggattcaccggtgagagctgactacaagatggaggagaaacaaaatgtaatcaaattatctacacagatcaactaaatcagtcattccaattatcgatatcttccacatgaacggtgcgcggcaatttgagtcacctgatcaatcttcagaggatctccctcaagtaggcgcgcatctgcagggacaatatcaccaagcctgatgctgataatatccccaggtaccaatgtagaagcatcaagctcttgccattgctcatctctaagaacctggaggtaaatccatgaatatatgaacacaacaagatcagactaacacaatagattcacctgtatttttaaaatttctgttcagaaaaaaaaaacctttgtttttagcgccaaccgggccatgagtgcagcagcagcatcgcctgcattgttctcctcaatgaagctgattgttgaattgataatcaggaggcagacaattcccaggaaatcttcccagtcagtaccttggctctgaccaaagacagtaaatgagtgaataataaagaaaatccattgagttgcttgcacaaattttcgacgatttgatgtcaatatttcaataacacaaagcaagcacttacaccaccatttgctagaaccaatgccatcactgctgctgcctccatcacccaggacaaaggattccacataaagctgaggaacttgatgatcttgttctcctgacaaaaaagatttttttaaaaaaaaaaattcaggagttcagaaaaggaatatgtttcagtttcaggtaaacgatgatcagaaagaaaacagtcaacttacacgcttctcctccaatctgtttgcaccaaacaacttcaagcgttctgcagcatctgctgatgagagcccactctgagacgtattcagctgctcaaaaacgtcttccaggggcagattctcctgtcacatatccacaagaatcacggcatttttcaaagaatgcttcaaatccacgacatcctaacaaatgtacttaccaaatcaacatcttcgtcgaagaaattctctagcccaagcaaaggttcacctggttcatccatgccttcagctaaaatctgtcgcccggaacagaatgtgaaataatgaacacggctacagcatcgtcattttcattccaaatgttgcagtgaagatctcaccacgcattagacaatctgatggacaagatcacaggagatttaagtggcgttagcgaggtgggttttggttggttcttcttgaagtgttaagaagatggcagcttggactgaactggtacagtgagaagacctgaatttgggctgatccaaccaccgttcaaacctccagttagtgagcggacggtcacctgaaaccaaacagtcgcctccgattaccgtgagaactgagaaactgcatgctctcgtgtgcagatgcacgcacagtttctgtctctgctatggcaaacgcgaacatttgataaacattacttatacagtgattatactgttcatcagataattacttcgtagcagcacatcttttcattacttcatgactgttacacttattcccccaggaaagaatttttcatgcatctgaaattttcatgaatcagggatatgttggtttccatctcttaaaatatatgttaggaggcgtattcatagagtgagtgtagtgttacgtgtgcacgtatacatctcccgtgtaatcggaaaaggaaaatactcctatgatttcccttcagaaatatgagtttttttgagggtgatggactgattggctgatggtggtatataccacgtagaacgtagagagcagcaggcgccaaaaggcatctcccccaccacatcttccacaatcctcacccccgcctcccctttgtccctttcccaccgccccaaaaacccaccccctccctgactcctccccccgcagcttccgccgtccgcctccgctcccacgtcgccgcccgctcgtcgtcgccgccggtgagtctcctccactccgtgctcgccccctccgtacccagcagcaggatcggatcggtcgcgcgggcggcgggggtacgtatctgtattccgtagaattgggggaattcattccgggttgcggggttgctaaggtgttggattgactgcggtgacgggagggcggtagtttcctggtaaataggtagtaggagagatgctgagatgactgctggctttgagcatgcggcatatgatgatttagtgcttagtttgggggcttatctttagatactagcgggcgcatggttgtgagttcagtttgcgctaaccaccacttttgcatgaggaggcaaacgaggtcctctccagctgccctgccctagtgtgatatcatttgagcctttcatgctttttgtgccatgcttgatctgttccaatccatttacttcactaaccaaattatgcgggtcatatgcagttttcctttcatgtttctctccaactataaaagtttgattggccgcagccacatagagaaactcggaagattagggagtaaaccaatattaccactgtccacatagctttaacaactaacagctggtcctgctctttttttccttttggcatcagtttgttattgtcatgctatgtttccatttgacgactggactagaatagaatctgtttctttggctcgttttttttttttcatcaaatagtgatgacaaacttgataaatttacatactgatacagtgatacttggctgactttcataacaaacggttttgtgtattgtgtgtttaatggttcctcttgtttttgcagacgctcttgcgtgcttatttgtcaaatcagatctgaatataattttaggagttgcttcagcatggatactggctgcctgtcatctatgaacataactggaaccagccaagcaagatcttttgcgggacaacttcctactcataggtgcttcgcaagtagcagcatccaagcactgaaaagtagtcagcatgtgagctttggagtgaaatctcttgtcttaaggaataaaggaaaaagattccgtcggaggctcggtgctctacaggttcaacctttgtactctattattgcctcacattccatctcttgtgaaaatatatttgattggcttttctgcaggttgtttgccaggactttccaagacctccactagaaaacacaataaactttttggaagctggacaactatcttcatttttcagaaacagtgaacaacccactaaaccattacaggtcgtgattgctggagcaggtatgatataattctaggatttgacagatgaataatttacatatatatctaactttgatagcagtcacatcgtggtcttagcattgtagtttttagctttgatttttttttcaggattagctggtttatcaacggcaaaatatctggcagatgctggtcataaacccatattgcttgaggcaagggatgttttgggtggaaaggttttactcttatgcttttatgttgcatttaattttttttgttattcattctttttttttttggttgcctttatcttaatagctcatattcactgttagtagcatttgtggattattgtttttttttttggggaaatgccttgaacagatagctgcttggaaggatgaagatggagattggtatgaaactgggcttcatatcttttgtaagtaataactctggatttttaaggttctcgttgtgctatattttatttaggttattaccgccagcactgatagatatctctaagggttttgaacaaaaaaacatgtatcaaactctttcatcgataaggtagaaatgccatgcgggaagtatgaagtgatgtctgaggattaacacacatggtagttttattttgtaagaaacttttagattggtttttttcacagtactaaaaagtaactttttactagcttatatggttgataaattttaacgtcacataaatatcatgagctaattgaatataaatcctcctgttcatacatagtcttctttcaacctactattcccttccaaacatatatgaatatgacagatactgtttttccttccatgctcacactgttttgtcgtccacaacagtacatatgtgacattgttcattttgtgcctgtatgtaaccatatacctttttggtttaagttggagcttatcccaacatacagaacttgtttggcgagcttggtattaatgatcggttgcaatggaaggaacactccatgatatttgccatgccaaacaagccaggagaattcagccggtttgattttcctgaaacattgcctgcacccttaaatggtgagatcatatgcagcgctggagttgtttaattaaaccaagattcccagaagtacatcgtattggtggttacttttgttttactaacacatgactgtaattagggggtatattactagcaacgttaatgatagatcaatagatcatgccatggagcttttatgttgtcaattgatgcctatttattatttatcattgatcatgcgtgcatttaacaggaatatgggccatactaagaaacaatgaaatgctaacttggccagagaaggtgaagtttgctcttggacttttgccagcaatggttggtggccaagcttatgttgaagctcaagatggttttactgtttctgagtggatgaaaaagcaggtataagttcacaatatcagtttgtcaagtctctgtgtacaagacacatttctacctcattaatttggaatggatataggagaaggtgttgtaagctagaaaaccttttattttctaataaaaaaactgatgccctttattgttgcattcacattgggaagaactggcagttctgaggatgaaatgcttcatgtactcaagtttatgccctttattttgcccagatccttttgcacaggtttaagcttgagctatgcttttagtttaagaccactgtttcagttaaaggtcaacaaccttgcatgatttcttcctccacctagaaaagccattgcacatattgacaaagcacacaatcctgttgactatattctttatgagctaatatacagaactgttttatacagaaaacacaatacatatgctatagttatcaatctctttccctttttttgggataacggattaatatggtgcctgatacagttgtttgatcagcacagggtgttcctgatcgagtgaacgatgaggttttcattgcaatgtcaaaggcacttaatttcataaatcctgatgagttatccatgcagtgcattctgattgctttaaaccgatttcttcaggtatttattatgttgctctatggtcatgtgtgttgcatatgagtaattcttctgttctttccggagtagtaccttacgtattacatccttcttagtgtttcttgtctctgttgtttcctaccttgaggaaactcaaatgaattttcgcttagaggccttttaaaaaaaattatgcaaatgtgtaggagaagcatggttctaagatggcattcttggatggtaatcctcctgaaaggttatgcatgcctattgttgaccatgttcgctctttgggtggtgaggttcggctgaattctcgtattcagaaaatagaacttaatcctgatggaacagtgaaacactttgcacttactgatggaactcaaataactggagatgcttatgtttttgcaacaccaggtgattttctacaatctttgtttcttctgcagttcataaattatatatatgcggctactcattttaactgactagcctgtatttagttgatatcttgaagcttcttgtacctcaagagtggaaagaaatatcttatttcaagaagctggagaagttggtgggagttcctgttataaatgttcatatatggttggttggttgaattatttggttccaagtcggaaattactcatcatcgagtttgtggttctccttatgactcatattagtatttctgttggtttgaacatttcaggtttgatagaaaactgaagaacacatatgaccaccttcttttcagcaggtgtctcttctaattcctcatcagttttgctgtcctttcactgcctcatgcatttgctctgtgctatgactggtttatgaactaaaacgatttgtattgcccaaattgggcacattctatcctgattttgtatacattcttgattaataccaaatatcatatgtcccatgtattgatcttgttcccttttctttcaggagttcacttttaagtgtttatgcggacatgtcagtaacttgcaaggtactaactaggagacattatatgttacgaaatagtaactatctgtcatgtattattgctcttgtgtatttgttcttgggtttaccatcttcaagcatcacatgatatttattttagtagctgtaacaaaaggcccaaaagtgcatgtgttacagaaggaatccagtattaattattaaacttggaaagtagatatattttatttcagattcatttaggcaacatgtcacttggctctagagtctagattttatggaccataatagctcaggaaattaaagacatggatgcctactgaacggttttctttccttttgttttgaactctttacaggaatactatgatccaaaccgttcaatgctggagttggtctttgctcctgcagaggaatgggttggacggagtgacactgaaatcatcgaagcaactatgcaagagctagccaagctatttcctgatgaaattgctgctgatcagagtaaagcaaagattctgaagtatcatgttgtgaagacaccaaggtgaggacattttgcaagagcgccccctatctgatatatcataggtaggtctaatagttggatgcacacttctctcacgttcctttcttttctgtctcactgttacagatctgtttacaagactatcccggactgtgaaccttgccgacctctgcaaagatcaccgattgaagggttctatctagctggtgactacacaaagcagaaatatttggcttcgatggagggtgcagttctatctgggaagctttgtgctcagtctgtagtggaggtaaacgctgctctccatggttctgtttgtacatagatgcatcagacttgtattgttgtcttggtgcagttcacaatgattcagttttgtaggctaatgagttatcacttgctgatttcaggattataaaatgctatctcgtaggagcctgaaaagtctgcagtctgaagttcctgttgcctcctagttgtagtcaggactattcccaatggtgtgtgtgtcatcatcccctagtcagtttttttctatttagtgggtgcccaactctccaccaatttacacatgatggaacttgaaagatgcctattttggtcttatcatatttctgtaaagttgatttgtgactgagagctgatgccgatatgccatgctggagaaaaagaacattatgtaaaacgacctgcatagtaattcttagacttttgcaaaaggcaaaaggggtaaagcgaccttttttttctatgtgaagggattaagagaccttatctccctttgcactcactggttgcttatgtcacacctgggagatatgcccactttgtttcagttaaaatgaatcaacaatccaccacctgtcttgttactgcctccctaaaaaaaaagaagatattttgtatttatccggattcttgattttttgaagtcaggtatttctaactctacaaatccatagatcttcaatctgttgataacattcaaatgtatcattttgctcctgttatagttgaaatataaagatttaaaccgttgtaatttagcattcaaactttaaatccagtgtggatctatggagctatatcaaatagggctcaagtcaaattatcctaaatttgattcagttttgtagagaagagtcttaacacctaccacacccaagaagtgaattctgaaaataataattttcataattgatctagtggtgtcgatcataaatattatttttcttttttataaagttgcttgaacttataatagtttggattagaacagacacacaatccttatattttgatactcagggaataacgcatagttgtactgttaagtaaacaatagtataaacatattcactgaaccaaaggtttagtcagaaagggtcagagaagaaaacatgggcagtctaaaaacagtttgcctgtccttgcgtcaacatgggtcatactgtactattatattcagttcaccaagttgcaattagaaaaacaggggcacctgctggattatccctcagatatttctctcctccctgagatatttcttagctgattcaataattgtacttttgagactagcataacaaactatgggtcacaacttccaagccatatctcctggatatatcttgcagatattatgtacagatgcctgtgataaaagtgtataaatcccttgcccctgaagactctctttggataacgaatgactgaagtaagcatcagaagaaaaagaaaaatctcggacagtagtagtagtagatttgttcactgcagaatcacctgaaaaacacttttgcttatcctaactgaatataaaaggcgtcgccgtggagataactacgagcggacaagcccatgcctgcttgctcgtggtttcgcaggtagatggtcttcttcctgtctggtagataaaagattactttaagaaacaaaatacaaaaatatactatccctatctttttgagcatcttaaaaagattagtccatatcgatacagttaaaataataattaatcgtaaatacgagcactcatatcaaatctagaaattaaaagttagtggactggttccattaaaaaaaagttaaccagttaactcatgttcatttcacaaaaggagataaaagattttaagatgtggataatagtagttagttagtgaaaattttaaaaagtagttctttttatttttgtggcttctaattcttttctagattttatagctatcgactctcaaaatctagatttaaaaaaagctatttcaagaattataaattttatgagaaattgaagctcaaaaatctactcctgtttgttttcctagcctctcttacgcacagggaggtggggcccagcttcagagatctttttggcaacgccacgcccacgccagagcggccacgaaatatctgagaggcggcccggcacgtgtgcgcgcgcgagatattttctttcccccccgcgccacgtttcgcctcgccacgtggaaaagcgctggcacacgtaggcggtaaaagcggtaaagccaccgcgccttcttctttttcttttctttttttttttttgctcgctctctcgcaccgcatttatttgctccttaaacaggaggggattcttcttcgtctccctttgcttcttccgttgcaattccattctcctctctctcctgcttctctctctcctcctcttcttcacctcctcttgtctgtccatagatcgagccgctcagaccaaatcttggatgcgttctctcttctttctcgctgcgagggaggcgggttgttcgatctgcgggtgaaatcgagcgagaggtgtgatttttgtttctcttgtttgtttcttgaagttgaaatcttgtccgtgtttgtttgtttttttttgttttccctcttcgtaatcatccggtcgcgaggagatttactttggtttgttcgccgatttgcttccagatccctagacctccccctacttctctgtagctgtacatatttcaagagaggaaattttgggctggtttctgatacggttcgagaagatttttggcaatttcttcggattttcctccccttgtgggttccttggttcattgagaagaatcaaatgggtgatgtgtcagtcaatcgaccgatcaaggcggagccagctgcaggcggcattgctcaggtattagaacagaaagttttttctttttaccatcgtgtttgttcttaatttcaggtagcaattgttgggctcatgattctgtcatacagaatgcatgcttccttgaattattgccattagcttctttttcttagtaaaaagtgtttagtcttgtacagttaattgtttatctgaatttgtcatgcaatcgttcaagaaatgtctgtcatgtcgaaatagtaatataatccgcccatggtgcagtgaagacacataattactctgctcgtggagtataactttaagccatgcaatcaacactactctgatatttttgacatgaatttcactagttcaggccctcttttatctgacgttgttacaaatacctgaactctgaagaataaaatggttgtctctttttctttgacagggcaatcgaatcctggacatgatgtcgtcagggtggacagatgagcggcacatgcattatataagctcaatggaggcttctttcgttgagcaactctacaatcacgaacaaaatgatgctggcaacggattcaaggttctccgtggtggggtgtgggagaaactcaaatttgatcggaccagtgcttgctcacggatcgggagaaaatactgcctgcccgcaagcccctggatccagcatttcaggccgcgcgaatgcagtagcaatgcaaggaatgatgcggcggaggctttagtgggtgatcatgaatctggtattcagactatccaagggaggactccgttgtcacatggaagggagtgggaggcttgcaaggaagaaaaagctgttggtgaaagtacaggtggttaactcaattacctcattagttcacattgaagaatgcttaaaagtctgaattccttgtttcatcatctttttctgactatcagcggtcacattataactatataaggtgttctgaatagccatgcacttcataggttatgatttaatgcggtttatctaaaatagctttcaatggcttttcctgggatcaaatggtggtgcgtcatatttcatacaaatgttttatcaacactactgatttttatgcggcatgccaaatccattgttcttaagcccgggagcttgtatagtttttattttttgggtgatgtctcttgtcataagaacagaaagaacagaaaaaagttaaagttctactaaggttgctccaaaacagcgtaatgtgatgaacctagtctctaacgcctttcttccattttccttttatacagaggtctctgatcagaattttgctgatgatgaggcggaggttgatgcagaatcaagcaaagcatgcaagagaaggaagttaagaagtgctcttacacggaattaccaagtaatttctcaggattttaattagcttattctgttgcaaatattgagatgaagacagcacactaaaaaaaaaatcagagtatcagtagcactgacatggtttgttctatatatgcaggttgttccatctgacaaactgtttgcttccacaaaagctgatggaaggaaagatgctccagagtaaggcatgcaagagtggatctggttgaatatgcagtcaatgagaactggatgagttagtattggcgatttagtagtatagttctgaactctgtagagtctgtcttggtagaagaataataggatcgatcactcacaacatggtagatttattgtttgatcatattgttgtaatggttttttttgtgtgtgttgctgtgttctggcaactgtttgtttgcaatgtgagtaatatgtttatgtttgccacaagatgagaatgatgcaaagcccatcattccttttgccataattccattgtacatacatgtactcccatcatgatattgagaatgaaagatcaccaattttgcagaatgatatccaacatctgtaaaatgaccatatataattgtgttcatggtgtgtaaagtgcaaattttgagaagtactgaattactgatgatacatgttcttacttccctgtgcaaaccaacattcagcgctgtgtacaggtatgatggtacgcatatttgccactcctggccaccgtcctcgcaagagtttaccaaagaccccgactgaggggaaaccaaagaggcaaagaggaggaaaaccggagaaagaaaacgagagttgagtggaggttcgctatgaagagggggggccatcgccggtggcggcgagctcgtggtgctattcgtcacttgtagaagaggaggggaaggaactgctgcccgggaaggaagttagaggagaggaagacgaagaagaatggatgctgatatgtgggtctcgtatgaaacgagttacttcctccgtttcacaatgtaggtcattctagcatttttcacattcatatttatgtgaatgaatctagatagatatatatatctagactcattgacatcaatatgaatatggaaaatgctagaatgacttacattgtgaaacggagagagtacgttaggaaaccacatttaaaatcgctaagggagttaaattacaatggttttaacagttgagatgtcaaaatattacctggtattatgtggtattgttgttgaggaatatgaattagattgagcctatacataaagggagtcaaatcggacttattcctttgtagaaagcccttgattgggctgatcccctgggtcggcccagcatggcgccttgaactagcaccttctttgtctttacgggcataagcttctagcagctacagtttctcacataatctccaactctcttaagggtgtgttcgctgctgatggataggaacatatcacctaagcacgaaaaatgaagcagtccattagcgcgtgattaattagatactccctccgtataggaaaaaaacgtcgttctagccataacctcgtttgcgattttaacgacattctgaaccgcagcaggctatgtggacggaattacccttgtctgttcgatagccgctcccgcaattaatccgcagcacgcccgcgcttgcctcgtttaattccttaagcgtcgcatgcaggcatgcagcacgccgctcaacctcgccgctcacgctcgccgccgccgcttgcgtcgcgctcgccggccctgctcttgtcgctctcgccgctgccgccgccgcttgcgtcgcgctcgccggccgcgctctcgtcacgctcgccgccgctgctctcgtcgcactcgccaccgccgccgcttgcattgtgctcgccggccccgctctcgtcgcttgcgtcgcgctcaccggccgtgctctctcacgctcgacgccgccgccgccgctcgcattgtgctcaagatgcttgacgagaagcgcgaacgtgagctcactcccaggaaggatgatgccaaagaaatggtaagataacacaacttaataatcgcattacaaggatgtctctattaattgagtgcggaacctaactagcttcattctaaatgttcaatgcagcaagagtagccttggcttcatctaggaaagatggttgacaaactgatctgcaacaactcttgtatctttcttgcctagtttcccattcttgcttctagccaacaaagcttgataaacttgttttctcacttcttcggtcatgtctttccttccttcgatggtttacttcaacgagagccatgacatgttctagcaaaaggaagaaaatcaagttcattgatagtacaaatagccatggcatgttctagcaaaatctaattgtatcaaaaagaagttggcttaccagcaaggtgttgtacataatcgaaatcgactgcaccaaattcatttagtggcaagttcaaatcaaaaccagttaaaaaaaatggaaaacaatgatatgagaaacgatatagagaagaagagatagcacagttgccgtacaaacatgcacaagagaagaaaaatcctgtcaaacagagaagaaaagtaccattgccgtgctccaacggaggctcgttcagatcaaaggcaaactcgccatcgccatcttcggccatgtgtactgcaatagtgagaggaagctagctagaagcctagaactagaagatgagatggctcagtactccaaacgtgaaagcaagttagcgtataaatatgggcaagcagtaacctaagcgtcggcattctcagcacgcccacgcgaaaaaattaccacgggataggcgcgcgaatagcggtaacgagcgccatgcaaaaaaatttcagcatcacgcgcggcagtgaacccaaactaaaaaagcgaaacaaaaaacgcgcctaaacgccacctgcacgagcgccatgcagccaaccaagtatccaagcctgcccaaaacagtgccatgcaaaacctagaaaccaacttgtccctgccaagattcttacgcgcaaccatatttaataggggtagacagggaaaaatacccataattaatcacttcttggtatgctaaatgctgttctaaacgtcatttttactagtatagagagagtattagctattttttttttcaaaaatagatcaatataatttttttaagcaaatttcgtataaaaactttttaaaaaagcgcaccgtttaacagtttgaaaagcgtgcgcgcggaatacgatggagagggtgaggaatcattgggtccgaacacaccctatacagtccaaattatcacccaaattttgaatacagaaaataaactaagaaaccataaaccagattttcaaaagttagctaccaagcagtagattatcgtaattttaagcactccaaacaaggctagtacagcgttccgtctgccgccttcgtctccccatcggcggagaagtaggagccccgaccgagatggtcgcgtcgacggggaatctcttgccggcggcggcggcagacatggaggctatgcgttcggagaaaatcctatccgccgggggcgcaggattttcgttggttgcggtctgatgggcgaagcggaacgcgcggacgacggcatcttgttcgttcttgctgcgctggatacgtaaaaatctacgatgacgaataagctcgcctccgcgcggtggccggagacacgggacgtcgcaacggcaagcacagcgtactcacaccggtggctgattgacagcaagatctgcaaagctatcaagctctagccagtagccactactccgtcagtcagatcgccggtcacactgctcgcggtttcccgtgcgatcagatcacgccaactcaatcatgattaaggggagcaaaaaaaaaaaaaaaacgtgatcagatcagatcggcaggtgcgccgtcgacggcgacgagacgagaacgagacaggacgcgcctcagctcgctccgctccacccaacattctgacaggtcgatctctactctgaacgagcagttgaagctggcggctagccggccactcgccggacgccgatttgttaacttaattgcgtcgatccgccgccggcccaggcgaaaagatgccgaaagcaacccggcaatcgcaccaagattctcgtcgccgtcgaccagaaccgcgtgtatcaccgatttcgacatgcactcgaatctcctgaagatgattaaaattgagtgtttcatacaaaataaggtggtaataacatgtgattaattgagttttaattattataaacttaaaaaataaattaatctgatgttttagagaaactttcacatagaaagtttccgcacgaaacacaccgtttaacagtttgaaagcgtgccacgaatatctaaaatttcattcaactcttgttggagaaatgaacgcagcataatgcactgtaaagaggtacgtggtttgaactccaaagtcacctgttcaatccccaacacacaatttctttggttttgcgtttactctgtatttctcttttacattgcatactgtaatgacgagacaggaagaggattccatttagcaatcacatagcagtaggtaaatcgtctaaattgcgtagtagtacaggatttggtttgacttgagctaaactgtaccagcattctcgatcttgtttgagctaccactttggctctcgtcgtctcttatcagctacggccaaagtttaaacttttaaaaaggagtaaattacattcatgatgcataaactacctaagttgagtgcaatttggtaaatgagtatcctagtacaacaacttacaggtatttagtgtaagaattttataagtgattgtacgagtgcaataacttacaatgtaggtgtgattttgatacaataaataaaaaagtggtgcaacaatttaattataccgagtatttttttaaataaggattctagtcaattaaactttactatgtagaagatattatatttctgttgagatttgagaaggtaagaaaaaaaattcaaaccggtggtgcaaattagatctccaatgtaattcttaaatattatattcaagattataatataatatcaataggattgctacgtgatggtatattagattattaacatcgtgaaaaaaaattcacctagcactcattaactaaaacatcacatacttagccaagttgttacaccaaaatactaaaatttttaagttctcgtattagaacgcaccaacttaccaagtcgttacactcgaacgtcaattctcaagttcttctatatcacatccacttgtcaagttgtcataccatagatgcaatttacattttaaaaagttaactttaaggcttggtttttaaaccactaataaaagttaaaagagttaaaaggtaaattgtccatcgaagtctattttacagccttgatttttaaaccgttgataatacacataaagttttaccaataattatttttttaatgcttcgattatttttctacggcttatcaattatagctcaatcgatcatcagagccttttcgtataaatttttccagacaaataaatatactgaatgtatcgtcttcttcaagagaaatgaatatatgaggcaaaaaaaatccacaaccatatttccactacgaaataaagcctttagagccctccaagcatccaggtcaaatcatccatcaacctatcaccctttttttttttgtgctctcctggaggatgttggaagaacaaagaacttttcatccccaaactttcttaactgaaagacaaagaaatccaacaggatttggtgagaaaaaaaattgagacaactattgttcaagtgatcatccatccatgggcacaagaggaataagaatgcagggggtaggttaggtttgggcatggagttgccttcaaggctttgtaaccagcaatcctactactctcatctgaatctcatttcactctcacctttttatcaaacttttgctgttaaatcttgtgtgctgtagtagagggacctagactatgcaaccaaccatgcatgtttaatcaccttcatggtatgtgccagccaaaaaacattttgtgactatagcctaataattccaaatacatgccacctgcattcaaaaccatatgattaaagaatggaacattgcctttgcctttcttcagctactactgccaataattagtaaaggtacatgtgtaatcgacctcttagatttgatcaagcactaccctgaaaattcatccagtagaggtttcttttctttaaaacttttgtaaagatattgtcggccattaattaagattgattgcaagtaacagtatatcaagaccaaaagagagtagggaaccagcagtagtagaagtagaacatgcacataaagtgcaaataataaaggagaacacattttcacctaatagtaccatgtgtagcatttctttggttaaaagattagaatataattggtgtgtaagcaaatttttacatgacttagctggcacttaggaatgctttcttatgcctcaaatcaccagttaaacagtcattctaggtgagatgtaacttcactaatcccctcaaacggctctctccaacgtcacatacatagatttgtctgaaatttattcctcttacattacagtggagtaaagtttctgaaagtatcactgataccgaaaggagaaggaaaaagataaaaaggaaatgagaagaacaacaccaaagagaaaagaaaccaaaggagacgtactgcagcctcgaagcattggttccaactaattagctgctttttttatgatcgctgctaaatgtggattacttccagctttgtgcgtcgtcgtctttccacgtgtgaaaaccacgcagtgtttaagcctgagcacgacgtgtatgtacgaccagaaccaattcgatcatctctgcccctctgtaacttggatggaagcatctgatcagatggcaatgaaaacaaaagggaacacatggcttataatgcatatcaggaagcacttttaaatccagaaagcttttgtgttcatcacacctgatctccattctcaagtagtatattatatatttcttctcattcattgcatcatgaaagatcactagaaaacaagaacagaagaaaaaggaagattctgatcaggtcatcaggatggttaaaacttctttatcttttgctgcagtaaggaccgaagtgcagagaagagattgttggcaccatcatcagcttagcatttcagaagatcgaatcagcaacagtgtggctagtatgcttgtagcttatccatccatctgaccatcttctattgggattcttgaaggtgaagggaaagggataaaccaaagcttacatgtcagtttggtacgagagatgaaacgttgtgtactgataatagctggatagatggatgcatatcagcattaatcgggatgtggcacatcagggcaccggtgatattttttctccttaattatgatagttacggatggctgctcactagattagacacttaattttggccttaaatcaactgtacttatttaaggtactccaggaaatgagtaatacttaattttcatgtatttggcattaaaccaatcatgctagctttgttgagttggaatattcaaattccttggaagttcttgtcagagaggtatgttgttcctaccaaatattccagtgaaatgatatactgtttgcaacggaaaatgaccatttttgggccaatttcgatcctatttttcctccattaattacaaaatatttcattccacgaagctgatcgaggaagccttaggatcacttctcctaggtgtggcgtcattgtacttgtacatgttcttggcgcccaaaaaacattttctctggttttttgtcggtcatctaatccagcgacgtcggatcagaatcggacggccaagattgcgtcgaattcagagtgaagctgttcttgttcctgtccctgaacagtttgaatggtctcttgattgacccaaggcaaccgaaccgtaccttgctgtacaagggcttgttaataaaaacgacaccacatcagcaatcatatattccaaatccgacaggttattgtcacgaatactagtagaagcactagcactgaagaaagagaaaaaaaactgtaccgatcgaatcattaaaatcacgcataattaaatcgttggatgagaaaaattgattaatcaaatcgcaattaggctcgacatagctgcttcaggggggattgatgcaccaacctcaacaaacggatcagatatataaatcaatatatggatcgcctgtatgtggttgtggctgccttgaactggcacgaacctaatttaattagtatgcagattacacatatctgggttaattcactgtgcttgtttaattaatggcagtgtctacttatgtttcaagcttactgcagaaattataaaagagaggagtatccaccagaaggtaggaaaggtggtatgtcgtgcttgaagctactatatatgaattttgattagggcacagccagagctaattaacttgatcaactaagcaaccggagctaattaactgcagtagcaacagatcaacaaaagcaaccagagccaattaactgcagtagcaacagaccaactagattcactatatactgaactgtttttgaacagctgtaataagactgatctagtactatattatgtacctacagtgctttttctttgtttatatatacccctccgtccaaaaaaacgtgtttaggtttgtagcttggaattcgtttttttaacggagtagcacacatggattgactgtaggaatgagatcctctgctgacactgacatgctggcccaaagagagtagggcccacatgtcagtagcagtgactgcagagaagtagagaacatgtgtgttctagatcagtatgtgcagaggcagcagagtgatagacaaccagagctagtactaatactaacaataaagttaaaatatgtgctctagctaggcctaattttttctagagaagggtattttttacccatcctctatatttaaccggatatatacggccattgaaataggaaacttagccccgcaaacaatccaatctaaaattcgctccataggagatttgaactcagaaccttggggtactactcaagtcactataaccactaggctacataccctttcatagctaggcttaattaccacataaacaaagttgattgctggctcctgtcaactaacagtgcaatatgctagcaggaacctagctggtacggagtaataatgttttcactcttgttattctgcatagcgattcgtgcctttttgaccatgggaattaaggttcgatctgcttttatttagaccaggtatcaacgtccgcacgttcaaggatcatcggttagaaatttctaaaattttggctttaccaaatgctcctcttgtatataaaaaagagccccacaatccatgtgagtttcaaaaaaatgtttgtatagagcgagataatttgtttaagccaattttttaattcatgatatgctcttgtattccgaggtcgtgagccatgatcctaggtagagatcgagatagaggggatgggatcaccgcgatgcaaaattaactcaaatattgttgttaaggatctattttgtaaattccaacttctaaatttagttttaggtgttatatatagagtggagctgtggagtattttttttaaacgaaagtcagtgcgagttttatatgttaatatagctggagaaaaatataaatctatggttctgaagggaaaaaaataaaacaaaactcagcaccacctatctagttcatttaatgaaaatgctacacccaatttcgctcctatttcagacgatgaagaaactgtttagttgcatttcagctcgatcagctaaacagatcctaattactcctgcacacaacgcgcacgtcatgattggcactagtacacgcaatttgtagagcttgatcatcatcagggagggggactgaagtggcaagtgtcctcgagattcgagaaggcatggattgaatggaactctcgccacgtggcatctcagttcgttgcacccccatcctttctcaccgtacccaaccacttgcccccaatcttgcctctcacgtactgacactgttgcgcacacgcacgcacgcacgcacagcgcacaccgcgtccttcgcgcgcgcctcgccgcgccatgccgcgcgcgtcgatctatataaccccgcgccatgcaacgccgccccggcttaggcaaaacagcgcgcacctcagctcgcgacgcgcgccaacctcgccgccgaagcacgacacgaggacaagctagcccggcgcggtgtgccattggcatgggggtgacgggcggcgccggggaggccgtcaagccgtcgtcgtcgtcgtcgttgtcgccggtggcggggctgagggcggcggccatcgtgaagctgaacgcggcgttcctcgccttcttcttcctcgcgtacatggcgctcctcctccaccccaagtactcctacctcctcgaccgcggcgccgcctcctccctcgtccgctgcaccgccttccgcgacgcctgcaccccggcgacgacgaccaccgcccagctctctcggaaggtaaggtgagtccaccattcgtgcgtgcgaccgacgtccgtcaaaaagctaagcttcgatttccgacccaccatgtgttcgagagattgcttacgaggaattggctacacctgtgttttgcagctgggaggcgtggcggcgaacaaggcggtggcggcggcggcggaaaggatcgtgaacgccgggagggcgccggcgatgttcgacgagctccgtgggcggctgcggatgggcctggtgaacatcggccgcgacgagctgctggcgctcggcgtggagggcgacgccgtcggcgtcgacttcgagcgcgtctccgacatgttccggtggtcggacctcttcccggagtggatcgacgaggaggaggacgacgagggcccgtcctgcccggagctccccatgccggacttctcccggtac

SEQ ID NO: 51536 - DNA, 9709 bp, Oryza sativa
  unsure (1)..(9709): unsure at all n locations
cgccctacctctgtggggacccggaggtaagctaagcacaatactccatctctttcatattattagtcgtttgattttttttaagtttatttttaatacaaaataaacatattatcaaaatatatttaatgttgaatttagtgagactggtttagtgtcggtgtttctatcttttctataaatttaattaaaactaaagaagtttcactaagaaaaaaagtcaaacaacttataatatgaaacaaagggataataactatttagatgatattgttctttgagggatcaaaatgttttcttgtttttttttttttgctcgcaccctggttaattggttttcttctccgtgagatgcacgcgctcacgccatgcatgcatgttagtcaagcatgaaaacaaagtaggggaaatatgacaggtgataaaggggaaaaaagagaaaaattggtggcacatatgtggttcagcttctagaaactaaaagagagaatatatcatgatcacactgagacaggatacacatgtgagaaattttaaagaaatgcagaatagctaaagaagtttcagagatcaatagcttaggtttattttcagtctgttccgttagtatctgtggagaactggccactgaatgattaattattactccaaccatcaattaatggtttacagtaacctttagccaataggatatgcgaattataaaaaaggtagtaaacacctagtttaaaggggacatttttttccattacaagtttttatgcaaaacaaaaatctattgtggattttactactttttgtgtttgaaaaaaaaatacttcaatatgccaaggccatgcatgcacataagaacaaaaaaaaaacggatgcaggaaaatagaacattagcatcagactaaggaaaatagaacattagcatcagactaagacatgattcaattcagagaagtgttcccaactgctggttagacgcataacatgtcacctaatgaaaaccgatcagcatcaatacagcacacccacacaattaatcaagcaagcacagcataattaaccaatcagcttttgtcccataatcacttgtagggatgtatgcgcttggaatgtgaatatatgcatgatcagtgtgtgaggacgatttaacgagggtgtgtgtgggacaaagccacccaaagagcgtaggaatctggtcgggaaatgttgccaaaggccacgagctgataatggacaaggttctcatcatcaattcatcatcatcactcgactttctctttagcaaaacatacactaggatcgagtagtccccattattcctaccaaacctgaagaatctgatcccttgctagctatagcttgatcgatcgatcgatcgaggtgacgattcgttgattcaggttgaaactgaagcctccaatcaatcaacttgaattgtgtttagtcctgttcgatcgtcgacgctctattatattcataggagtactgacgatcgatccggttggtgcaacagtaaatctgttcctttttcgtaactgcatttgcaaccgttggtcttcagattatacggttcatcaggtgttgattaattgctctaggttgattagagtgtgtaccagcagaaactagctagctagcctatcgttgatcagcacagtggcatcccacctgagtggaagcttctactggtaatcatggatctatcactgtcagtgttatccacaagctagctagcgagagctaattaagctaaaacctgtccttgcaagagcagatagatctagccatctagggcctaggtctactgcctaaaccaatcgatcaacacacattattcacagttgataaaaaaaatatactagcactaaatattaattacttaagggattgatctgatgataagtactcctagcacactactcaattgctcataggatgccacacgcacagtacggtttgtacatgttaatagatcaggatgcacatggagatcgatggatgagcattgacagattaatcaagaaaagattaattaattagaagaggatgacgaccactcatagattaattagaagaagatgataaatgggcagagactggggcctctttcacctaacttgtgataggcatgcagctaagctggttggaagcctttcacctccaaccgtccgatcagtcgaacactatgatggcaacaaatgcatactacatcgatcggtcgacagggctgattaaactagattcggttggtggccagccggccggacagctgcgtgtagctaaatggatactactctagatggatagatagagatagcttgtgcatgaaccaattaatacttgcattgcatgctactacattcgtctccatggcggatgaccagatatctataccaaccgtacgcaatatcgtcgcaaattaagtttattgcttgatcttaccttgtgcaattcgatttgattctttggtggttttgacttgtctgacacttctagtttgttttaagctaagattatacagtatattcatactattcagttggaatagttctttttttttagcttagttggaatagttcaagaagtgcatgaatgatgcatgtgccacgcactacggatcgagtacatatactatatagttaagaaatagatttattgatctgctaaaagattaggaaaaattcttcgtcgtacgcactagtttttgagttcagatcaccttggacttttttctttttttttagaactgatcaccttggacttggagtaaatttgttttcatggataggtaaattgtcagatcaggcacagtgcagtttcgcaagaatctagcacgtgttcttctctggcgtaagctgcagtcaactaatcaagcaattaattaatgaattaacgcaggtatccaggaagtgttcaacgtgtcggagctgacggcggcggcggcaacggcggggcggccgcggcgggaggcgtacgcgacggtgctccactcgtcggacacgtacctgtgcggcgcgatcgtgctggcgcagagcatccggcgcgccgggtcgacgcgcgacctcgtcctcctccacgaccacaccgtgtcgaagccggcgctggcggcgctggtcgccgccggctggaccccgcgcaagatcaagcgcatccgcaacccgcgcgcggagcgcggcacctacaacgagtacaactacagcaagttccggctgtggcagctcaccgactacgaccgcgtggtgttcgtcgacgccgacatcctcgtcctccgcgacctcgacgccctcttcggcttcccgcagctgacggcggtgggcaacgacggctcgctcttcaactccggggtgatggtgatcgagccgtcgcagtgcacgttccagtcgctgatccggcagcggcggaccatccggtcctacaacggcggcgatcaggggttcctgaacgaggtgttcgtctggtggcaccggctgccgcggcgggtgaactacctcaagaacttctgggcgaacactacggcggagcgggcgctcaaggagcggctgttccgggcggatcccgcggaggtgtggtcgatccactacctggggctgaagccgtggacgtgctaccgcgactacgactgcaactggaacatcggcgaccagcgggtgtacgccagcgacgccgcgcacgcgcggtggtggcaggtgtacgacgacatgggggaggccatgcgctcgccgtgccgcctgtcggagcggaggaagatcgagatcgcctgggaccgacacctcgccgaggaggccggcttctccgaccaccactggaagatcaacatcaccgacccccgcaagtgggagtagattgcctcgccggcgatcgccgccgtcccgtccccgtacgacgtggcagcttgctagcttagctgggctgggctgggatgggctggctggccgcatttagaattttgggcctccgttaattctctcttctttaacctctgttcatatatacacgcacagggactatagatttactaagccctcggtgaataattcaatcacaagtaaataattgagtaaaatgaagtcacctttttattgtcaaagttttactttggatcacacttaaaccaatcttttcattttagaccggataactttgcctatagtatttggcttggatcaccccactctctttactattcatgtatagatatgagcagcatataaaaggggaagttcaccattataccgaaaccgatttgattgaggttatttatgggtgtttgaagaagttaaggatgatccaaacttaaaaaaaattgataaaattttctgatcatccaaactaaaaaatatacaaaactatctgattctaaagtgaaaagattgatttgagggtggtccaaagtaaaacttaggcccaaatcacaatccactcgcaataatttgatccagtgatcacttgggcctcatttctctcatgggccgtgaaagaggtttcaaggcccatgacgcacacctaagattgaccagttcaactaacgtttgctaaatttaagcggaagccgttgaaaagccaaggaagcaaaaaccacccgtttgtggcgcgcggtgatccataaacagtagtggcctcccttcgtgagccccctttcctcgcgtcgtccccttcgcggagcctccccttcgtgggcgcgctccattgctctctcccctcccacccaatcctattatgacattacgatgcctatccccattgccttcctcttcctcctccccctcctcctcgccgcctcctcccatgccaccgcctcctcccatgccaccgcctccgtcgtcccacaacctcgaggtaattcatggtactccctccattttatattataataaattttatcttttttattaaataatcaattttgttaaacttataaaagaatataaaaatattttctacaaaacaaacatatataatcatagtatatctaatgttgttgttgttgtatatgttgctaattgtttatgtaaacttgattatatctaactgatcagaaaaaaaagtttaagccactaattatatcacaaacacggagtaattgattcttgcatgcaagaaatgggacgtgtaatggtgggtgatcgaaatgttattatagggttctatataaactgtggatcggagaaggaggagcagatagggagcatcaagtggatacaggatgaggggttcatcgccgtcggcaacatgtccgccgtcgacaagccgaacatcctgccgctgctcgccaccgtgcgctacttccccgacgcgacggcgaggaagtactgctaccagctccccgtcgtcaaggggtcgcggtacctcgtccggacgacctacttctacggcgggttcgacggcggcgacgttccgccggtgttcgaccagatcgtcgacgggacgcggtggagcgccgtgaacaccaccgacaacttccggcggggcatgtcgacctacttcgagatggtggcggaggcgcaggggaagacgatgagcgtgtgcctggcgcgccgcgccgacacccggtccagccccttcatctccgcgctcgagctcgtcagcctcgacgactccatgtacaacaccaccgacttcgacaagtacgtcatgagcaccgtggcgcgcagccggttcggcgccaagggcgagatcgtgaggtacgcgcgttnctgcgttcgccgccgtcacgacggcgcgttgttgtgtcctgattaacctgacatggctggaatttctagctatccagatgaccagtacaaccggtactgggcgccgttcacggacgcgaacccgacggtggagagccactcggcgatcacgccggaggagttctggaacgtgccgccggcgaaggcgctccgggccggcgtgacgacgagccgggggaagaagctgtcggtgcagtggccgccggtggagctgccggcggcgacctactacgtggcgctctacttccaggactcccgcacggcgagcccctacagctggcgcgtcttcgacgtcgccgtcaacggcaaggagttcttccgggagctcaacgcctcggcccccggcgtcatggtgtactccaccatgatgcctctatccggcaagatggagatcgtgctcacgcccaacgagacgtcgccggtcggcccgctgatcaacgccggcgagatctaccagattgtgccgctcggtggccggacggccaccagagatggtatgcgcctccagatcagggtttgaaatttcgtttcaaaatttccgaaattcgccccccaccggcaatcttatatctcagtccgaaaattttcggttttttgcttttttttttgtgtgaatttggtcaaattttattaaaaatcagtcaaaatttcaaataatttcggccaaaaaaaatcgaactttatgaaatttngccccccccccccctccaacccaacccccaaagaaaaagcaatttcgaaaataaaaaccctgctccagatcgatagacaggctgatctccaaatgtcaagcagtttctttctgcaaaatttgagcaaagcaaaattttaaaagttcatcattgtgctagctagattcagtatgtgagattaatttttgggtgatgagaaggtttaggatcttcgcttgtgcagtggttgcaatggaggaacttgccaggagcatcaagaacccgccgccggactgggccggcgatccttgcctgccgcggcagaattcgtggaccggggttatctgctccgagggatcacccgtgcgcgtcgtatcactgtaagtgttcagattgacatggtttggcacctatgaactcatatggtgttgacagtgaataagctaccgagatgttggttgttgctgtgatgatatgatccattttctgtatactacagggatctaaaaaatcatggtctttcaggatcgctccctgacagtattggaaatttgactgggatgaaaaatatgtaagattgacacgatcatatagagtgaatccgaatgatcaaatgggataagcacttgggtctaattttcctgttgaaattgtatgcagctatttcggtggcaacaaactcacaggctccatacctgatttgagcagcatgcacatcttggaagaattgtaagctcaatggataggcagtaggagattgattactactcatcctagctaggagactcatttccatcatactaacttttctgaatttggaaaggcattttgagggcaatcagttaagtggaccaatcagcccatcgctgggaacactcaccaatctcaaggagctgtaagtatcctaaccctctttttgttgcatgtccaaacagctgataactcttagtacttgcctcatgcatttgctcctgcgaaagacagatacctgaacaacaacaatctcaccggccagataccagagagcctgaaaaacaaacctgaacttgacatgaggtatgattggggaacaaagtcttcacattttggatccattttatatgctgatggtattgcttttgcataaaaaaaaaatatatatatatatatatacaggactgaggggaacaaacttaattgaggctggaaaggaaggaatatctgagatgatcatttccaatctaatgttacatttatgtacagaaagatacagtttgatgatgaaggagaagagcgaaggcttcagaaactgtaggatgatattcatgtatgatgctgtatgtgagttgaaagattgatgtgatatttagcatcatccttttgatccattttgtgttattagtatttgttgtacatgctgcattagatggcattagtgtaggataattgttaggtcaaagaagcagttcataatctaaccaatctaaacgccaaaagttgtaccatgttccatcaaaacttaattaggacagaaacatgcagtagccagacacataaacagcagatactccaaatctgtcagctaataaactcccgagtgtcgaattggcagtaattgtggacacaccaattacaaacaacataagagtggcaaattgttccttctcccaacatagatatgggctacatgatagatgctctgcaaactagcagagtaacagattaagtgcctaatggtaatactaacagatgaggcctaaacctacccaaaatgcaatttttcgtctgccgatgtgttagtagtgccgtctttgttgatgtcacttggttacctcatttccatcatcaacagtagctcggataatatgcacctggacaaaaatcaattttcaaggattattcacattattcatatataaaacatgcttaagttacaggtacaaatttattcagacatattgttcagttcagtaaaaattaataccttgaaggttgtaggcttgaccaactgaaatactgtcgcatctccatccaacaatccatggtccaaagcaaagccagcccagccaccacttaggccattcttgtaggcaaggtaattggtatcaaattgctcgtctttctcatccaacaaagtgacaatggcatcatgttttggcaggtaagtctcgcagaaatgcctcggtaagcccttttgatcatgccaccaaacaagtattagtaccacatgacaacagttccccttaaagaagggttgcagggatgggaatgtgatagtgcagtactcaccaaccaaaatcctcggaccacatgtgaatgtagcattggcttcacgaaggagggaaattcagggtcaagttgtgattccagttcctctgcttttcttgctgcctcgagcctagcttccatggaaattgatccacgggttgccaggtagatactgtcaattgcttttcgtggagacctgcagaagaaatcggacaacgggatgtagttttgcaccttttgctacttagtgggaggcaatacaggcttcatacgctcatgtggtaatgttattgttatcacataatgacataccttttcatcctctctgcgccatctggtgctacctgccgacaaatgctacttcttagtacagaaaagatgtttcttatgatggttacatacttacatatgtggatgctaggaacaatggcacaatttaaaatgccatttactgaaaattgttaagttctgctaagaatggtttgtttcagagacttatttaatgctcagtagttcctaccaaatttgcacatttttttatcaattcagttggtcagaaaacgtgaaatacagcttcttcactgtgcaataggccgtttttacagcttgcactagctggattgacagccacggctagaacgtatgaaaatcacgctcaataatttgtaaccttaaacttagaaccagatgcatcagaacaagaagcaggtgtatctgaacttcttttttttttctatgactgaatattactgaatctttttttctccttgacatttattactgtgtaaatggaacaccaaagcaaagcagttacctctgcatacttgacctcagggagattagcgaggcgccgagacctcctcggaggcgagggagccacgaccgccgcctcgatgatcctacgcctcttctgcttctgctccgccgaaaaaagaaataaaaccaaaaaaagaaagatcaaattaatgaacggatcgagcagcgagcgagcaagagcaaccgattagaatgtagagcgcggtggcagcatgagttggtcaccatgggggagggggtcttgggggc

SEQ ID NO: 51537 - DNA, 16284 bp, Oryza sativa
atatgttatttcggtaaaatggaggttgtgggaacaaatccttacacatatgtttgtgctgtgatttttttttcttccttaccaaaacaaatcttgtaatagatttaacgattcaaaattacgtgaaacttatatacaagttacactgtagttacatgcaagttacaatgtaattacatataagttacagtgtaattacactacgattgtactataattacatctgtcaaatttttaggagaaaatttgtcgacaaatgtataggtggtcccatgtgatatatttggtccgatataaagtgtggtcgcgtacggtaacagtgagaagggaatttttctactacgtactacatccgtcccaaaataagtacagccgtagatatccgtgcccaacatttaaccgtccgtcttatttaaaaaatttgtgaaaaatttaaaaatatttaatcacacataaaatactattcatgttttatcatctagtaacaataaaatactaatcataaaatttttttaaataagacgaacggttaaacgttgaacgtgaataatgtaaaactacacttattttaggacggaggtagtaaaaagatgggtatgcaacttgagtacgtgcttgacataactgtgatgcagtccaagaacttgatcgcgaaggaccgagatcctctgagaagaccgtgactttgatccattatcagtcgtccgatctacagtatctggtgaatagtaaatcaaagcagtagtttttacttttttactgtgtctacagtaaaaaaactgcagagcaatgttttgcactgtaacaccagattcattttactatgtttatcttccgttcgcttccaaagtcagaggagccggatccgattggcgaatgctgccaacgatcctgacgttgttgacctgacctggcacgacaatgcaaatccagtacagctgctgtttcagatgattgacgacaagccgattgcctttcccttatctgaaaaaatttggtcagatcagatgagtcatgaaatggatggatgcatagaggtcggaactgttggatttgtctgacgctgaacgcgatcgatcgatcgatcgagtgatctctcgaaaatgatgccccgtacacgtaggacttgtttactttgctactattttcaacattaacaagttttggcattgccaaattttagtaaggttgtcaaaattttagcaaggctaccaaattttagcaatattttatacgtacttactaaaatttgacaacaaactaaatgtagccactttttttaactttgccaaaaaaaaagtaaagttgaaaatggtagcaaagtgaacgagcccgtaaattactcatacgtaatattgtcaacctaggccttgtttagttacaaacttttaacttttcaatcacatcaaaacttttctacacacgtaaactttcattttttccatcacattgtttcaatttcaaccaaacttccaattttgacgtgaaaacacacccctagaatggcgatgaggacgaagctgatgtggagtttgatggcgacggagccatcgccgtcaagcacgcaaacttatctagctgcgactcctgatgttcctggccgtgatcgagctcctgcgttcttgcttaatttgagtggtcggatcggctactgagctggtgcggcggcggcggctaatcggcggcatgaggatcgcggtgacgggcgcgacggggtacctcggcagccgcctgtgcggtgcgctggccgacgccggccacgccgtgcgcgcgttcgcgctccgctcgtcgggcggcggcggcggcggcggcaacgtcgaggccggcctgctcccggcgtccgtcgagctggcgtacggcgacgtcgccgacgtggagtccctcgccgccgccttcgacaggtgcgacgccgtcttccacgtcgccgccgccgtcgaggcgtggctgcccgatccctccatcttcatcacggtacgtgtacaatcttttaaaaagaaaagaggattttaaaaagaaactcgcgaaagtttctaagcaattccgaaaaatatatgctctataaaattgatttggtcatttggtgttaaaaaaatgggcatttaatcatatcctcggacgtgttatgattatcaggtcaatgtgggagggctcgagaatgttttgaaagctgccaggaggacaccaacagtaaagaaaatagtttatacgtcatcattctttgccattggcccaactgatggatatgttgcagatgagacacaggtaccatatttatattggagttctccttaattagctccctcagttttcaaatccttcggtctagaaaatctgccatttcttgtgtgagatgtccagactgagcatgctaaaaaaaattgtgcaaaatatgatgatatgtatacttcaaattcctttcgtgaaagaaaaacatttttgcagagtaaacaataagttgctgatattgcagatgcatcaaggaaaaacattttgcacggagtatgagaaatcaaaggttcttgcagaccagatcgcattgcaggcagcagcagaggggatgccaatcaccatcgtctatccaggattcatgtatggtcctggaaaacttacagcaggaaatcttgtttctcgcatcgtaagacaatttctctactcctagttattcatcctgcatatatggtatatctgaatgacccaaaaaaaaagaacttgttcctgaaataattaacagccatgaatcatgatcagaaacttgaacatcactggctcttaatttgcagttgatcgagaggttcaatgggcgtttacctggttacgtcgggcatggccatgatcgagaatcattctgccatgtcgacgatgttgttgctggacatgtagcagcaatggagaaaggcagagaaggtgaaagatacctcctcaccggagagaacacgtcgctggttcagatcttcgacatggcctccaggatcacgaacacaaaggcgcccagattccacgtacccctctggttgcttgaaatttacgggtggatttcagttcttgtttcaagaatcaccgggaagctcccgttcatcagctaccctgtatgtctctttctgtgctccttttatttccagtacttacttaggttcagagtttgtttttgcagggtctagttagattcagagtttgcacattggtgatgatgatgatgtattgatgtggttacttagatttcagttcttgtttgggttttgcaggcagtgcgtgttcttaggcatcaatgggcatactcatgtgagaaggccaagaaggagctagggtacagtcctaggagcttgactgaaggtctatcagagacgctcttatggctcaaggacagcgaaatgatcagattttagtgttctacatttcactcatgtaaacatatcagcattgctgtaactgcataaatagttaaatcaaagaaaacatgtggtttgaaatttgaagatgaatgcgtgcaccaaacagggccaaatttcttcttagatggtcaaatttgttcctgctgatcactgatcagacttgagactcgagaggcaaaagcagatcatatttgggcccggcccacaagtgacttgggcccgcttgcttgtgggttgactaggggtactactggacaggctggtggctggcctcgccggaaggcttggaagcccgcgttgactagtggcggttggattggcggcggcggcggcgactcgacgatgggcggcggcatgagggtggtggtgacgggcgcgacggggtacctcggcggccgcctgtgcgcggcgctggcggccgccggccacgccgtgcgcgcgttcgcccgccgctccagcgacgcctccgggctcccggcatccgtcgagctggcctacggggacgtcaccgacgaggggtccctcgccaccgccttcgacgggtgcgacgcggtcttccacgtcgccgccgccgtcgagccgtggctccccgacccctcggttttcaccaccgtacgcgtgctgattcatttctgatgttttcctgtggcaagtagagggtaactatattcattcaaatcaaagtggggagtactatagaacgctagatgaacctagacattctgcctattgtgcgatgctgtttagggtctttgaaaattatggctccaagtccaacaataattgattttccgtttgctgttctgttcatgaaactaaaatgcatgcaaattcggtttggcttggtgtaagaaatggcacttgagcatgcgcgttctgtgctatgattacaggtcaatgtgagaggactcgagaatgtgttgaaggctgctaagagaacaccgaccgtaaagaagataatttacacatcttcattctttgcaattggcccaactgatggttatgttgcagatgagacacaggtaaaacatgactttgaactgtgtaagctttttaccatttcatgtttgaaaagcttgaatagtaaataaaaggattgtattatgattgtctttagtagttctgcccataggttctgttctaagctcattccttgatatgtactccctccgtcccaaaatataagggattttgaacggatgggacatttcctattactacgaatctaggcatactctctttgtactttcgtagtactacaaaatgtctcattcatccaaaataccttatattttggtatggagggagtagtatagatagcacttggctgacccgacattcatgttaataggagcacataaggtgtccattagtagtatagatagtagatagtcgtttttcttgatttccattgaacttttaatgataaatttctataatgggcaactcactcttgaaacctagctgttcaatttaccccattccaaagtattttgatttacccctgacactctcttatttctaccacttgtataattctttttgataccgacttttagtaacaattatccaacttatgcatgtcctgttgaaatggagtaaccatttcatcaaattatcctctaattacaaaaaggccttttacaaattaaagtaattctataagctataaacagagttcaattgttctaaatttcagagacatcaagagaaaacattttgctcagagtacgagaaatccaaggttcttgcagaccgaattgcattgcaggcagcagcagaaggggtgccaatcaccattctctaccctggagttatctacgggcctggaaaactaactactggaaatattgtttcccgtattgtgagagaatttcttactcatggctatgtcaaatatgtagttatttattatcgtatatttgtttcaattttaaaatataacatttcctgaaagatagccatgaccagaagaaattaaactgttgtgattcttgcagttaattgaacggtttaattggcgcctacctggttacataggagatgggtatgatagggaatcgttttgccatgttgacgacgttgttaatgggcacatagcagcaatggagaagggcagaccgggggaaagatatctccttactggagaaaacttatcattcaaacagattttcgatatggctgctaacattacaaatacgaaggcacccctattccatgtacctctctggttgattgaaatatatgggtggatttcagtttttatttctcacatcactggaaatctcccacttatcagttaccctgtatgtccagtattcttccttatttaagtttaccatctccagataggtcatgctgttgtgcttactagattctcaatgtggattgcagacagtacgtgttcttagacatcaatgggcatattcatgtgataaagccaagagggagctgggctacagtccaagaaacttaactgaaggtctatcagagatgctcttatggctcaaggatgaaaaattgatcaagttttagcactcaccccttgtgctaacttgtgctgcattccacaccatgtaaactgagatctgatttaaacctattaactgtaagatgtacatgtttggtgtggtgttaatgttgtatcatatcagtaataacttgagatgtaacatggtagtactggttccatggaagaaaggaaaaacatgttcttcgattgaatattggttgatttgattctttacaggctgcagttgcataagtagttacagtaaaaaccacgcaatttcaaatttgagaacacgtttaaatggaattttatcgctacctaatgctgggaaggtatatgcagaaatccttacactcgcattgcaatttcaaaacaatacagaatgttttgaaattgcgagatgccgaacacagctcacgatcaaaatgttgagcagaagaaaatcagaacatgtagcacaacaattcatgacacaagcagctatttgataaactgaaatggtgaataatccatatacaactacagattggaatacacaactgagctgtttccatggtgatcactgaccgctcgatcaattaaaaaaaaattccaaacccagctggtcaggtcaattcctgaagcaatttctccagcgcatcagaaacaagaggaatgtggaggcaatcttggccatcagagtgctttctgatcttcaccagatcatggtctttaaactccgtcaggtgggagttcagcgtcacttgactgcttacaagaaaacgctcacggcatttggtatacaagctactgaaatgcatacctggcaaacaatgtagcaaggtttagtttgtaaacaacaggaagtcataagaaaataagtctgcaacaaacttgccttcctccttctcgtgtgccaactgatattcagcaagaactctgaagacactttgcgcatttggtgtcaggctttgcagaacaacgagggcggttttcatggtttgggcatgaccgccgctggcaagaatcaaggggtagaacacaccttcaactttgtaaggtgcaaacgttgggacgtgataccagctccacttgaactgtgtgtgcaccatcttcttgtcccatactacagttatttgacaggttaggaatcttaaacagtgaaggcattacaggaggttaaagctagccaggaacttacacaaaggtgcattaacatgatctactgatgcgacaacatggacttgcgggcagcacgaaacttgagctaggtactgctgtgattcagcgtcacgcaaggcaggtccgtcgatgttgtgaataagaaggcatacattgtcatccccattgtcagatgtctggttatttagaaaggagataatatcatctattgattgggatgcaaatggctgcaactgggaccttgttgctgtctggcgttttctcttaagttttgtttgttcccaaaatatttcagctattgtcactatgacctgaaatggcaacaaggcagaaaatttggcagaattaagagctttgatgtagaaatcaatagtcctccacaatataacaagaacttcctgattaatgatagtaaggaattacatgcacatgaatttacttgaggtgccgaatttgacaatattggaatggttgaacaaatagaaggtacagatgtttcaatatgttaagttacaggtgtttgggatcatgatcctaataggcaaacaaggatctccatatgactgcaagcaacaccaagataaaggaattgcgcgcagttttcatgaatcatctatttcagcttcacaactagtcaactattagagagcaatgtttgaagccactttgagcatgaatcagtggaaattaagattgcacaatcaactttggataccaaattgatgcctttggtccttatagtatttcatttgtcctaaaccttaaccccttaaggactgtaggctcaatgcttttttttcccttttcaacaacaatgcgataaagtaatccatactgcaggcaacaaaggtcaatatcggtcaggaggaggtcatacttgcttcaagttgatggaagggagatagccattaaccacaatgacggtgaaatcgctcaaggtcgtggacgcaaaatcctcaagcaacatcttcttagatccaaatccatacatcaggagcccaaatccgcacctgcagaagaacatcacatcgatcttttggcttcatccacatcaacatcaacactgggaggattttgggtagcagacgaacctgagctcgaacagccagttgcggtactgctccttgtagcttctcgtcagagcctccacctctctctcgtgcttcggggggatctcagcgagggatgctcgcagcacctgcaccaaatctcgaatcagggcattcgccatggcctcgggaacacgaatcggagggtttccaggaggggcgggttatgcagacctgctcgtcgacgaggttgaggtcggagagcttgccggcggcgcgggcgcgcttcttgccagaggagggctccttctccttggccaggaagtagctcctggagaagccggcctcctcgtcgtcatcctcggacccagagcttaccccagcagccgccgccgcgtggccgcctctcagtgccatcggggttcgcttccgccgccgccgccgccgcgaggatggaggacgagaaaggggaaggacgcactcgtgcacagcctgccggtatataactgtaaatggttcaatacaagtagaaaataacaaataagtagaaaataacaaatagtaaacgatacggtatataactgtaaatggttcaatacaagtagaaaataacaaataagattgaatcttacctaaatgacaatgtaaattgttcaaaaggtcttagataaatccacgggtgggattggtacatcacaagatgcaactcctttttgcttcatgcttttgaataagtaacgcaatgcttgacttctccatgcctcaatctccaaccatcataccatgcaaaaatgtcatatgaggttcattgttgcacacaattttgtggtaatttatacaaatcaatatctccttaattggctaatcacagatattattgaagaaattgatttattactaagtactggtctagtagaactctatagaagggggagagggacggccggactgagggagagccagagaggtagttcactagcgctcaccggagtccggagtccggagggggagggccgctggggccggcgcagagggcgggaggccggagtgccggacgcggcggggcggcgtcgggcgagaccacgggaggccgcgcgaggcggggccgcgggaggcggcgccaaggcgggcaggcccaggccggggggcagccgcgcggggtgtcctccggcgtgcggcgtcggaccgtcggtggctcggtgcgtgcgggagtgcgccgtgtgggcggtgcggcgtgggactgggagaatagccagctagggttttttttttttttgttgcctgttgggccaagcttttttgataggccaagaaaactgaatacctgctcttctctgggtctctgggtcaaattctagggtagtcttaggccgagtacctcttggggctcttggggcgcgtagggtaggtggtttatgcggtttatcggggaaaaccggttttcccgcgcttttgctacctcttttcgtggcaaatggctcgatcatggtcgggcccatccagcagtttcagttgggcattgtcaattttgttagcctcgaggatcaatttttcgtgaagcgcctacaaatcgggcatccgatttgtttgtcaaaaatcgggtgttgtttcactaatgaggaaaaaaatgtttcaccaagtagattgaaaatgtttcgatcttttaaaatgctgaaacacaatcaaattacaccatgaaacattttttttacaacgtatgaaacaatgatttcgaatatattaaaatatgaaacaaatccgagtacatcgagaataagaataaaacaccatcgaattgaaaatgtttcagtgctgaaaatggtgaaacagaatcaagtcacacaatgaaacattttactacaacgtatgaagcaacagtttcaaatgtattgaaacatgagacaaatccgagcacatcgagaaaaaaatggaacaccatcgaaaaccacattgcaacattttgatctaactgatgaaacatcatggtacatggactaaaacatcacaatattcaagaggaaaacctaaatctgcctcttcctccactttggtggttagcaaccacaaccgcatcgacgccgcaccgagctccaccgcacccgcatagccactgtcgttgacgtcgcacggagctcggctgcgcagagctccatcgccaacagtggcgggggcgctgccgtagcggctgcttgctcagggaggtggcggcgttcgacggtgtcgccgtcatggaggagaagcgtcgccgtcgcggaggaggagcgattggcagtagccactggctcggggaggtggcagcgtttggtgtcatcgccatcacagcgaagaaacggggaggagaagcatagctgtcgcagaggaggagcgattggcggcggccgtcggctcggggaaggaggcacggcgccgccgctatgcaacgtgtgggagagagatgagcgagataaaggagaaaaaatagggaggggaaaagtcacgggtgtggaaataggtggttgagagcccccgatattttttgctcacgttgggcgcccaagactgagcatatccaaccttttcacctcttggtattactccatcggcttgttagccgatccgctttctggtgatctacgtgtttatctatcttgtcagttgcaggatcaaactgattggcacgcctgtacctcatcaatattttagacctgcactggagctaaaatgatctcctaggccgttatgttcatcgacttagtcagcgccaacatagttctggcaccatcggccaagcgcggatttttcatcaacacactgccacccagatccccgcacgccccacgtggccacgcccgatgatgtcccctctcgctatgctgggctagcctggacaagtggacaggtggtgagctccgccgaatgcatcaaaatgatcactgatcattactgtcactttgccgcatgcaatgtagcctgcagtacttagtttgttcctgttaattaccatgcttagttacacgtgctatctttgaatcataggttcgccctagaatattcttgcacaaataatcgagtcgaatatgatgctttgttattcgtcttacaagtattagaagttatatgagcaacacatatagatatagatggccaaatgggccacctggcccgacacgccacgtcaaacggtcaggccgggccgggcctgcccacggcctccacctacggcctaataagagtcaggccgtgctagccagcctaaaggcatgacgtgctcatccttggaataattctattttacctccctcattttttggccgcgccttatattccctccctcctctttggcagtgccttatatatgactcaataagtctatattgtgcccctcatgtttcgtgccaggccggcccactatgccaaggcagcggcctagacatggcccaactgtcgggctgggctggtgtcacgcccagaaatttagcccaaatttccagactattttgtgtattaaatccctgtctaggaccagccagggtacacaaaacgacaagtaatatacagttccaaacgtaaataaagcgtaaaatacttacaaaagaggcacttagtcctcgcaccgaaacgaaagcagcagcagcggaaaaaggcgatcctagcggggcttcagctccactccacaggcaaaactcaactggggtctgagccttggtcttctaacttcgtctttagcttagaagcactacacttctgaatagggggaataatagcaaggctgagtacaaccaccgtactcagcaagccacaccaacgatgcagatgtgcaaggggatacaaggatggtttgtggctatttgcataaaggcggttgtaaaacattttattgagcaaaacagtaaaactgttgagtaattagagtaacattaaatctccactgatcaacgctacaccacgttgaacaggcccaaccaacccacctgaactacagcgtattgggtcgacttattaagtgtgagactaatcacggtgaatctggtcgaccgcccataaccgcgggcacggctattcgaatagctttactctgatcagaggtgtacaactgtacccacaagacacagccccacgacacatttccgtgcgccgacatgccaccacgacataccggaaagaggccgtgacaggacccttcgcataaccccctctaaccaagcacaccacacctcaggtttcaccccccgtccccagcgggcaacgggcagtcccctctcgtgcctaggtgaatccggaagcgacagaggccgtcgcagggcccgccccgctctatcacgcccacccttgcctggatgcgtcggctagaggaaagctacactacaagcccagccgttgcccacgctggcttgtggtaagtacgataagttcttccagggcatcccgcgaatcggtccttaactgccatgggtgcgaccagcaaaaccatgcacccacagcccaccattcagtcgcattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcatcaaagtaacacaagctaggcgatttattacccatggttgataaaggacagatatcaagtaaacatggcacaagcgagcagataggtaaaaccctgaccccatgtaattagcaaaacatgcatatttatttgtaaacggtaaaacatttataaattgggatcaatatgctcaaggggaatgtgtgacttgccttgcttcttcaaacaatcttccgaactcttatccttgcgaccgtgatcttctgaaacgacggattctacacgcaggcacgcaaaacgaggaaaaactctaataaaaaccaaggaaacagaacataaaaagtaaacaaacatgtagagctcaattttagatgaattttgcaatttgaatggcccaatttggagttcgaatgaattagatatgaattttagaagttttgagccactaaatgaatttctataattattaatgatttattgcgcatttattaaatattttcacaaaggaaaaggactgccgctgacgtcagcaagagagtgggccggcgccgacaggcggggcccgcatgtcagcgagacgaggtggcggtccaccgtggaccgggaccacaaggacggtccaccgccggtccacgggttggacggcccagatcggccaaggccgatcggacggctggggacggccgggcggcgcgcagacggccagtcaaccggcggcggcggcggtgcaacgcggcgctggcacgggaggcggctggcgaagaggaaaaggaggagggaggcggcccaccgagaggcgcggcgacggagggagcggccgcggagggaggcggcggcgctccacggggcgaagacgacggtggcgattcggcggtctccaacgaaggtggaggagcggccggggtacgggggagcgcggctaacgcagtagaggcggtggtgtggcgcgaggtggcaaggaacagcggtaagaggcggccgaaggcggcaaacgcggcgatgtcctcggcttcgcggtggagatggtgttgctgcggtggaacgggaaaacgaagcagaggccggggtgctacgcgatgcggcgaagccgacggtggcggtggcgtggcttggtggtggctagggcggcggtggcgcgctaccggagtcggcaaagtggcggtggagctcgggttcacggtggaatcggtgcccgggtggtttattgcggaagcggagcggtggatgggatgcggcaaagcgcggcgaggccggcgatgcaagcggcgcggcacggggacggcggtagcggcggcagcgcccggctggagtccgccgacgaacggcggcgcttgggctcacggggaggagggggttccgggcatgggggagcttgggagagaggggaaaacggaggaggggagcacgagggtgctttatatagggctcggggatgaagatcgtggccgggagaggcgggatcggccggtgacgtggggaggtgaagtggagctcgtggggaggtcaaaccggcgccgttttcttgcggggtgagtgggggaaaaggtggaggacgtggagggggtcgtgtccacgtggttagatgcgagctcgggtgcgggagggcgctggattttgcggcgacatgggcggaaatggcggctggggttggctggcgagaggtaggaggaggagctgacaggtgggaccgtcggccggatggagagagaggagggaaaccgggggacataaagtagactttcgcaaggcgcgggccggccgagagagagagaggaggcgcgcggcccgcgggagaggaggggaaggcttgggccaagcccaaaagggaaggaaggagaattaaatttgttttctttttatttaattgtttaaatgatctttgtgactttaaaattatttcttgagctccgaaaatttgcggaaaaatccggagagtattttagggcacaaagaatattacaaaatattctcagccaatgatttttaaaggaaattttaatttcctctataatttcacttgattaaattgatttaacttttaatataatttcttgaaatgcattattaattgatttttaatcccaaacgaaaatcggggcgttacagctgggccggcacgggctgacaccagtcggggcttgggccttttggccatctatacacatagaagattttggttactcgaattgatagtgaaacaagttttcagggtgtataaccgttttgacgggccagaaaatagatattatttagatatatgtttaaacattttcgtcaattttgatgactttcttattaggcatattgtgttaattttgatgattttcttattaaacatattgctagagagaaaaactttagggcaaatgatttggctcatgttaaaaaaaagagtgtcccggtgtttcaaaagtttggacgaaattgatgaagtttcagatgcagggtggtttgaccggcgcaccgaggcctgtttcactggagaagccgacggtctggtatgaggccccaaagttattagtctctctttgcataccacaattcaaagtatgcaatagaattttaatggacactataactaccaaatttactcaatatctatgcaacatagtgctgataacgcataacatgtgcacgagtatgtttgtcttgtgtatcatgatcctgataggcaaaccaattttgtataaggaagttttaattacccgatatagatacaacaataaacttgtcttgtaaatacacattgggtgcaacagagtgaggatagtaaaattcttatatcttatgcagtcaaatggagaaaataaatactaataatataaaattaataaattatggtatcaaaagataccacttaaatatatttcaaaatttaaaagttcatttacgatcatactattaaataatattaatacttctatctgtgttcttcccagcactccttttccactcgcatgctttccgaactactaaatgataaacgatgagttttttgaaaaaaaaatatatagaaaagttggtataaaaatcatactaatttattttttttaagtattttagctaatacttaattaattatacgttgatatgtcgtttcgtttgtgtgtaagagaaggggttctcaacccttcaaaataacataacctagatttgagttaataaaatcgatgtattttataaaagctcttttattagtttgcaagtgtcatgtttattgcaaagatataaaacaatattttgctagtttataaaagtttataatagagtgggtcttacatattataaaagtattctttatagtagtctttaggctctgctacctaacatatggatcatttataagaaataaacaatattattgtggatgtgtatgtagatacaggacttatttagtttattgctactattaagattaccatattttagcattgtcaaattttagcaaacacatttatcatattctaccaaaacttggtaattgttgtcgattgacaaacaaatctgctgaagggcaagttatcacttaactatgtgggatgtatattgatttattaaaaacaaaa

SEQ ID NO: 51538 - DNA, 9681 bp, Oryza sativa
ttttggcccaactagtgggtcacgggctctaaaggttcagtcctaggttgtttattggaccttcatgggtggtaggtctgtttagagcccaactggctaagtgatctcggcgtgcatttgaccggtcggtgatgtgttctgcttctgccatccatcatccatccatgatccacgatctgtctgacacgatttctacgtccctctatttcagcctgaccggtagccatgtacactttaacactataccgcaatgtaacatgagcatgactgccatgacataacaaatgtgccagtaaatcaacgaggggtgaagtttgcacttcctttgatgcatcatgtatattagtgtgtttatcatatcaccaggttagccatcagcattttcgacctttctaggtggttcctaactacatatatgcatgatgcataaacacaacatatactatgttagtttataaaagtttaagtgctatccatagcaataggagtgggtattaagtaccttatagcctacttatatattataaacgtagtctttaggctatgctacccaacatatggactactcacaatcataagaaataaacaatattattgtggatgtgtatgtagatatagggcttgtttagtttgttgctactatcaacattaccagattttgcattatcaaattttagcaacaacacatttatcatattgtaccaaaacttgtaagtgttatcgattgacaaacacatctgctaaagggcaagttgttacttaattatgtggaaatgtaaagtggaatgtatattgatttcttaaaaaaaatagatgccctgttacatactacttaggttctatttatagttgtaaaaccctatgtttgcaactctaggtttctccttactcgggaattgacttaatcgcccttatgacaaggatatttacaagggctacaataatcttttggcccaactagtgggtccatgggctcttaaggtccagtcctagattgattattgggccttcctgcgtggtaggtctgtttagagcccaattggctttgtcatgctgcttcacctcctgttagtgaagggtcttcgcttcgccgcttggtaggtggttcgccacttggtactcgccttcgccgcttgcaagtgcttcgcctcgtaactaagtggttgtttcggcacgttcggttgaaagtcctcatggtatgcctccaacaacaatgttgtcaatttgtcaaaattttggtattgactaatttggaaatattgattttggtagtaatgtgaccacccccaaagtgaacaaactcgtattcaccagtgtattgctggagaaataaaaaaaaggaaaattgtacacttacatcgtttttgttgatgtcgaaaatgctcttgcacttagaagcccagtcaacaattaagagcaattcatgcgcatcagcgatgaacacaactaggtccgcacccgatggggcatccggtttatggccatgagtaatgaggtgttcgggaaggatgaatcgacgaaggagatagcttcgtctttgcggatgatcagtggctcaatcgattggaaaacaacactgctatacacacgaagaaactattacgaagtgcgtatgaaaagatccctacgtacgacacttcggggacacagaacgctaaaagcccatgaaaagtcacagccccatagcccactctatcaataagcagtctggattcttctagtacagggaaaaacagatcccctatctcagattgacagatttagtacccctcttactctttcagtgcttggcttgagcggagatgcagagagcaaggagagaatcaactcaatcaaacatatgagctacaagaatatcgattgcactagcagccgacgcggaggacgctcacctacggccacagcccacaatacgagcagtgagctataggtagctggttggcttcatgcacaggtacggatctacaaaactaaccacttatgctgcaaattaaggataacaattcgttgtgtaggagtcaatagtgcactgctattagcatgcagtaatttcctggtatgatttgaacacgatttactcatctggagtttggacagatgttgcctgtggtagtatggtagatcttctccagtatatatagatttgcagaaaataaaaatatacctcttattcttttggtttgcatcatatatgctacttcaggctgaattcttttaactaaattagaatccatacgtagtaccaaacttcaaagcttccatgcttctatgcacataaattcttctatgcttcttcagatttcgtagaatagaacagtagaagaggacatcaaaggcttcttttctacctgtaatatttccagctataagaacgaaatctaacatacacaataaacatcttttcttgtgaaattggtttactatgaaattaatgaaaccaacacgacgagttaattgaattgccgacaatgaaagggttcttaatgtgcatttttagtcctaaaatgcaatttcagtttatgaaggttgaagcatcaaggaatgtgcaatgcatttgatctacggcataagaaatactcaatctagatggcaaaacatagacagggacatacctggtcaggatgctcatcaagggatacttggagattgagtttttttttttttttttgttgaaccttacagatcgaattctgttacccaaagattgtaaaagataaggagaggaggttagctttggagggaatcactggaaaatggcgggaccacgtcacgacgttctgcacatgggcctttattagttatgggcttaaggtctaatgagaagattacaacatgtaggctaaagaagcagcccatggtggctgttcgaacatgttccgtaacaaaattattcgtacgcatagagtttttcattggaaaacacctagaggtcttccagcttgctccacaaagtgatgggctagccggtctgggttcgaagctcacttgttctatttatttgatattaggtcattcactaatattagtttttttcatggcggcgacggcggcccaaccgttggcagagacaaccgcgctgagatctgtgcaggcggtgaccgcacgcgctgcgtcgtttttttagagagaggagcggagttgggaatggggaagaggactttggtgctttcgctctgggctccgcaacgatggtcgtttcttcagcctacggcccagataagttggccggagtaacggctaggagaagtgtcgagaagttgaattttggcaagaaattcagaaccttctgaacattgaaaataaactgcattccaaagacgagcacaacatatatcaacaccgaaacacatgcaacgatgacttcccagccaaacattgtattttcacagctaagtaatctcggcgtgcatttgaccggtcggtgatgtgttctgcttctgccatccatcatccatccatgatccacgatctttctgacacgatttctacgtccctcgatttcagcctgatcagtagccatgtacactttaacactataccgcaatgtaacatgagcatgactgccatgacataacaaatgtgccagtaaatcaacgaggggtaaagtttgcactttctttgatgcatcatgtatattagtgtgtttatcatatcaccaggttagccatcagcattttcgacctttctaggtggtgtctaactgcatatatgcatgatgcatacacacagcataaaacggagccattgcatgatactggtatcgatcaatatgctaaattgccaatatgccaaattgccaatatagagttacattaaatggaccgcaaaagctgtgcagtataattgctcaattaatccttttttccaggatcattgatcaatttaattttatgtatggctatgtaacatgaaattaagaagcacgactttaggcgcgcttcgcggcgccctgccattcattaaagagttatgtagcttacagatgattataggatagcattgaatagtactcaaagaaaagcaaataatatgactatgcaagagctgctgagagcatctaaagcaaagcatacttctgaccagtttgagtaatattaagtacaaagatagtcatgcatggaagtcaatcgatagattttataatcactttatagtacatgtcggtaagaagtgtcaacattatcacttaaactatatatagaaaaaaagagtaaacaaaaaatgaactcccggctttggtttcttcctcttacccattaatttagaaatggaaaaactaatatcaaacaaaatagaaagatgagataataatttgtgcagcaagttctattgtcagtttgtttgttctatatttggaaccggcccattgggaggaagcctactcggtgcagcagcggtgggagaacatggcaaacacgcccgacattctgaagaagggacttatatccctcaccgtgttagttgtctgggagatctggaaagagaggaatcggaggatctttgaccataaagagatggcaacgagctccctgctaacgaaaatcaaagaggaggttagcctttgggctctggcaggggccaaacgtttacgtgagttcatcccgcaccctgtatagtgtatattttacgtgtaacaccttttctctctttacccttaggggttgtattttctcctgctttattcaatgaaaaggcactatcttgtgttgttttccgttcaaaaaaaagtttgtttattcttgtctttggtaactaagcggtgataccgctgtatttaaagaacatgcttaagagaaacttaagattagtggcaattctcacatttccaaatattgtgtataaaataatacatcttgaactgcaatgcagctgcttagcacattataacatgagaaagcagagccacaaggttgagaaacgctcctggaattttgacaaactttagcaccttctatggtagtagccaatccattttacatgaacagaacaaaaggagtcatcagatttgatattcccatttataatcagattgcacttatttctctctcaaaaaaaaaggattccactgtctattaacaaccatttcacactaccaattagagtagaaggcaaaccggaaaggaagataaatattagtaatttttatccttttttaacactgaaacacaactgtattatagatccaaatctggtaatatgctttttcattagtcaatgaggatgataattttaacagagctagcttgatacaaagacatgactcaggaaaagagtaagttgcatctcctaggcaaggtggtgggtgctcaacctcatggcacactaatggcacaacctcaaactgacctgaaatctaaagtggacatgaaccttcaaattttgcattgattcacttgggtgctacatagaggacaccaaaaaacttcaaagctctgtcctgaccagggtgctaccatgatagaaattagttggtgatgccagcatgttgtcggctagttctaaaatacatattgtgggcagttttctccacatatatttagtcaatctagcctcactggctcacagctccaaagtatattagtttgcccaccacagcttctgtggctcctagcagtcacttccttttatgtaattaacacataacagatgaagcttcagcgcataaaaactcagaaattttcttttcaaataagcatttagttgattcactttctgctgatatcatccgattactgtaccaaaatgtagaatgcctcatagcactggtgaatcctggtgtaatatggatgcaaaatcatatcattagagctagcaatttgagattatgtctgagatggtggcgagcaatcagaaccagggtaatatggatgaaaaatcctatcattagatgtagtaatttgagatagtgactgagatggttggcaagcaatcagaaccagggataccatggcaagtataactgacaaagacgttactcacatgagaaaatagagcgccatcgacctcaagcgcttgaggtgccgttgccaaaggcacggctgcgtatgatgtcttggggaaagtagagtgtgtgcacccagtatcagagctaggcgccgccacctcagatctatgctttgctgcctcgctgcgctgggacagcagaacgacgacctcgctaagccaaaccgccggttccctccgaatcaagtgctagcaggccagttcaagcgatacgccgatacgctgtctcttgaacgacgacctcaccatcttccatcgcgccatcgccagcaacgaagggacaagagaacggtgggggtcgatggcagcgtgaggaatgaggatgtaaggggagaaagggagctggcgcgacctaggaaggaggaaggcggtcgcgatgggctagcgtttcccaaggggatgggaacagagagagagagagaggagaagggcggcggcgggctagggtttgctcaggctccttgcgaagctgcgatcagggttcactctatcggttgaggcatttgtatcgggggtcaccgaaatcccgaaatttcggtccaaaattttctaaaattttaaccaaaatttagttgaatttgaccaatattacccaatatcatgaaaaaattgaaaaattgaaaattttcggccaaaataatatcgaatctggggtgaccgaaaatttcggtctgaaatttccaacactggttgcgattgaagagacaaacagaagggtgtgggtgcggggaaatcgtgtgctgctgagctaacgatcccgacggtcagatatcaatcggatggccaagccagacgattaaagagagcgctccaaattcaccagccttccagcgcgggcggaccgacatgtggacccacatgaaagtatggcccagcgaacagagaaagaacggtaaattttttttgtgtaaaaatcccacgcgccatggcaaagccaccgtgcggggcgatgtggatagcttggggagcgagcacgtcgtgctgaaatccctccgaacgccctggtccgagcagatcgcccttacttttagggccccatcgtttcgctttttttctaataagccaaaacggcttattagaaaataaaaataaatttgtaggtaaaacttttatatatgtgttcttggtgacttaaaagtcaatactgaaatagaaactacgttgaaaatatctcaaaatcaatctcataattaagtttgaaaatttaaaatttagcttttttttctgcttaatgggcaatccgatgggagccttaattaccccgactagacccctatcaaggatccaaagaacttttaccaataaaggagctcgagcaccagccgctggtgtcaccattctcctcttgcaatttcaccaccaccgccacggcctctgcctctcgctctctctctctaggcggcgcaaatggcagcctgcgtcgataagtggccggcggcgtacccgtgccgcctgccggataagttctactgcgccttgccggactgcaccaccacggaccgtccggtggcgccggcgccggcggctagcgggagcagcggcgactacgtgtgggacgcgctgcgcgccgaggcgcaggacgacgcggacgacgagccgctcctccgcaagttctaccacgacctcgtcctgtcgcggccgtcgctggagtccgcgctcgcctcgctgctggcggccaagctctgcatccccggcgcgctgccgcaggaccagctccgggacctcctcgccggcgcgctcgccgcgcacccggaggccgggcgcgccgcgcgcgccgacctcgccgcggcgcgcgaccgcgacccggcctgcgccaagatggtccactgcttcctctactacaggggcttactggcactgcaggcccaccgcgcggcgcacgcgctctggtccgacaaccgcagggcgccggccctccttctccagagccgtgcctccgaggtgttcggcgtcgacatccaccccggggcgcgcattggcggcggcatcctgctcgaccacgccacgggcgtcgtcatcggcgagacggccgtcgtcggctacggcgtgtccatcctgcacgccgtgacgctgggcggcacggggaaggagtccggcgaccggcaccccaaggtcggggacggtgtgctgatcggcgccggggcgagcgtgctcggcaatgtgcacattggcgacggagcggagatcggagccggtgcaatcgtgctacgggacgtggcggacggaaccacggccaagccgatcatcggcaagaaggcggagccgcaacgagagcttcccggggtaaccatggagcagagatggtcggattgaatggtttgagtagcgtgcagtgtgaacgcgaactggttagtacaatagagtttccctccaaaagttattttctggtgatgactactcttgtaaacctatatacggagtactctctagagattagacaagtactcaattagcattgagccatttcaaatctttttttctttttttttctttttctaaggaataacgaaaaacgtttctgatcatctgttgcctccttgtaagtatagtaggagttcatcctctcatatgtgtttttttagagaaggatattttttacctggcctttatatccaaccggatatatgcagccattttaattaggaatttagcctattgaatagggaatttagtcttatcctcttgtatgttcttctgctgaagatcatagtatttttcttcttacaatgtgaagtacggatgctttcttaaatacttgagtagtacagattgatagtacataccgagtactacagtttctgattctgaccaagtataatggtttgacgaaaccctacgtgaaggtggtcaactagccagtagatgagtagtggataagtttattaacttgactagagcacaaagtatagtagcccaaacgaaaacatgaccactaaactgtgaacgagttgcataaatatagccgcagagaacacttccttcaagacttcgtccaaacaaatcggctaaatctacagcctttttcgtgtttacatcgcagacgcaaataattgacgatattggtatcctgcgaactgaaggacgtcaggatagatacaagtggatgcgaactgtggttacccgacgaaagggacttttgtgataagctaactcgatgaggctctctgtcagcaaagtcaactttgatatccagtaatctattgctggcggaaactgcccttgtgtccgtgttctccaatatgaagtcccaaggaatcgaatatcgagtgcttctaccatgattttccgtgcttaattttgatcatctgtcttaattaaaaaaattaaaaaaaagattaaaaacataagtcacaggtactattcatatttcatcatctcataataataaaaatactaattataaaatatttttaaataagatggacgactaaagttagatgaaaaactcattgttgcttaaaataagacagagggagtaagatattgcttgcggaaactgcccttgtatctgggctcaccaatataaagtcacaaggaatcaaatgcctccagataacggtacagtccactataaacttatatagctcatattagttaatactccgaccgcccctaaatataagggattttggttggatattatacatcctagtacaataaatctggacagggattttg

SEQ ID NO: 51539 - DNA, 2819 bp, Oryza sativa
gggacggagggagtatgtatagtaaatgagctataaggttatctttatttttcttctcttctttatattcctcatctatgtatttaatgtatttatcttgaagtgtgtgaatagctaacttttgcataaaaatcgaccgcttcattttttagattctctcttctttacataagtggtttataacctactaatagtattaatcttgttctaacatgtaaaatgtaacctctacacaatcttaaaaaaaatggaaagagaaagtaaaatatatagtgtgagagtgagttagttaaagaagattttggagtttgtgtgctaattaagcggtaacatattatacaagttgccttttattgatttagagcaggtttaataatgtcgtaaacttgctaaccgtaaaacatccacatcatctatagcacattagtatagattgctcatataacaatggtctttattactatcatttacggtaacaactgatatattttttaattgatacatgtcccactaattactgcattcttcactattgttccaagcatgaaccaatctccaccaggtttacttctctttcttcattgtacagtgtgctgcagctgggtgataattgtatcgtcggctcgcgttctctctctaccattttctcctccagcacagcagtggggctgacttggttacgctatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaattaccaatctagagcggttttatcctacgtggcatacgcgtggcagtccagtcagcattttttttaaaaaatggtggggtccacctgtcatgcctccacttcacctcttcctaatatctctctctctcttgcgcgcgggcgcaagtgcgcacggcggcgtggagccgcgaacgatggcggcgtacatgggcgggtggtgggcggcagccgcgaggcaaggaggtagcattgcccgcagtagggatggcgacggggagaacgggccgagcgcggccgtcgaggtggaggctgcggcggaggggggcagcgaggaggtggctcgatgatgaacctgaggagaaggacacctcctgcatgacgaccggcgatggaggcggtgagttcgggcggtcggtggtggaggcggaggcagagcgtgtcatttgcgccaactgcccgcatcgtccttccagatccgcgcggcctccgcccccgtccgctaatgtccggtctcggggaggatggaagggaggtggcgccatcgtgagatacaaccacggaggaggcggggacgacgtcaacgtgagaggcggagacagcagtgccgcgatgaaggtgggagagcggaggaggacgaggaggaaacgatagcgagagcgaggaggagacggcggcggtgacaaggagaaggggcaacgatggaatttcacggtcgcacggaggaagaattggactacggcgtcaaataaaaaaccgattcaggattgaactacaacgtcaaacaaaaaaataatatggagggagtaattgacaacagagaagacattactcacgtgagaaaatagagcgccattgacctcaagcgcttgaggtgccgttgccaaaggcacggttgcgtacgatgtcttggggaaagtggagtgcgtgcgcccagtatcagagcttggcgccaccacctcagatctatgcttcgctgcctcgctgcactggaacaacagaacgacaacctcgctaagccaaactgccggttccctccgaatcaagtgctagcaggccagttcaagcgatatgccgatacgttgtctcctgtctacagtctccacgcagcccctcaccatctttcatcgcgccaacgccagcaacgaagggacaagagaggaatgaggatggtcgatggcagcatgaggaatgaggatgcaaggggagaaagggagctagcgtgacctaggaaggaggaagacggttatgatgggctagcgtttcccaaggggatgggaagggagagagagaggagaagggcggcggtaggctagggtttgcccgagctccttgtgaagttgagattggagagagagagagaggagggtgtgggtgcggggatatcgtgtgctactgagctaacgatcccgacgatcggatatcaatcggatggccaagccaggcgattgaagagagcgctccaaattcaccagccttccagcgcgggcggaccgacatgtggacccacgagaaagtatggcccagcgaacagagaaagaacggtatttttttttgcgtaaaaatcccatgcgccatggcaaagccacgtcgtgctgaaatccctccgaacgccatggtgcaagcagatcgcccttacttttaattaccccgactagacattttgcgcgcgttgcgcgccctatcaagggtccaatgaacttttaccaataagaatattgtgagaataaaattaaagatctataatctctctgatagagacaaaaatcatgaatttctatggtaaatagagtgagcatcgtgttgtagttatgctaacaaatttttttcctaaaacacagagttggtatatctagacaaaattaacatgaacaccatataacagcttaaaccatcacgtaggctaaatataaatcacatagtgcatagcataattcatcaattcagcttgttttcttcacatcctattgaagagggtataagtcatttaata

SEQ ID NO: 51540 - DNA, 7260 bp, Oryza sativa
tacaagttcagtgtcttcattatcacaaaactacatgttttagcattgttaaaacctgtagttttgtgataatgaagacactaaacatgtagttttgtgataaaagaagacactaaatgtgtagttatgggataaacgaatacactaaatctatagttttatgaaacaagtttttaaatatgtagttttgtgatagattatacaaagtacctgtagttctgtagttttgtgataaaagtagacactaaatatgtagttttgtgaagcaagctcttaaatctgtagttttgtgataaattgtgcaaaatacctgtagttttgtgaaatttactcaaaaatatatctcacgaatttaagctagataacatttctcaagtacctgaagaccatgtgtacaataaatgatttattcatgtgcattagatatgctcagcagcagccagcaagctatacaaagaaaatatcacattgttcatacttctttgaatggcataactacgatatttgtaacagatagcagatgtttcactcactaaatcaacagtacatagaaaaaaaaaacatagctaactaactacttgaaacaactgtttccgaaggaaaactacaactaagcactgacatgatagctactaaacacaaaaggcaaaaactcaagttaaaatcatggaatacttatcacacatccataatgtattttttaatagtgccactgctaatttccttcctatttcattcgacctgagaactcaataaactaatgctgaaatagttaaccttccacaaatcaggcattcaaattcatgcaaaatggaaattgctcaagacaaatgatggaaactgctatgttattttacgaatatccagacaacgtgttgcagtgagacattaaaatgctatgcagattcagggttgccataattaacttcttctccctggtaagacctcgtcaagcaaaagccaatcaacatgagctgcatctgaattcaatcaacaatgttagaagcagttgtgttcgcctaatttttctgaagatcaatcttgttatctgttagagagtaacaatagacccccactaatttaagtagcagttaagaacaaaaataataaattcagagagaaatgacaactcccatctaactctgcttaccttgcagaagcacaatccaattattcattgaatcctaaacctacagcaggacactactattaatatgtagtttaaatcattagtactttgttcactggaaattatgcaaaatcatagatggattattgatatttattgaactaaaagcatgatacataacattcttgaacttgggtccacattcaacatgaattgctgtcacagaaaaaggagaaaaaacagagtatgcattctgatgtggctgccttgccttgccatctaatgtattctgatctggctaccttgcattgcgcctgacaccaatcaatggaaaccatgacactaagacagagagggccatctcttaccgacaagaaggaaccatatcggggattgcaatttctctgttcatctcgaattgcaacggaggagttgcaggtgaatatggcagcgactgtgccatttccgtggtccatccaagatctcatcgaacctagtatttgtgcttctacacctgccatccctaatcggcggaggagatagagctcagctgctcaggaggcatcagcaacggtgaggaggcagccgacagggggacagacgccagcgatggtccactgatccggcgaagcggccgaccgctcgaggggacgtaatgtcggcgcggggcttgctggtggtgacggagctgagcgtggtgctcggcaccgtggtcacgctccttggacccgtcaaccttccctccaccagcgggcggcgctcagccagacattggtgagccgctcgagttagaggcgggcctcttcgtcacgggcgacagcgccggtgcgaacatctctagccctagccatctttgacgaccccctccaccatcggcctcgctgtggaacgtcttttctagatctggacaccatgtctcctcccgatctgctcttcctcgacctcgcggcttcggaccggtgccatcgtcgtcacctccaccgccgtcaacctgggggaccacgccggcactccatctccgactcctcgccggcgatcgatctcctgacagaaggggatgtgcaggccggctgcaagagcggaagagaggcggctagggtttgggagggtggggtgaggggtgggccccgcccgccaggtggtagggttgttcgtttttacaaaaaaggccactcacttgttgttatttaaagtgcggcctatttttcgttttttttctcttcttagcataagatatttcaggtcttggagggccttaaagtaagaatacagaacacataaacgaagacaagggacttatcacagattatcaataatagcaagggctttttttgtaaaacgaccagagtcaacgcgggcctcccgctcgctcgtgaaattcggctgcctggagtttcggggccgacgtggatagcacgggaaacggccacgcctatgcaaaacgctatggaggcgccaatccagggcaggtttaaatttaaccgctgtctctaactctatcatattaaatatcacgatcaaggacaaggtcacaagggccatcaagattctaaaattttatacacgtatactagggcctatttgaaggaaatctacagcaattagttgcagtcttgtatttctagacaaactttatgtcaaaaatcatttcaagaccggaagcacaccagaaataaaactagtgatcattggatcagacacacagtttgccaactacaaacagctatcctcaccacaacaatcatggagattcactctaatgtagacatgtattgcagttcactgctgaaatgaattgagacaaaaatatcaatgtatcatgaagcactatattcccccatagaacatcatacccccccaaaaaataccatgtgcattcaatgagaacatacctggaaagctcaaagcaaggctagtgcaacaaccagctattccagcattaacaactgcaaatgaagaattcataattagtgctatatattcaactaccaagatgttacatctaaaaaactagcacgatgttaacagaaaatagggaactaaaacaatgcacatactgtcatctttgccacgcagccttctcaacaggcacacaactagacaatggacgccagagagaactgcaaaactttgatccgataaatttatgttatgagcaaggtgtctggatgattttcatgtacagaagaactgaattcacattatcaatagttaaccttggcagaggaccctgggtgctgaacaagcccttaaatcccctcttagtgaacaaaccttgtcctgaataaagaatccagtacagaacataaagattttacacgaggaaaataactagttgctacaaatggccttaactaattcacatgtctggtacttaacaagattaatagcatcttcattgacataaatatcaaaattcagatgaaggaaccaaagattcctcacaagatgtgctattatctacacattctagatttattacaaattcttacagccatactaggtgagtttgaggagaaggggattgagaagattgggaagatacgcaaaacgaggtgagccattaccgtatgattaattgagtattaactattttaaatttaaaaaatggattaatctgattttttaaagcaactttcctatagaaaatttttgcaaaaaacgcaccgtttagtagtttgggaagcgtgcgcgcggaaaacaaaacaaactatctctctttctccagctgccgaacacagcgtaagaataggttaggaatgaacttcctttgcatgacatggaaaggaacaaaatctaaaactagaaaaagttcgtgattacaacaacatagacaacatgggcagcaccggaaacacataaacactgaaacacaagggggcaacggagaaattgggataataccatatccaatggtagacaccaaatgaactgttggtagtggatgcatgagtgttgctgcactctgaagcacggtagacaaatcatgatgactaaaagcaactgcgcacattgaaagttttattagcatgcaatttgtttattacccagttagaagagatgcaaatagaaagattgcgttgttatctttttaaaatgaagcgtagagaaaaaaatcacagtaactaaagaatgctgggcattcataacccattctgtgcagttacaaaacagaaggtaggttattggtcatagtctctgccatcttcgtaggaagaaataccagtacgaacaaaaggtacattattgtgaagaacaaaaacaacagaggccacagaggtggtgcatcttttgtagctatacaattacttgaaggatggtgcaacaagaaatcaagcttacagaaaagggtaggtcttacttaggcctaacagtctagcagccaggtatttacttgctgtcactgtacaatatatggacatagcaaatagagcataattaggcataattactgaaacaggggataaaaacatttaaacataaaagggggaaaggtctatacatccatggtggcaaaacctgggaggtaattagaaattctcacacggtacaggggaagtattaggtggatttgtagtgcaattgataaagtaggcaacccggctgttcagggggtgaaatggattttttttttctgtgacagtctaaaactgacgctctgtatagattgttcatggtgtaaagtaataactattctctactaacgagcatgtccaaattgatgatgggttagaaataagaaatattacactgcccagcacaaacaataagctatcattgatgatgagttataatgcaggcaagaatagccaaaatatataccttcttacatagcttgaacacgactttgtccagaaggcttcactaactcctccctgtcaatcatcatcctaactctctttgcatcctcaaccattccggcctttgcatatatatttgacatagtcacaaaatttccagggttatctggctccaattgaaccagtttctcaaaagcgatctgtgcatgatccacatcatggtgcatcctacttccagataacaaagcaccccatacaactgcatttggtctgattggcatctgatcaataaatccagcagcctctctgaacctcccagctcgtgaaagcaaatccacaatacaagcacactgctccatagtagggatgagggcagaattttccacaaaccgctcaaaaagcgcaagaccttcatcaaccaagccacagtggcagcatgccatgagcagagttgtgaatgtcactgaatctggctgcatcccacaacgcaacattgcatccacaagttcaagtgccctctctccatgcccattctttgcgaaagcacctatcatcacattccatgacacaacatccttccgttcaatctcgaagaacacatgttctgcattgtcgacacatccaacacgtgaatacatgttcatcaacgcattccacagaattgcgtttgaaccactatcaccatggtttctcaccatgtgcccatggacctgtcttccagactccaaatcacaagcccccagcacagcaaccgcggtacgggcattccctcgaacacctcttgcgcgcatctcccggaagcaatcccacgcctcgccattcatcccggcaccagcgaaccccccaatcatcgcgttccaggacaccacgtcctcgccgtccatacgatcaaagatcctcttggccgcgctcaccctcccacacatcgcatacagcgcgacgagcgccgggccggccgaggcgtagaaggccagcagtggcgcggtctttaccccgtaggcgtgcgcggcgcgagcggggagggaggcggatgcgcggcggcagcaggagacgacgcaggagaggagctcggcgtcggggcgggcgaccgcggcggcggagaagagggagagggcctcccgggggcggccgtggcgggagagcgcggaaaggatggcggtgtaggatccggtggaagggtgggggatgagggagaaggcgcggagcgcgcaggggaggaggccggagagggagtaggcggagacgagggcgttggaggccgggagcgaggaggggaggacccccagcttgagagcggcggcgtgtagggtggagacggccggggcggcggcgccgggggtggtggcggcggagacgagtaggcgagggagggagagagggtcgacgggaagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatcaatacatgaaaattcgtatacgtaggaatcacaaattgaaatcggttcctatcaaagaaaaaaaggaatcaacgattgaaattttcatattggtgtagttttgcattgtatcggatagcggggttgatgcgacaactgcacggaaatatattggttgtattatagtaatgttagtttcattttaaattaaaaaaatgttattgataattaagacttcaatcctaaccgatgaaatgggatgcaatatccttttctcgaatgcacgtgcacgtagtcgtaccaactctatcactataaacacattcaaaaatttaggttagaagtcaccgcaggtactacttaccacgaaaaaaataggctagaagatatacccgtctaataaaataatcactggccaccgcaaagcattgtttaccgagaaagacatgaccaatttattattgcgccatttcccaaaaactagtacagaaatcaccacacattaccatatgccgaattcatatcctctactcagcattatgccaaagttatgttgagtagaggagactcaaacattgtcagacatgttgcaccataagtaacctagctaattaattgatacttaattcattcgtagaaagtaatccatgatagacacaaagtaatctatgatagacacactacatgtaaagaacacgtaggccaaaatctcatatttctaattaacattttccccatatatatatatatatatatatatata

SEQ ID NO: 51541 - DNA, 12949 bp, Oryza sativa
taggttagaagtcaccgcaggtactacttaccacgaaaaaaataggctagaagatatacccgtctaataaaataatcactggccaccgcaaagcattgtttaccgagaaagacatgaccaatttattattgcgccatttcccaaaaactagtacagaaatcaccacacattaccatatgccgaattcatatcctctactcagcattatgccaaagttatgttgagtagaggagactcaaacattgtcagacatgttgcaccataagtaacctagctaattaattgatacttaattcattcgtagaaagtaatccatgatagacacaaagtaatctatgatagacacactacatgtaaagaacacgtaggccaaaatctcatatttctaattaacattttccccatatatatatatatatatatatatatatatatatatatatatatatatatatatatatatatatatatatatatatatatatatatatatatatatatatatatatatatatatatatatatatatatatatatatatatacatagtcttgtgggtgggtgcgcgcgggtgcccgggctccatttttgtatttgtgtacagcccctgtgcgcgtgagcgtgactcgttttcgtgtgtgtgggtgtgtgtgtatacagcacccccacacagacgcaagcaggtaggtagtgagtgtgtgtgtgtgtgtgtgagattgtgactctagggcgcacgcgtacatacatatatatagataggtatgtacgcatggagtgcgcaataacgttctctgtgagtgggtgtgttgatatgtgtatggtgtgtatatgtatatatatatctatgtatacactctcagagagacctctatatatatatatagtgtatatatatatatatatactatatatatatatactactatatatatatatatatatatatatatatatatatatatatatattataacccggccgggaggaggaaatgaaaaaggagccatgatgagaggaatagacagattacttacatctatctaccctaaagttcaacaaatactttcactcattctttcattcatcactcaatggttcagattatccctgtgaaatccaatgctccagattcaccctccccacaaacgagcgctcccttcccaccccaaccgcgcccaaacctcaccatcacaccgccccgccacgattgacgtcgccgctgaccccagcttctcgtagaacgctaaaccctaacctcccctctctccccaccgctcgaggtcgcgccctcatcgctgctgctcgtcgcccggagcgagcgatgcggtcaccggagatgagcacaaccgctggggcaccacgctttctcgatcggaggccagcaggatggaggaggttgcgggagagacgccgacgccgtcacacgctgttgatccgattccttgctactagatcaggatgcagtcccttttttttcgtaatctgcatgtaatcctagggttggaggaaaggcactgtggagaggagaaagtggagacggggtgccggcgtgccgatgcagacgagtggccaagaataggtaaatagctctgttctattgctagctagcttttttttttacttactatgacaaattgatcgatctccctgttggatttttattaattctgattgaggaatgacgttttgttttgaacttttgtgccgtttgatttgcaagattactttgctagatttagcaattgtataatattcaaaacagaggctttcactatcactaattagagagcagaaacagaaagaatatagagtcagagttggtgtaccctgcaagtctgacgattggattgtacatgaactgcaatttgcatttcatgctactatggcattatgctcagtgaatcttgctgacttcctttattcaggcacaagtaatttgtgtcggatgatcaattctaagcagtgtctatgtgaataccgtttgaacaaggagctgtgtgggtttttaggattcaattctaatgaagccaaagaaaatatcttgaagatatttttcaggttattgttgtcttttgtgtccttcagagatggggattttgtactaatttagtcactatcttgatatacctgtgctgctgctacccataatactaaagtctgcctagataatgattttcaaactgcattgcatgaccagaaatattatcagttaggattagattgttctcaaggttttaatgattgtcacatggatagttctttctactactttcactatgtaggtgcatatctatgggagtaatatatgttccatgtgtgtctgcatcaactaaaatacctgatggatgtacatgttcattaggaaattagagctgcaacaaataaatttcatgatttttgttcccaccatcatagtaaatttcatgtgatatagaggaatagcaagctaacacacgttcttgagattctttaaacaatcaattatttacttgttggtaaatcatgcatctacagttagatttgtggtttccgtgattacattacatcacctgaagtaatcaacagatttgagcattttgtgtatgcaagtagttgaagaatttcaccatgttctgcatgatatgaagtatgaacattatgctagagttactgtagatcctggcatcacagtcccttaggtttggtaaattcaaatttaccatgttactaagacatgtacgataatttacaggaatatgaaattatttttagaccaaatatattacaacaatatatataccgttgtttggttttgagacatttgaacttattttgctaaaatatgtatcttttagcatatgattgtttaattcacattactaaatatcgccgtagcgttagtacgggcatattaccagttccaacaattggccatgttttttcaatggaattttcgttaaccaaatgaaggcatcaaattcctgtgtctggggtagacgtactaggacaacacgaacaggaaaatacgcacagaacatacttcctccatctcaaaatagataaatcaactcttgtacactagaattcattcatgtatatgtatatgtaaaattattttgcttgaccctagtatgaaggtgaaatatatttaattaaatccgatccagagcacaaaatgagaagtgtttttattcataaatttctatttaaaacacacgagagtcacataccctatcgagaaggctgtaccgtctggacctatgattaaccatctggagcgttgtgctgctgttcttattacaaccacgccgaacctcgacgccggtgaacaccgcgaatttctcgtcgaaatcaaagttggacctccaccctttgtacatgaatctgacaatgcagaacctgccggcgccgagagggacgaggtgcggcgtcaccggtgagccgctgggcgacacggggctcaccttccacacattgcgccgcggcggcgaggtcggacgcgcacagctcgttgccgtcggaggagagcgcgaaccagagcttgtgctcgggcgcatactcggcgcggcctctgaacggaagcaaccagtcgccgagcttggtccatgtggcggtggacgtgtcaaaggagtaagtccccgcggcggcggcgacggtgctctgcactgtcatccagatgcatgagccgccgacggccgtgtaggcggtgaggaagtcatcatcatcttggaaaaagttgcggatgctatcaagggcatcatcggcggtgaaggcgaagggcggcgaagggaggaggcgccagtgccagtgcggcgtggcgaaggggtggtttgggtggcgatcgtggacgagaacctcgaagcaagaggagggggattgggaggaggccgggtacctttccatgacgtagatgttgcctccgatggtgagcgacaccgggaaggccttgggtgtgttcatcgggggaaggatggtgacggcgcgcgaggcggcgccgtacagcaccccgctgccgctgtagtcgacggcgaccacgtcgttcttttcgccgcctctgccgctgccgctgccgctgccgagaggcatgaaatccacggaggagggccaactcggaagcccgtatgatgggcaagggtggaagatcatggcggcgcgaggcagctgagcgtcctcgacttccatagcgccgccgcgccgcccttcttcatcctcatcggcggcgagcggacggaacagcgtcgagacgtcgacgcggtgcaggccgtaggacggctgccgccgggcgatgccgtcgagcaccagattcacaaatcgccgggggctgttcattctcgccgccgccgccgccaccgccgccgagagatccgatcccccggatctaatctaaaacgggacgagaaagagcctggatgaaatcgtaaaaggacgaagggaaagtagtactactccccttgccttggtgacggcccaagaggaggccggagagggagtaggcggagacgagggcgttggaggccgggagcgaggagggaggacccccagcttgagggcggcggcgtgtagggtggagacggccggggcggcggcgccgggggtggtggcggcggagacgagtaggcgagggagggagagagggtcgacggggagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatccacacatgaaaattcgtatacgtagggatcacaaattgaaatcggttcctatcaaagaaaaaaaaggtgtagttttgcattgtatcggatagcggggttgatgcgacaactgcatggaaatatattggttatattacagtaatgttagtttcattttaaattaaaaaatgttattgataatcaagacttcaatcctaaccgatgaaatgggatgcaatattcttttctcgaatgcacatacacgtagtcgtaccaactctatcactataaacacattcaaaaatttaggttagaagtcaccgcagatacttcttaccacaaaacttacctcgaattaaggcacctttgaaaaatacctgtctaataaaataatcacaggtcaccacaagcattgtttacccagaaagacatgaccaatttaccatatgcgccatattaaaaaactagtctagaaatcaccacacgttaccatatgccaaattcatatcctctactcagcattatgccaaagttatattgagtagaggagactcaaacattgtcggacatgttgcactataagtagcctagctaattaatttatacttaattcatccgtataaagtaatttatgatagacacactacgtgtaaagaacacgtaggccaaaatcttatatttctaattaacatttttgcatatatatatatatatatatatattaaaatcaaatagctatatcaaccatgcgaactaatgagcaccctcccccccccccttccccgtaatggaacttcaaacaactgccagcaaactctccccagcttgatcattgagaacactcaaccgccatatatcaagcaaaccatatcatatatctagctcagaagatatttggtaatttaacactccttaatattggtttcgattatttgacatattagtccactttcattcatcttagatggttctacatgttatcctcaaaagtatcaattgaagcaacaggacaacgaaaaaagtgttaaattatcatttttttccaagtttggtaggtaaattgttctaaaaaaaatgtttgctaggtaaacattatgttttagagtacaacgcagagcagcatgcgactatgtcctcgctcacaacgtccattttgcaagtagaatcgtatcaatttgacagtgttgtaatttgaactcaagaggattaatttcaaaacaacgtgccaatctccacgtgctcccagcaatgacacacgggtttgtcacgtttcccaaacttagcccatcaaagaaaggaatagaccggaagaaagcccatcacgactcgccttcctccctccgcccgttcgccgcagccaccgaaccaccaccgcctctctctctctctctctctctctcctctctctccggcgaatattccctcccccctcgccttcctctccacgccaaagccggcaaccgcgccgcctccgccgcgcccaacagctcagacgctaccggagtccggcgactcgacgcgacgcggcgcgacgctcctccgccccggcgatgctgcggcgcgggctcctcgtcgtcaatcgcctccgcaatgtccacctccagcgtctcccccggcatcgcacgcactgctcgagcggtcccgcctcggcgccgtcgacctcgacgacgtcctcgtcggcgccgctccccgtggccgcgcctcccccgccccaccacctcgcgccccgcggcggcggcggcggcggggggccccgacgccgcctgaccccgctcctcgccctatccacgctctccctcgtcacggccgcggggacgatctaccacatctccgcgtgggacctggaggggacggtggagaggtccagggcgtccgcggcacgcgtggtggagcggatgcagcacacctgcgcggcggggaaggtgctgtgcaggtcgctcatgtccgtgctgtcgtccgccaaccacgaggtgaggtccgggttcgagctccgcgtcgccgcgctgctcgccgacatcgcggccgccagcgccgcgcgccgcgcggtcatcgtgtcggcggggggcggcgccgtcgtcgactggctgctcgagagcgtcgtgcggcgggccacgcaggcggaggccgcgcgggcgctcgcgcacctgctggccgatccctgggttgcgcctgctgtgctcggtcgaccacgagcggttccctgcctcctccaattcatcttctcttaccagccaaaacgcggcaagaaggtaatgtcctgtcaggtgctactcttgaattatttgctttgcttggctgccgtaattgtagctttaacagaataaattttgcaatcagtttaaattattcgagcatgccaatgtagctggctctaatctactaggtgattgttgttgtaaattctgtccaatctgcaagataaagagagaaaactctgaatgtttatattgaattgttagtttctttctttttagttgagaattaatgatttggtgtagcttgatttgttcttgtgttaggaatttcagtattgatatgctatgttataggaatcagatgttgagatgtgcatcagtacagcctgattataggtggaaaacaaaatttgcatcctcgtgtgctctgaggtttctggcatttttatgttttcatcccatgtctttgtgagcatggaacctttggcccttcaggttttcagattgcaaactcttaatatatgctattgatgttaagataaaagatctcatgggggaatgagttatgttatgcacctgcatgccagttatgcaataatgcagttatgtctaatggattatcaagaccttggagtggtaaatataatttattttccttgatggcttggtgatctcagctctcctataggcaatttctttttttgcttgctggcagtgctttttcttcagcttatctcttctttttttcccctatacatgtagtattatgtttcatgcgcatcttaatctagcaatgtaggtctattaaaccatttagattttccagttctggtttccttggactttaacacaatatgagttgtttgtacctaatataatgccctcctgttaatacagaactcggaatactcttcattcaatgtctcagaccattctaaaggaaggagcatgcttgttgctgcacttatggacatcatcacttccaactgcgataatgcggattattcatcatttcagcctttattgccttcagatgttgatacaagagatattgcggcagccatcgaagtcattgagcaaggggggatgcattttgatgaccatgatgataataacagtgatgatggtgacagtggattaaaaggaatagggattaaggtacttggtgggactactgtcttgggattctctagagaaataaactcattggaggtgggcaactcggatgatggtattgttggagcttcgaatagtagaatattgatgcaagaaactgctactgattctccactagtggagaagctaagttctgctgctgctccaggcctctgggatgatttgcagagggagcatgtagctgtaccttttgctacttgggctcttgctaattgggctattgcatctgatttaaaccgttctcgtattcaagaacttgacagtgatggacatactgtcacaactgcactgaaagcacctgaaagaactgtcaagtggcatggagccatggtggcgcgagctcttttggaagaccagagcttgactttggctccttctgtccctgactggtgctcaagtcttcttttgacagcttctcgggctgctgagaatggtgacatggcattggctcaaatgtcactatcaactttcctattatccatgataaggtgtaatgagtcaaaatttgtgatcagacagaagggtcttcatcttcttcgtagtatcgcaaaaaagatagaaaatgagaatgctcagagcaggatgaaggaatcattagcagtggcactgagtttgctctatgctggtgaagttccgttgtcacttgaagaaactcaaagatggtccggcattcttcttcgttggctctttgataaatctgtttcagaaactacaaatctcacagctattaaaatcctttcatgcattcttgaagactatggaccagcttccgtaccaatttctcagggatggttggctctcgtgctttctgagattcttggagataacaagacacagaatttgaaaggaaccacccagcctcaaccagagagagtgaaggtaagaatcttgttattgtttttaataaatatatatttgaatgcgtgtgccgccaactgttcttagtagttaagttggttgataaatgagttttagataaataaacatgacgataatcagactgaaaatactagaacgtcaagaacttaagatcaccagtataatatagtatgtcacatgttcagatttatgacaagtattaaccatggaggaacaatgttctaaacattccatatataaaatttgctttgttatttggcgactctataaagtgcttcatgccagatgctgtttaggttttttttttttgggagctatcttcttgtctttcgaaacatttctatgaaatacacatgttttgatatttttattttaattgtgttatattgtttgaaacaaaatttgaatatttggttgctactagcctgctacttttcttgtgcagagtttcacattttctatcatctgccattttcagtttagtgctgctctttttggatgttacagtataacttattttgtgttataaagctttagcttaactcctgatagtactcctgatagtactaatttcacaatcttgttcttcctccttttttgtcctgaatcctgatactaaccttttttatggacagaatcaagttgatcaccataatgcttcctctgcgactcagatcttgaatcaattagctactgctgttgtgaaattggcaatagttcaatcacactatgatcctgcttctggtgacaaagtaccccttttcgattttctctctcttgaaccatttgctacagctctgaagaacttgaataaaaagaacccacctaagtttgatgctgctgactcagcatccgctacgctgaagggaataaaagcactggcagagctttgttctgaggatggtgcatgccaaaagagaattgctgatttaggagttctttccctgttgaggcgcatcctccttggtgatgattatgagaaactcgctgcgatcgaagcatatgatgcatcacgaattcgagaagtgcaagacaagaatgtgtctacctctaatgactcctctaatgacactacttctgatccctccagtgtacgggttcctccagcagctcatattcgaaggcatgctggccggctggttaccattctctctcttctacccaattcaaagaaggaaattatttctgatgatgtatggtgcaagtggcttgaggaatgcgcaagtggacgagttccttgcaatgatttaaaattaaaaagttactgcaggttaactttgttaaatgtattctgttctgaggatccaaatacaggaagcacttctgatgaataccctgattcaaaaagtgagtataaaagaaaatgtcctcagtttggagatgctttgttcttgttaaatccagagttgcctcttgaggttcatttggacaacaatggtcatgaaatttcaagaaagaaatttaaggatgactgttgcactgaagaaggtggtgactctgaaactggagatgctccaagcaacagagccaaatatacaccccctttaatggatgtcgtgttcgtccatggtcttcgtggtgggccattcaactcatggcggatagctgatgacaagtcatcaaccaccaaagcaggtctggtggaaagtatagatgaagatgctggcaaagagggaacatgttggccaagagaatggctttcagcagattttcctcaagctcgttttttgacagtcaagtacaaggttagtttggtgctctgatgttctttatgtggggagggttatactggtctcttttaaaacttttgttattctggtaatattcgatgcttccctgctgatggaattattgttgcttttatatgtttggaggtcttactggtttcaaatgatttatgcagaccaatctgacacaatggaccggagccagcttgccacttcaggttagttttttctttttctttttcttgttccattgctgatctcgcgaaaacattccataattttgtgatactcagatctgatatgttctgtagttggataggagatgctcagagtttaactttaggcttatttgtttcttcttactgaaatttattcagttgaaataatatttgtatataggaggtgagctctatgctgttaaggaagttaattgctgctggcattggcagtcgtcctgttgtttttgtaactcataggtaatgatggtcgcttggttcatgatgtagtgctggaaattgttgaaaagtctgtgacagatgaaaaggcttacttattcccatttacatatatgcagcatgggaggactggtggttaagcagatgctgtatcaagcgaagctgaacaattatgacaagttcctgaacaatacgaatgggctagtatgtatttgtttgtcaattctttcaaacatctgtgagatctaaccatgttcatatcacaggttttctatagctgtccacattttggtagtaggctcgcagacatgccatggcgtatgggtttggtgtttcgtccagctccatcggtttgtccttcacaaaaaacttgcagcttatcttttttgttcaccccattctatatttatgacacttgcagcttatctttctttagattggcgagttaagaagcggatccccaagacttgttgagttaaatgattttgtgcggcaacgccatagtaaaggattgctcaatgttcttagttttagtgaggtaaaggaagatattgttattcaattacacattatgctttcattgttataatactaatatacctatgtcaactggcttcacaccttaatagactcaagtcacaccgatcgttgaaggttacggtggttgggcacttcggatggagatagtaccgattgaatctgcatacccaggatacggggaacttgttgtaagtaaccacgttataacgttcgcaccattgcgtagttaattgtgatctgctagccttgcactataacggacttgatagatcatgcatccacatctagtactctgcacagttttaacatgcttaatgatgtcaacaatatatgattatacatgttagagacacaaaacccaagctagtgtggtaaagacacaatgttgattttgtaggtatcccattgtatttttcttcttgtatgccccccaaatttcgcccatattatggggttgttcagattgatgacatttttaatcataccaatttttttgataaagttgctaaaaaaatgtctatatttagtttgttgctaaactttagtaaatacataagaaatcccgccaaaatttttggcaagttggctttggtaaggtttattttagctataatttgaaccacccttataattttcgtaaggtagtagcagtttatgcaacttgtaactggtggtttacttattattattaaaattttgcaggtcctggcgtccactgatcatataaattcgtgtaagccggtcaataagaacgacccgtcgtacgcagacaccttggcatttttggagaaaatattgaaatcgcgtctcaaagaatcagaatcctagttttttttttccttttaacttctcaaatatgggcggcctatggtatacaacacttcgggtggaaacgctggataggatttccttcggcattatgggggagattctgtttcttctgcatcagagattctcgtctgtttagttgatctgatctgacaatttgggcgggctgtgttttatgaagccttagcccaatcatacagtacacgaacgaattacatctacaaatagaggatagctgtaaatagttgcccctcttgtaagaagaaaaaaggaaatatatgtatgctctctgaatgacatgtattatttttctctcgaaattcataagcatgtaaccacacacccc

SEQ ID NO: 51542 - DNA, 3431 bp, Oryza sativa
atgggctgttgagttcatgggcttacagtttgtagactgagtcaacttttagcccatttacttccaactaatgaacttggagtggaagaagaagaagcgacacgccgacacccatctcttcgtcttcctcgcctaaaaccctcgccttcctcctccgccgcttccccctccacgccgacgagcaacggagcaagcgggcagcccacaccacaccaaggtgcccctccaaattctcccctaatcctctccataatttcccctaattgatacttgcgtcaagatttcgtcgtagatccccgtggcccgtgagggatttcaggatttgggcgaaatctgataatcgcgggccctcgattttgtctgtattcccccaggatggtggacgcgtggtggccgctgctcgccgcggcgatcccggcggtggtggccggtcaggccttccgcgtgaagcggcggcgggacgaggagcagcgcctcaaggcggcgcgcgggcgcgagaagagctccgacgaggtgttcgtctgcgagcgcgtgtgcacctccaagcggatgctcaagaaggtgggggccttctccaaggaccccatcccggagacctgcgtcaccgtctgcggcgtctccgagctcgacgcctgcgccgacgcatgcgcccggaccgtctgcgtcaaccagcaccaggtccccaactggaacgacgtctgcctcaagaggtgccagagcgagtgcctcaagctctcctccaccctcatgtagcatcccccactgtaagccatcgttgtttgtaccttgtttttggtacaaaccatcaagctcttcttgttcctaatgcaatccttattactacctaagaggagagcttcagacatccatagctatcgtttataaatcatgaggaatggaataggtgaatgactgcttcctgattgttttgtgcttcacatttgatcttcaacaaacaattgtgattgctaggtaccataccatgtcttttgtgaggcgtatccgaggttgagtttttcagctgggccgacgaataacaccagccaaatttatttagtatcagaggttgaatcaccccttttggatgaaatgcttatcgtgtttaatatgtgcttacctgagtgtgctgattctgatatgaaatcccgtctactatttatccgagtaggaaatgtaggacggctctattgcccatttacctccagaattgtagttttgtgcattagtattgggagtttcacaacttgctcaggtgatttatgttgcacagatgagttatctacagttcagaccaattgtgacagctaggttgtaggtatcatgtcttttgcggggggtatctgatgttgagtttatagcttggccggttttggccaaatttatcatgtatctaaggttcagttatcccatttggatgaaaattcttatcgtgtaggaattgtggttgcctctgcctgagggtgctaattctaatattaaatctcttctgctatctgtctgagaaggaaatgtaggatggctattacctattttacctccagatgtagtttggtgtactggtatcgggagcttcagaacttgccgaggtgatttatattgcacaattgcaatgattttcagagtttagagttgagagcattgcttgctggagtttctacctagtgctagcatgcgaagtagtgaaagatttgcagtttcttgctatgctcttattattagtcagacacaatgcttcctgcttcagttactttgctgtttacgagcttcagaagcttgttttctgctccagttagcttcttgttttaatgtttagtaacaactccctccgtctcaaatgtactaggtttgtttattttgagacggagggagtacaaccttccatggctgtcatttatctctaggaatgagccatggaatgacctatcctggttgtcatgttttgtccattccattaccctttgtgcatatgatcctcgagaaaattatcctaaggttaacagagaaggccttcctttatctgcattcagattacaagacagtgatggtctgaaatacatgtatcttttgcaaggcaacaatgccacatctttccggtcctccatttcccctaccgtctgctcagtgtgtgcacatgttgctatcagctccctgggtgtgaagctttaatcaccattgtgatgatccagtctgtagcctgaaactctgaatcaggcgtcagacaagcatcaggtagacgtcaaattctcctcttggattaggttaaccaagataataggatcaaaatcgtcactgttgatcggtgatcgcacacccaggccaccatggaaacgggcacctaacgcactgatcgtaaaactaagaggacatggagatgatcttgaacagaaaagacgcgcgacaactcccgctctagcttacgcatgcatatcgttctgtttcgtatagcatatggagtagctggttcagataataaaactatttagaaatccccctgaaaatgctccaaatgttcaaacacttcaaaacgcctctatactttaattctttgggtaatgcgtttgtcataagcaatgctgaacagtcataatcatccagcacaaaatacaagatattcgttttatatctcttacatactccactgtacataaacttgctgttctccccatcaagccatcaatcttatatatatttacagaacaaatttgcacattagactgtggctaatcacgcttaacatcaacacaagctcgagaaaacagcatcgtggaaagacaagtggctaatcacatcagtttgccacccgcacgccatagttttatactacttccatcccagaagactgcagttttgcattggttgtgttcaacatttaccatctgtcttatttgtaaaaacttttatgattagtatttttattgttattatatgataaaacatgaatattactttatgtgaaactatttttttaataagatgggcgatcaaacttgaacacgaaaaaccacgactacacttaaattggggcagaggtagtagagtttagagtgatctaatgcattatgcatcgttgtctagaggtgacacgggccgacatgatgcccatgtccttcctccaaggagtagatgatgcgctcgaacgcctcgacgtggtgctccgccacggccatgaacacgtcgacgccgcccttcgccgcgcgcgacgggacgaacaccatcagcccctccacgggcaggtccggcggcaggaacgccgccggcgagccggtgccgaggtccatctggtggaacctgaacccgagccagctatccacctccaggtccgggcacaacatcgtgcccgccgccgccgccgtcgccacgagatccccgccgccgccgccgcccgccgccgccgccccgccgaagtcgacgaacgactggatgtactcgcc

SEQ ID NO: 51543 - DNA, 6408 bp, Oryza sativa
  unsure (1)..(6408): unsure at all n locations
cgacgagcccgccgcacttgtaccggacgagcttcacctgcagcagcgcggcgccgacgttgtcctccggcaacgcggggtagaggtcggcgacgtcggtggccatggcgcggccgctgttggcgagcacgtcgtctaggtcggcgccgtcgacggtggcctcgacgacgagcacgccctggtcgttcacgtgaagaaagcggcggccgtggtggtcgacggcgagccggccggcgaggtgagggtacgccgcgacggccctgaggaggccctccttgatcgcctcgttcgacggcgccggcgcccggtacgcgagcacgctgggtacgtacaggtcgaacgccgcccggtcgaacacggtgagctggacctccgcgccggcgagcgggtgcggcgtgccgtacaccggcgccagcatcgccgtgcttgtaatcttcatcttaattacacctcgtcacctcgtcttaattactttggagtggcatgcatacaaccgcttatatagagctccgaactatatgtagaacagtgtgtgatcaaccacccccagtacatttattttgggctatttatttgtacacgtcaagaccaaaacgagagtaggtatcaaccactccgcttataaaaatgactaaattcaaatcaatttgggaaataattccatgttctaaatggggaaagtattctaaactcttgagaagacaccaattcttgtttgcatgccactcaaatagttatgcaaaaatttgaaaaaaagatcaacatgatagtttaatatgtgcttgatcattacacaagcatgcaaaaataaaatttaacttcaacatgttgcaacgaaaaatacactaaaattcaaatcggtttaggaaataattccatgttccaaatgggtttagagaagaggagaacagaaaaaaaggaaaaagtacaccgaaggtccctcaacttctcatcgagttacaaaatcgtcccttaaccgcaaaaccagatatatcacatctttcaacttacaaaaccgttcactttacatccttttgtggttttgatcccggttttatctaacgtggcggatgagtcagcgtgagacccacgtgtcaggtaccacgtcatcactctttctctttcccctcttctatcccttccttctctctctaatttctccttcgtctgggcaagccggcgggcggggcgaggtgggagaagaggtcgggcggccggcgaccggcgacgggcgatgcggcagcggcggccgcggcggcggtggcgatgacgacgacgtgggaataggagggccgccccctatgccgccagcctccgtcgcctctccaccagctcccatggatgatgacggcggcctcctcgctctccccgttgcgctccccatcggctcctcatccttcgtgctccgtgaggacggcgtctcgcgcgccgctgacgaggctgccgccccgcgctgcttgccgctgctgttcgatctgaacctgccggcctcgtccccgtcggctgctgccgccgccgaagtcgacgagatggattggtgttgcgacacgctgctccacctctagcctgcacatcaccaaacaatggcagcaatcgccggcgaactctagcctacgacgacgacgacgacgaccaaccagcaagcaacaagaattggaaatttgttactgggttgctgcgctccaatccaaccatcaccattgttgctgctgctactgcgaagaagctctaccatctcctccatagacacggataattttctttttattttcgttttcctccatctctttttcaccactcaagatttcgtttccgccgcctctcttgtgcatctctgtatccaaaggggatgctgctgctttcagctgtaccaatagctagaaaatgcgcagagcagatgataaaatttggttcaaaatttgtaacgtaaatgttatcggaagacgacggggacgaggcgggcaggttcagatcgagtagcagcggcgagcagcgcggggcggcggcctcgtcggcggcgcccgagacgccgtcctcgcagagcacggaggaagaagagccgacgggaggcgcaacggggagagcgaggagaccgccgtcgtcatccatggcagctggtggagtggcgacggaggccggcggcgtgggggcggccctcctgctcccacgtcgtcgccgccgccgccacgtcgcccgtcgaggtcagctcagccacgagagatagaacgaacagaggggcgggcgtcgattgctcacagtgtatcagaagcgtgcgcgcggaggatacggtgaggaggtcgacgagcgacgaccggaagtcgaacacccgcgcctgcacgacgatggcctccacgaatgacgcgtcccctgcgcgcgacgacggcctccacggtcgcgcccacaccctctcccttcctccatgcttttacgtcatcgacagcgccaccggcagcagtagcctcttctccgccggaagcggtggtggtggtcaatcaccgaagcaagttagctagagtcgatcggctcggtatttgatttggcttcgattgcttcgccgcgtcgaggccgacggatgagggggacggccgccgcggccatccgcgcgacggcatccatcggcggagccgcccgtcgcatcggccctcctctctgccgcgctccttccccgccagccgccggccacgccggctctcctccccgccgcgtggaagacgccgccaccatccacgcccagggaaaaatgagagaggaagggagagaagagggaaagagagagcggtgacatggacactctgacacgtggggcctaggtgggtcccacgctgactcagctgccacatgagacgaaaccggggtcaaaaccacctaataccttgaggttttgtaagttgagggatgtgatatatctggttttgcggttgaagaatgattcggtaactcgataacaagttgaggaaccttcggtgtacttttcccaagaaaaaaaagaagatgaaggcccgattcaaatacggcccaatataagcagcccaatgttcaaactgggctgtacgatcagcgctcgtcggcccagatctaggcggagggggaacgtgcggggggcccacaggccgaagcagcgtcttctccacaagctcaggctcgcctcgccacgccatggccttgtcctcctcttcgcacctcctccccttctcccggcctcccgcgaccttcccacgagcacgccacgccggcggcgggaggggccgagccggcgccacggggaggttcatagcgtgctcctcgccccctcctcccgacgtcgtggtcacccgcgagcgcgggaagaacgccaagctcatcgccgcgctggtttggttcccaaatcgacactcctgcattgttcacttgtacctaacgcatagtttttttttgggtggggggtgaggggaagcgtaggggattaggggattagcaatagagatggagaatacgcatcttccatttttgttttgtgataccctgtgagatcgtcgcgtattttagtgttgtgattttaggtggcctggccgactgtatagagggaaatttacgggctaattatactgtttaggacccgggaggctcactaattggtgcgagatttcagttaatgtactgatttccatctaggaaaaggttggcgtgtgctggatatgagatatttggtgctaactcgttgaacatggtgccgcgtgctaatggaactcaccattcatgtcttcaactggtcggagcttggagtttagagttagttgttttgcaatacagttcagttttatctgattacaaatgcaatgcaatgctatgttatggaaaccatttgtcattttgttagtatcagtctttcatgtaagaacatatcccttctttcatccatttcatatgatacaagttgggcatatgatctgcattgcctattttattccattagcttagagaagttttgtggatggtatgacttcctctctttttttttatgatcattgacctaataactttaatctactattagtttattatcttggatcacagtatatgagatctttacctttattctcagctgttgtttagcgtctcatgaatcacgatacatcattaatacggagtgtgaagtctgaatttttctgatcatatctagccatattctaactgctatacgtattcaactgggccatagatggttgttactccaatggatttgagaacattcctacattgtaatacttgtgaaaaggtccaattgacattagagtaatgcaattgttaccgcgtgccttgtcgaacagtgtgctaggttactagacttgattgatctctgaagggcccttggagggagtctaatgattttactcaatgttctgataaaattagagtctttgcctgttgattgtgtaatggaagtaatcttttgtgtgttgggtggtggggtcttcatccatcttaaaatgttgtaagcatgcagagtacatgttanagtaatcatgaatgtgctgctgcagccacttattattgtctcagaagaagattcaatttgtgttcagaaataagcagtccttttgtatcatccagcttattgctatctagttttcacatcagttttctaattgaattttgtaggaaaaacataatgtacaaagtcttgagcttcctcttattaaacatgttgaagggccagatacagataggctttctgctgtcctgcgcggtaagtagttcagtctttatttttctagtaatataactttatgtgtttctgtcttgcgttgtatatccattgctccacatatagtatatttcattacacttgctttgcaaaatcataataaaagtattccatagtttagtcacttaatattttgtattttcagatgaaaagtttgactggatcactataacatctcctgaggcagctgctgtgttccttgagggatggaagtaagattcaaacatatttcaattatcgtgcgcaattgctacagaaatataaattgtgcatcatttcacacttcattcgtcctaagttctgggctttgtggcataggtttgtgcactctgtgatttgcttgttgtctaacccaatatatgatatgttcttcaatcaatccattattctgtgatgcaccagaacaatccaaaaccaccatattaacacaagttacataacgacctatcagggctgctggaaatcctaaggtacgaatagcggttgttggagcaggtactgaaagagtttttgacgaagtaattcaatacaatgatggatcccttgaggttgcattttctccttctaaaggtatcttgcctcataggatgtaattttcattgcatgtcaactaattcgtatggtgctctcatatattgaagacttggaactgttttcagtcagtaaggtatttctttttcattttttttatttcatcagctatgggtaaatttttggcctcagagctttcaaggaccactgaaactacttgtaaagtgttatatcctgcatctgcaaaggctggccatgaaatccgtgagtcagaatgggttttatccttctggttacatgcttgcacctgcatttccacaatgaccacatctgcatcatatcttcagctgttatgttaactaattatgcggattgcagagaatgggctatcaaatcgaggatttgaggtgacaagactgaacacatatacaactgtatgtttttcttttaaattaaattattacatttgccttattaattcttatttgcttactttatatgagtaatgtgaaattttggccccttgtcttgtgcactttggacctcgttctatttatctgcattcagacatcccttacctgatagtatcatattttagcttgatatggttgactgtgacatatgttaccgtagtagaggttttgtatttcaagaaacagtagtaattttcatggattacattttatcttttcaaagtttgtgtgcacgtgaatcttggatttttgttttgacctatgaaatggttgtatatacatgcaggtatctgtacaggatgtcgatccgctaatattaaagcctgctctttcagctccagttgttgcagtagcttctccttctgctctccggtaatatataatgtgtctatggctgcctcggaacaaatttaaaaccgtgttcatataataataatggtatgctagtactccctaattagatggttcaggtaaagtacgtatgtgggagagatcacaaattctgcattgaaacattttttttttggaatacgcaagagatttgtgtaccatttcattaacacggggctttgacaaggttggggctgatttctatttggacgtgtttctttatgatccataaaggggtataccgattcaaaggcacacaaacagctttat

SEQ ID NO: 51544 - DNA, 4475 bp, Oryza sativa
  unsure (1)..(4475): unsure at all n locations
gtgggttgaaagcatccttgaagcgctcagagcccatgggcaatcgaaagaggtcctctctcgtcctcgtggatactttccttgaatttctcagcttctttcgtcacacttttttctgtttctactgtaggccccagggtgttgaacttgaagacgggcaatttacttgtaccagatgctggaggttggtggacatttgtggcggctgcatattgaactctgtgcttccttgactaaccgatcacacactttttgttgtttttctaatataattgagaggagaaaccaagtcggcaactactgtagtagaactacttgtaaattgtgagctgtttattgtagctactgaacacggtgcggtatattaccagtgttgtaccaattgttgcttagtttataccagtttggcacaaaaaatgagccctcctccaaaaatatggaaatcaatgaatgcaagaggctcttgtactgggctttactaaaccgcaggtgtttctcaggtcagaaggcccaaagctgcactaggccattattaaggccctgtttagttcgcgaaaaaaaaaattttgggtgtcatatcggatgtttgactgaatgttggaaggggctttcggatacgaatgaaaaaactaatttcatagcttgcctggaaaccgcgagacgactcttttgagcttaattaagccatcattagcatatgcaggttactgtagcacttatggctaatcatggattaattaggctgaaaagattcatctcgcgatttccatgcaaagtgtgcaattattttttatttttatctatatttaatgctttatgcacgtgtcaaagatttagaaagtaaaccaggcctaatatcaatatatgtcttctcataaatgtgcatagatttatcagtcaacctgagccgtccttgtcctcactccgagagagcatgcaacgcttcgcagccgcatcataattgtggccttcttttttttttttttgacacggtcagtgccgtctactgcagaatctccangtaagttgccgcggtgatccgaatgaactgaaattgattgccacgacgacttggaatgccacggaatctncgtcctcttcacctncaccaaacctcttaagagattccagcgtttgtgtccacccacgcaagaatcttctttctctcagagacatcactgactgcccacggacaagtgcactaatgatcaatcaaattatgaaatgaatgaatgatactctccttcgattgcgttaatatctcgctaatctccgtggctgtcagcatcctaaacactgcaaaaacagaacgtaacaaaggtcgacatggacaatttcttttagtttcttttgttactcggttagcacttacgtacggttagtcgtccacccccttctggacggaaacacgttcatgtccagctaacgtcgacgtctctattgcagatttgtaggtctaaccctcctgcttaactaaccaagcgccgtaacgaaaaccggcgagcttcttcctccaccgccgccggcctctgcaccggcggcgacgagccggagagagccagcgtctctcataaaaggagattaaaagttactacctccgttttaaattataagactttttaacattgctcacattcatataaatgttaataaatatctggattcattgacatatataaatgctagaaagttttataatataaaacggaggaagtactatataagacaacgatagtagcagctttaggttcgcgaatatttatatcaaaatctatggagaatttggcttctctagctatcctgttggatagattcgaggccgacttcacctcacaagagaaggaattaatcaactagacaggaattaattattaaagatggagttgtttaaccagcaacactgtgtcaactccctgtacaattaagtactaatcagtaatcacctgtactagttgttactgattacagtattactagctacgtggcacatactgtcactgagatgctgggagcctgacaaaaaaaacagagcaatcgctgaaaaaaaaacaatctccagtgcatcgtttttgtctgtaatatcctagtggtaacttggcaagagtgatcagtgagtgagtagattctccttatcgcctcgtagctcacggtggttggagcgttcagatcaacgtcaactgtctgtttctctgaatttgttggagtaaaccggagatatatatatcccctcctaaacctaaatgtggtcgttgcgaatgaaaggattattagcataggatgagttgttggagaaagactgcattggaatcaaaagccaaagtacagcagttgtgccctccatttcttcgcaatactgcagtgtaggacagaaacggagttcttttttttttctttttgaaagttcagtttcatcaagtgattacttaagtagtagtactagcatactgtatatattaggttttattgagtgggattaatttgatttgacagtgtgacagctaaaagtacgtatccctccgtcccaaaaaaaaaaatcaatcccaaaatacgtgtccagatttatagctagagtttacctttttttaatagagtagtactccctccatcccaaaatgtttgacgccgttgacttttttaaaaatgtttgatcgttcgtcttattaaaaaaacttaagtaattattaattctttttctatcatttgatttattgttaaatatacttttatgtatacatatagttttacacatttcacaaaagtttttgaataaaacgaacggtcaaacatatttaaaaaagtcaacggtgtcaaacatttagggaaggagggagtagtatattgtacaataagagtcatctcaaaattagacggatacattatatataaattttgaaatatatatacaagtgttgtgaaaatataatgttatctaaaaataaaaattgaatactaatattaaagagtgtgtaatttcattgccaaatttttaaatggacagattttaaaactaaaggacagcaaattttctcggccgacaaacaccggacactaaaaaggggagggagtacgatggacatggacatctgagaaccggaaagatcatatttactctcatttgttcaaatttgtcatgaacagtaggttggccgtgctactgaaataattgattcggccatgatttcgcaatcaatcttgaacggcagccaggagctaagccatgagagttgagacccactgactactgtagcttaaagctactccctccgtccaaaaaaaagactcaattcctgggttttcgtgtcctacgtttgactgtccgtcttatatgaatttttttcatgattagtatttttattgttgttagatgataaaacatgaataatactttatgtgtgatttatctttttaaatttttttattttttttaaataagacggacgattaaacgttagacacggaaactcaagaattgagttattttgggacggagggagtagtaagctactgctcttctgccaatcaaaatggcacacatttatgcaggcaggcaaagtatccatccatccgaggaccacaggggaaacattggaaatgtttcgaaggacaggaaagattgctacggatatcactagcagatgaatgagagatggaggggaaatatttggtagcgagcatgttcttggtttatcgcttcactgcgcaataagtttggtatcgtttggaacgcatgaatttcatagggatttatcctgaaaacgtcgtcacttgaaagtggctatgattgagacatttttataaaaattatgtgttctaaattagtagcagttgtgcgagtgagtgatttatgactgatcggatatactccctgaatttcataattaaagatgttttgtttttgttttcatcatttgtttaagtctaattaagcttattacaaaatatagtagggatgtgcttctatgctctgcaaaaaaaaaaattgcacgaaagttaaagctaatcagcggctatgattaaaagggagattagcacttaattatcattagcgaggggtaatttcgtccaaagatttttgagcccatatccagcccagtccatctgaagcgatccccacattctaccagtccaccacggcaccgctcctcaaccgcaccgccgcgccgattttcgccttgccgtcgttgctctgccctcttcttcagttaaaaggatacccgagcaggtatggcctgagtgacagtaaattcagtttcagccttaacttgtctcctcaaagatttgccttcaagttacagaacagagtcaatgccttattgctgcaacccgacttgcaaatttggttgtacatatacacatctggcacaagcttcatatttacaagtaccataaaaacctcatatgcagtctaagcgctgccacttttcaatagaatcgagagaatggcattcgtaataggtgacgatggttgggcagcg

SEQ ID NO: 51545 - DNA, 1700 bp, Oryza sativa
cccttttaatcacagccactgattagctttaactttcgtgcaagtttttttttgcggagcaacaaattaatttcattaaaaccataactgaatttttagagcatactatttgtttagtgttaaatttttgtctattttttctataaatttaatcaaacctttaaaagaagtttaacttaagttaaaatcaaaacattatatatctatactccttttaaagaagacaatgatggtgacggtgaatctgtccccaccaactgttgtatggagttttttttaaccaactaccccttcatggtttttaccatctactacttcatgtgctctaatattacaaaatttcttttatatataattctatctatttcattcctgtaatacaaggttatgatacaaagacatcagcaaggacaaaattattaaaaaacatcacaattaatttgttctaaacaatattaacgcagagataatttatttttaatccctagcaaagcatgggtatttagctagtattcaaaaatagagggagtatgtgggaaatgtggcacatgccgacatgcggtacaatccaatgatatgattgataaaactaaattgcaattgctataggatgaacatgcatatctcttgcacaaatacgtcgctacaaattcttagtagcatgtgcttataactatcctataacctttatctgcttttggaagttcctatcacccatatctagatttataagtactttttggtgacagattccctaatagttctttctcatcctgtctggacaaaaactggttgagaaaaagtatgctacatctctgcactttcgccgtgtactgactggttttgatttttcctggctctgaactctgaagtttagagacgacggtcgtcacatatcagaaactgttgctttcccaactgctgccgttccaaacaggaaatgatagatcacttgccacattgtctgtagtcttaaagaaacaattaaaagttgtagataattaattaggcttgtgactgcaatttttctaagcttatgaatgctctcggttgtagtcgtcctcctctgtcggcaaagcatggcataaattcgccattatcttgtggcatgacatgacagcagcttatcaattctgaaaaaatggcatgacatgactgtatactgatattagaaaacattatggccatgattagttaaaaaaaatcacgctatcacatcaaatggttggacacatgtatagagtattaaatataggaaaaaaaaccaattacacagattgcgtgtaaattacgagacgaatcttttaagcttaattgcgcaatgatttaacaatgtggtgttacagtaaacatttactaatgacggattaattaggcttaataaatttgtctcgtagtttcctggcggaatctgtaatttattttgttattagactatgtttaatacttcaaatatgtgtccgtatatccgatgtgacaactaaatctaaaaattttccctagctaagcaaggcctatgttggtaattgctactacctccttcaaaaacagttttacttttctacacaatatggatggtcacatccaggttttttagaacaataaagatttatttagagggaggtagtacttaccagccgcgtccatgtattaggtagtatgattgtgagaaataaacaaaagaacatttcttttttttt

SEQ ID NO: 51546 - DNA, 886 bp, Oryza sativa
tcaaaaagtttgcacggacaatccgttcactgtagctaaacacttagcgctttgttgtcattgatgacatccaaaatcacctaatcaattttttatatatatatcccgaaaaaaaatttgtatataaaaaaatactccctccgtcccataatataagggattttgagtttctatttgcactgtttgaccactcgtcttattcaaaaaattttagaattattattttttttgacttactttattatccaaagtactttaagtataacttttcattttttatatttgcacaaattttttaaataagatgagtgattaaacagtgcaagcaaaaacttaaaatcctttatattatgggacgaaggggtactatcaacccatgtagtaccaatcaccatgtgagaccgtgcaactgtgcaaaaattatttttgtttttttcaaacacaaatgtaatgtaatggcaaaggctcgtaattagagggtgtttccaggggcaaaagcgggagggcgctcacccaagcggaaagcgacacggcaccacttgagaggaggacaccggccgtgcgagcgaggggccccaccgtcagattccgcggggccccgcatctcgatgtccacgtagcgcaagcagccgcccccggcgcgggtgttattatatgttcaccggaatctctagccacccggggtgggacccaccggtggggcccggtgcaagtggacgccaggcgggtaaggaaggggagccggtgaggaatccgcgggaacagcgacagcgccgccaggcgcgaggagattccaccgttcgatcaacgtttggtgaacacgtgtcgaccaccgagacgagctgagactgctcaagcttgacgcgatcactaatttgataaaaaa

SEQ ID NO: 51547 - DNA, 845 bp, Oryza sativa
atactgttctgtagacaggatacaatggcacacctggtcctacaatatatcaagcacacctgtgattatgtactgatgaaactgactttcttttctatttctccttccattcttctctccaataggcgataggcgaacaaaataaatacaatttgagatgtaacaggaaaagctaggggtgtagtttttgtcatatgaaatcttgttcttggtcgtctgttcggcgcgacgaagtatctccgtcgagcattctcttcgtcatgttggccctctggacaagacgaaccaatgcttgcaccacctctgacattggtggcctgaattctggttcaggctgtaacatgaatttgtttcataagattcagacattctgttccatgtattaggtaattagtattgcatagctcatctgcataggatggtgaaatcctacctggacacacaaagcgagcacgtcggcaaaccgggagagagacttggcagggtacagacccttcagcgcaggatcgaccattctgtccaatgcatcgatgtcatggagctgtggagtcgcccaccgcacaagtgactgctctgacctcggtctagtgctgtaatgcaaagtcacacgattataccgaggttcatcagttagcactaaatttatagttatgcgcaagctggaaactggttacgactgatgagaagatcaagttacctatcgaaaggtctgcgtcccgtcaaaagctctagcatgactactccaaagctgtagacatcgctcttcagtgtgtactgaccagtcatgtccacctctggggcagtgcacccaacactctgttgcgctgcctgcatagttttttttt

SEQ ID NO: 51548 - DNA, 2043 bp, Oryza sativa
aagatggagtagatcatggagtgacccattcctgtggaaatcgtaaacaagcaagtgttgcccatgttccatgcaatagcccacaagctcattgagattcggatgatgcagttttgaaatgtctgagaccagttcagcaaaatcatcagatgaatggaatggcatcccggtactatcaagtttcttcacggccagaacctgaatagtgtaaacaagaaaagtaagctctcagaattttgcctatatctaaatgtccaacctgtatcaccctcgaaataacttcaaaagcaaaaaggggaaatacggtaacataaaaactgaaactaacattaagaactatacggcctccaatttatgaggaatacttctatgctcaattgtttctgttcatgaggtcatgacagattttaaggcttttttttcttagctttgcatttccaccttttgactaatgtgataatgaatacacatgctacctttcatttactttgagaaatatacaggaatagcaatagaaaaaattgtagcatacctttccaccagtaaactgtgccctgtatacacgtccaaaagtaccttccccaacaaggttgtccatgctaaagctttctgttgccatctgtagatctgcaactgaataaacagttgcctttataggtgccacattggttttcttcaagacaggcttgtttgataaatcatcatcatcgaaagacttgtggcgttcaatcttggggggtggcttcagactaaatgaagcaggggatggcaaagactctacatctattgtagtagactcttcaataggcttcatgtctgcacattttcagaagcaaattttcagataattgtacaaaatatataacaaaactaaagtatgatgatcagcaaggcatcaggcaaacagacctttaacttcgtttgaagggaacgaagtgaatggctggtgctggtcaaaatgttcttccaatgccgctctgcgttttcttcttcttatcacaaagaatgcaacgactgctccaactaccagcaatgatatgataatgcctgctacacctccaccacctatcccagagcttccaccagaacttgaaccaccattgttttgacctgggctgtttggacggtttggtggaggtggagctgaatacggtggaggtggtggtgctggtccattactccaagaatttccgtcagttctgtacacagggatcttattagttcagggtacatctctcatacatttttacatgtttataagcaaagagaactcactgtagattgtttatcttcttaagttgactaggaatccagccagtgaaatgattttttgcaacattcctatataggaaagcaaagatatgagatgtggtactgcacgtgcaaataaaatattaattacttataggttgatttcttacagatcatcaagggggagattagcaaggacattgatataaccagtaaattgattgttctgcagatatctgagaagaacgagtatgggattacaggcatgtcactccaaaaagacatatctatgagagaaaaacaatcattttcttacaatttcttcaggcttgacaatgatgtgaacccttgtggtaggtcaccagcaagagaattaaaggaaagatccctgcatcacatcacatagggaaatggaaagtgaatatagacattaggaatatgaacaacaaagaaggattttacaatacacaagttaagacccgtctacaatccacgcacacaaaagtactcacagtgttgtcaagctatagaggctggaaaatacatcagttatatttccttgcaattggttatgatttagatttctgcacatacaaagagaaaacatttagctctaccaaattatacaaatttaaaagcaaaatcaacttgatgtttgcaaagatactcacaaatacttaagattagacatcgagaaaatcgagtagggtaaattttcagtgaactggtttcctgcgagattgctgcaaacaataaccacttagcacacagacaccagaaaagctgatgtac

SEQ ID NO: 51549 - DNA, 1182 bp, Oryza sativa
tttgttctcaaaaattgcccctcgcaatccagacaatgttttgcacgaaattcctcctcaattgagattcagcaagcaaaaatgcaaccataactgagatagctaggtacatagcataggccaaatttggttagtagaaacagcagaaaaagaatggacatgcaagatttccaaccgaatccagtgtatttccttactcggataagcacaacttaactaccccaggggcagaaagaccccatttttatcaacccaaaaatgagaattataagctgccgaaattcacacaccatcttgttcactatgtcgaacagacgtaaatcaagagcattcttgcgcaaagaccagatttcgcaagtaaaaaatgaagaaagattcggttaatcggaagctttcacatccatttccccgttccaaaacggaatctacagaaaactccgtacaaacagcgccagaatcagcaaaccagccggacgaaccgcaacagaaaacacaaacacagacatcgagcgaagaactccgccgattaatccagcagctctgaaacaaaaacagaaaagaaaaaaagaaagacaatcgcgcaaaaagggagaagattccagattctagcttaccatcattagggtcggtgtctgcagcgaccaagatttgcttctggggccaaatgcaaaagcagcaggaggagcacaggagcagaagcgcaagccatggcgcatccgctcttcccatcttcttctcctccccccacaccaatgctcacacgctctccccactaaaaacgcaaagaaaggcgctttcctcgcatgaaagatcccttctatagcctcctccccactgatttctttcttccaattaattaacttatcttatctcctcctgtatctgctgctgctttcagagtttcaaccttcctccgtgttcttgaatcgcgcagtgggaagtagcggagcagcagctggcaccaggacggggacaagaacgatgaggtcaaatcaattgcaaggttgtcgctttcatcgaggggctttcttgtgaattcagcagccgcgaagggctcacattcaataggagaacatcagattcggagacgaattctttttcttcaaagagaaaaggtaaaaggaaagagctgattttttaaggaaaagctgacacattcgacgtttttattaggatgcatct

SEQ ID NO: 51550 - DNA, 706 bp, Oryza sativa
gccatctgctggctccggcattccgcgctgcagaacgcgtgctcccctctgcccaaaacaaaaaaaaccacagataaatcagtcagtcagtatccaagaattaattaaccacaagttcctcagctcgatcatgatcactaatcaccaaataaagtttctatttgaagtgtggattaaggcggagttcttgatttgttgtgtaaaatgtcttacttgtagacgaacacatccatgtcggcgtagagcttcttgtggcagcagtagcagcagttcaagaaccccaaccccatgaacccccggcctgcaggagcaccagcctcatcctgactcgccgccgccgtcgccgccggcgacggcctcaccgccgaccgcctgagcacggacagcggcggccgttgcctcggcgactgctgtatgatcagccggagcccgacgagctcgccggagtcagccggcattggcttcttcgtcgacgccgcgacacccacagctccatcctcgatatggaagaggctcggagctctcggaatcatggcgtaaaaacttttaagttctcctcgatcttgaaatctcgagattcttgcagagagagaagatgaagaattcaagatcagagaattcagaatggattgcaagagggggaggagaattgctagcagattgtgtggcagtgtgattatatatagtggtcagagctcaactagta

SEQ ID NO: 51551 - DNA, 967 bp, Oryza sativa
aaaaaaatagaaatatggaattaaaaaataaggaatattagaagtagagtatagagttcatattggaatttaaaaccaactaaaattcggaataaaaaggagcctccatgttcgctctcatggcctagaaattctcacattaatcagagaaaaagaaaaggcagagtctcagagaaaaagaaaaggcagagtccatatagaaatacaatttagaaatagctgaaattcagaattaaaaaataaggaatattagaagaggagactagagtagttattacacattagtagttttgaaaagttattgcaaaatttaaaattatgttgtcattgtaatatattttataataatataatgagaaaacatatatgcttttatatgagagaaaatataatgatgctagccgcgcaatctacgcgggccaccatgctagttcatgattaagacaaagtggcactgttattttgtgatgtttttcatgtcagtaagcatatgttccttgatccgaagaagtatttaggttcaactgatataaatattccaaaaatcataattgaaatgtttttacattgttgttaagattcttgatgagcaacagcaatatgagctagtaaagttctgcaaggacgaggaacttgttcttctggcggatgaggtaaggctagtcatgttcaaaggtgtcagtgtgttgagtgatataataatgttaacaaagtatgatgttaacaaacacaagagaaaactgtccagataatcgttttttggggggtgttgataggtataccaagagaacatttatgttaccaacaagaagatcaactctttcaagaagatagcaagatccatgggatacaatggagacgatttacaattagtatcattgcattctgtttctaaaggtgaaattccatcatccgcctttctttcttcaagtacatttgaacttcttaccacatagatatttttttg

SEQ ID NO: 51552 - DNA, 1029 bp, Oryza sativa
caagtttggtcctttgtgaaaggttgcagggacatggcacgtgagatgcacgatcctgccgcaggaggagaagataccttcgatgatctcccgcttcagggaattccatgaggagttcatgtcacagtatcgcgactgatggactgaactcataaggcttcgccatccagaagacgagaaataaaagcaaacgccgttaatctgcgatgtgttaacggaagatgtgcagcaaccttaatctggaaaacttgagcatactcagtttgggtcgtaaagaattcacgggctgttgcatcagtgtttgcccggtacaaggtttgattggattagcacgatgaatgagtgcagggagacctgcagctaaataaatactccctccgtcctataatataaagtattttgaatttttgattgcaacgtttgaccgctcgtcttattaaaaaaatttaaaattattatttattttattagtgacttactttattatctacattacttcaagcataacttttcgttttttatatttacaaaaaaaaaattgaataagacgagtgatcaaacgttgcaagcaaaaactcaaaatcccttatattgtgggacggagtgtgggacggagtgagtgttaatgttagtagttgtgagttagtgactcgtacctaaaagtaatgctacgaaataaaaatgtgttgagagagtatcttacattcagtaaaggttttccaatcgagttggctatcttgaaacggaacgagaacagcagctattgttttgagctctgaaatctgaagcaggcgacacggagcagcagtctatagcgaatctcttcttgaagcgaaactcaaactcctcgcgatcccgttcattggggcgtggtcgcgtagattcatcattcatgggcctcgcactcccgcggctaagagcaagaacaatagtaggctttatgccggctataacaagaagaaaagagaagagagaaaaaagcgggctataaatttgtatccagctgaaacatggacttcaagacacttt

SEQ ID NO: 51553 - DNA, 1480 bp, Oryza sativa
tatttttttattttttaaatcaaatatgaaataagagagacgattatgggtgcgtttaaaatagaatgcatggagtactagtgtactacatcgagcaggagcgccatagctttgcggcgtccacacaacacacgccgtgccttttcccggagtggcaattggcaaaagcaataacatgcccagaattaagtatgcaaagcggttgctgccaacgccccgggttgtgcacatgggctatttggagaattggattcgcccctacgagtagtagttgctcagctagggttgctgtttgtttgccaaagatattctctgccactccctcctgaatgtttaacgcagttgatttttttaaatatatttgaccgttcgtcttatttaaaaacttttgtgaaatatataaaactatatgtgtacataaaagtatatttaaaaattaatcaaatggtatgaaaagaattaataattgcttatattttttgaataagacgaacggtcatatatatttaaaaaagtcaacggcataaaacatgtaggatggagggagtatatacgaatggtttatgtgaaatgagggggggtgggggggggggtcttttccctgctatgttggaggaaatattctgccgcggttaggtcagtttccaccacggaatgagtggtttataccagagaattggatactgattgtggagtacattccttccttcagaataagagatggaatactcccatattgtcccatatgcgcaaggtaaaggctgtttgcttggtggctagagtttgccatgccaaatcttacccacaccacactttgacagcttaggctgagttcgtcagcttgagttcccaactacacatccttcgtttttcatgcgcacgcttcccaaactgctaaacggtgtgttttatgaaaaaaaaactatatacgaaaattgcttttaaaaaatcatattaatccatttttagaaaaaaaactaatactaaattaatcacgtgctaatgaaccacatcgttttacgtgtttgaagggagagtttccaactctctctgccaaacacaaccttttgctaagttctttcctcaactttgccaacatacctccctcgttttccgcgtgcatgctttttaaactgctaaacgatgtgttttttaaaaaaaaattatacaaagtcgtttaaaaaaatcatattgatctatttttaaaaaaagtaaatatttaattaatcataagaaaatgagtcgctccgttttacgtgcgcccagtctaaggaccccctccttgtcctatacatgctcttagctatcaacaaaatatgcccgtaatatgcccaacgagttacgataggaattggatgtaagaatattcggattttatttcttctgccaccctctagtggtgcaattcttttattttagttagaagaaattttactacttaaatttatatagaacaaagtcaacagagcgttaaaagttt

SEQ ID NO: 51554 - DNA, 2491 bp, Oryza sativa
cagcacagcagtggggctgacttggttttgttatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaattaccaatctagagcggttttatcctacgtggcatacgcgtggcagtccagtcagcattttttttaaaaaatggtggggtccacctgtcatgcctccacttcacctcttcctaatatctctctctctcttgcgcgcgggcgcaagtgcgcacggcggcgtggagccgcgaacgatggcggcgtacatgggcgggtggtgggcggcagccgcgaggcaaggaggtagcattgcccgcagtagggatggcgacggggagaacgggccgagcgcggccgtcgaggtggaggctgcggcggaggggggcagcgaggaggtggctcgatgatgaacctgaggagaaggacacctcctgcatgacgaccggcgatggaggcggtgagttcgggcggtcggtggtggaggcggaggcagagcgtgtcatttgcgccaactgcccgcatcgtccttccagatccgcgcggcctccgcccccgtccgctaatgtccggtctcggggaggatggaagggaggtggcgccatcgtgagatacaaccacggaggaggcggggacgacgtcaacgtgagaggcggagacagcagtgccgcgatgaaggtgggagagcggaggaggacgaggaggaaacgatagcgagagcgaggaggagacggcggcggtgacaaggagaaggggcaacgatggaatttcacggtcgcacggaggaagaattggactacggcgtcaaataaaaaaccgattcaggattgaactacaacgtcaaacaaaaaaataatatggagggagtaattgacaacagagaagacattactcacgtgagaaaatagagcgccattgacctcaagcgcttgaggtgccgttgccaaaggcacggttgcgtacgatgtcttggggaaagtagagtgcgtgcgcccagtatcagagcttggcgccaccacctcagatctatgcttcgctgcctcgctgcactggaacagcagaacgacaacctcgctaagccaaactgccggttccctccgaatcaagtgctagcaggccagttcaagcgatatgccgatacgttgtctcctgtctacagtctccacgcagcccctcaccatctttcatcgcgccaacgccagcaacgaagggacaagagaggaatgaggatggtcgatggcagcatgaggaatgaggatgcaaggggagaaagggagctagcgtgacctagaaggaggaagacggttatgatgggctagcgtttcccaaggggatgggaagggagagagagaggagaagggcggcggtaggctagggtttgcccgagctccttgtgaagttgagattggagagagagagagaggagggtgtgggtgcggggatatcgtgtgctactgagctaacgatcccgacgatcggatatcaatcggatggccaagccaggcgattgaagagagcgctccaaattcaccagccttccagcgcgggcggaccgacatgtggacccacgagaaagtatggcccagcgaacagagaaagaacggtatttttttttgcgtaaaaatcccatgcgccatggcaaagccacgtcgtgctgaaatccctccgaacgccatggtgcaagcagatcgcccttacttttaattaccccgactagacattttgcgcgcgttgcgcgccctatcaagggtccaatgaacttttaccaataagaatattgtgagaataaaattaaagatctataatctctctgatagagacaaaaatcatgaatttctatggtaaatagagtgagcatcgtgttgtagttatgctaacaaatttttttcctaaaacacagagttggtatatctagacaaaattaacatgaacaccatataacagcttaaaccatcacgtaggctaaatataaatcacatagtgcatagcataattcatcaattcagcttgttttcttcacatcctattgaagagggtataagtcatttaataacatgtaagtacataatatacatcgatacttaggaagtgtaatatttctgcatgtcatagtcagacaatcatatcttaacaatccattttgaccaaaagtttaaccaccaaactgtccgcacagaagaagcatatgttagacaacaaagtaaaccatactggggttaaaaaatatagagtaaatttcataaaactacatatattttgcacattctatcacaaaactacagatttaagaacttatttcacaaaactacagatttagtgtctacgtttatcacaaaactacaggtactttgcacaatacatcacaaaactacagatt

SEQ ID NO: 51555 - DNA, 1435 bp, Oryza sativa
caaattgcatcgccaagttgccactggaacagggacacgcaattaatgtctctcacccttttcctctatctcaaaaggtacatttcgttttctttacctaatttctccctctcaaaataaatttatctttcattcatctcacacgtatcaatacaaaatcggaaaactaaaatacatctattttatcaaactctatatagtctcttatttatctatttttaatataattattttatgctttcacaaacttcgatgtaacgattactctaaaaataaatttattctatgacaaatgagcgaaaaatgaacatataatgagagagaaagtacctttgctcaagtttcaaatgttctcgtagcaaagagtactactggtaaatactctaccatgataataaacctttgctacaatatgagataaaatcctttgtgttacaaatagataatgaatctggtaaaactgaaaatcacgctgtgcaagcgactctgtgaaaaaactgtttctggtgcttttgctgctgtgcctgggacctcctcagcttgtgcaataccgctttcctgaaacttggcacgccgcagaccgcagccaccttggttttgcacatcaagttgaatgaccgagtgtgacacaagatcctgtataaacagagaacgccattcgttaattcgcttgcaaaaaaactttccccagtgtgacatggacacttacgtcctgtttagttcgaaacgaaaatttctagcgtgtcacgtcaaatatacggacacacatttaaagtattaaatgtagactaataacaaaacaaattacagattctatctagaaactgcgaaataaatttattaagcctaattaatccctcatcagtaaatatttattgtagcaccatattgttaaatcatgacgtaattagacttaaaagattcgtcttgatatttacacgcaatctatacttttttttatatttaatatacatgtgttcaaacattcgatgtgattgggtgaaaaaaatttgcgtgtacactaaatagggcctaattcgcttgcaaaaaaaacctttccccagtgtgacacggacactgaatatatatatatatatatatatatatatttgctactcgtagtactagctttgactgtagctgcatcctgctgcctgcgacccttggttgctaccaacagatgatgctgtattaataaacgagaaagtgagcaggtcaagttggcaacttgacaataccggaattccaagaaactggggttggggagaaagttttggtattcgcaggcgatgcagccccgatctccgtggctcacccgtgtggccgtaatgccgttggtcgcacacgtttgggtgaggggagtccatggtgttgcggaggaaggtttggtaggaaggatcgtcgagctcaaaaccggggaaagctctttttcact

SEQ ID NO: 51556 - DNA, 717 bp, Oryza sativa
tgcaaatatgtcgtgggtctcgtttaagggcctgtttggttggggccacattttgccacacttgaggtagatcagtttgaccaaatgtgattagtgtttaatttatttccacaattttgacatgccacattttctactcttttggtcccactagtcatagactcttttcttagccaaagtttaccacaagtgtggccatcaaattttgagacacataatttgcatcttgccacaccttcggtacaaaattgtggtaaatcgaggagggcttccaaacaggcccttaggggtccggatcctacctgctccagtggctaacgggtgcggggtgccgagcagcagaaacagtgagcgcggtcgtgccctccacgagcccatctccttccccttccctttccttgccgggccaaccaatgcacgcgcgccgtcgccgtcgccgtcgccgcggacagctgccacaccacacacacacacacacacagcacggcccgtgtctggtactccccctacgcaagtgggcaaacgcagcagcagatgcattgcaccttctcctcccccctccccccgcgtgggccccacccacctgaccttatcccttcgcccccctcctcctcctctttcgccgcgatttctttaggattttttttcccgcgatttcggagccgcgggatggatggcccccctcccccctatttaacaccgcctcgtcgctctctc

SEQ ID NO: 51557 - DNA, 1101 bp, Oryza sativa
cagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcggaaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacgtacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatcttcggtgtctggcccccagttccacgtgattacaagcgcatcttaacacgacgatcgcctccctgttgtcctcctctggggcaacaaaccgcaggccgagttggctctggccggaaa

SEQ ID NO: 51558 - DNA, 1242 bp, Oryza sativa
ttgagctgatcttgtgcattactgtatatatattgggattttcaacgcgtagttagctttcagcttcctgatgcagaaaccaaggtttctctatttgtacagcaacaatttataggagctatttttcttcctcaatgactgtttcattgctacaagggagtgttgatgtctaaagttgttctaaaaattatcccttgtttaacttttgttgagttgacatgagtttgatcttttgttgtagaaattttatcttatcggaagggacaagacaaggactctatggagggtgctgaagattgacaggatggagcctactgagctggaaatcgaggaagatcatacaagttacacagagaatgaatgccaagaactgctgtggcgaattcatgaggggaatagattgactggtggactgaaatttgtcacgaaatgctatggaatagttggtaatgaaacaggaactgagataccattgtttattgatcaaacttcctggtagttcaaaacttcaaattataacatttactccatctttgctttactcaggttttataaaatttcttggcccttattacatggttctaattaccagaagaaggaaagttggtacaatctgcagtcatgaaatatattctgtcggcaagagcgaattgattgcaattccaagtcctattgtgtggcccaacgtggcttattctagggatgagaacaggtctttcattttttctatgtgtaaatattgtgctttgcctgttgtaaatccatcgctggttcctagcaatatgaaagatgccagcttgctttgttttgtatctggacatatcatagtgcttgtattcatttatccttttgtagttttccttctcgtaatatttcagttcatttgtttgctacattgtgatgagacaatgtgcactatcggcgccaaagtgtccttgatttcacgtttttcttttctatgacaattttcttttgtgtgcgtgtgtctatctgcatatctttcagataagtttttgttcatatattggcgcttgtagttgaacctgggcaatccagttgttctgtgtgtgcaattaatatcactttgcctttaagtatacaattttcttgttgataataatatgcaccctactcatacggtcggtgcatacgtcaattcttgcagttctgagcattgtgtgtggtgttcataaggtcagaggtatatagaattgcctcgaatttctttgatccactaatatt

SEQ ID NO: 51559 - DNA, 1206 bp, Oryza sativa
aatgtttattaaacggtaagcgttgtgccgttgaggttctttggtcctggttcaagacctttgaattaggacatgtatgattggcagttctaaatgtttctgataaataggaacttcttattgctactctatttgcattttcattatgtaagtactgtgtttcatactttcatctgtcaagtattatacacagagccatgctaaacatattttgttgcacagtcaaagctctcagtagctgggaaggaattctggttgacacttatagcaaggcgctcacgtcattttgctggaaccaggtttgcattacaatcctttgggtttagcaccctaatttatgttgaaaagaatggagcctaaacaatgtaatctatgtcgcctgatcttacaatgttaattttgcatgtcattttcaaatacagattcttgaaaagaggtgttaatgaaaagggtagggttgccaatgatgttgagactgaacaaattgtttttgaggacacaccagatgaaataccacatcagatatcatctgttgtacaacatagaggatccatacctcttatatggtttcaggaaacttcaagactcaacattaggccagatatcatacgtaagttctagactgtcagtctgtcatgcatttgccatctgtagactgtcttctctaatactccaatcaccttgctacctgcagtgaaaccggatgtagactacaagacaactcgccttcattttgagaaccttgcacttagatatgggaacccaataattatcttaaacttgatcaaggtgagaataagtgtggaatacaaatttggtttattctctgatggatttttttttgatagttgacatgtgaatcactactgacttatatatctatcaatttaattgcaatattttttttctgaaaaggaaatttaattgccatattgacgaccttatgttctttgttatcaatctggagtgctcatatccatttcgggtcccttgtatttttttcagactcgtgagaagaaacctcgtgaatctttgctccgtgcagaattcgcaaaggctatacattatattaacaaggggctgccagatgacaaacgtctaaagtttttacacatggatctgagtaagctttctagaaggtagtgtatcgtactccaaggaaatcttatatccaagccattaggattcaagcttgtaattacttgt

SEQ ID NO: 51560 - DNA, 1307 bp, Oryza sativa
aggtagaacctatctgggtattaattgctgatataatgatgtggggggttacccaagctatctagaatctggtcaattagtggttctgccaattgtactttgtttttgttatattattttattgaatgtcggaaaacccatgtctagtttagtaacatccatatttcatatcagccgatcattcataaagaggtcgctatcggacggtaatattttatgtgacaacactggtggacctgtatctgactgtaatgttggaaaaaacaacacaagctcagaattgctcccaatgcaaccactggaggatattagagaaccttctgattctgcaccagagatctctatagaacctaacccgtgctccaggtgctctatccttgtttgaaaacgaattggtggttgctggagaacttcagattgtccatactatgaactaactgcatttttctcatgttcagtacaaactatagcacattgtctgggagacactcaatttcagaagagcggcagaattatttgagaagattgggttatcctgaattgcactcttcaaactttcttgatcttgatctgttatcatcttcaggaaattcttgtgaggaggaaatttatcagaggtaacacatctgtgatttatttgtatatccaactgcacaaattctatccccttgatctggcaactaaaggagtgaattctaggctgagatgttatattactcacactatagtattttatttcatttttttggagggaactgctgtaatggttaacggtaataagatgtttcaaactcatttacaggtcatcactcatcaattcacccatggatgttgtcagtattgaatcaactacatcatacagtgaacagggacacaatgatgaggtcagtcttttcccctcttttctttttaaaattactagaaaaaatgcccgtgcattgcaacgggtaaaggctattttaatattaatattattattattattattattatatcgagttaagatgaaattcactgtgttaaattcgcttggatatatattttgttagaaaatcatgagctgtaattaggtgtccgatcgtctcaagttagtatgtgagtttttaaagagatttcttatacgatttcttctgtatttctaaaagcgaacgaacttacaaactgactcaaaactgtctcaaatacggatttgtatttccaaaagcgaacggacttgaaaaccgactcatacgcggatgacgtaccaaaataccggcaaaaacatcttcactttttataatagtagagatatatgccactcaagcttg

SEQ ID NO: 51561 - DNA, 1172 bp, Oryza sativa
caacaatcacaccaatggcgattgagtagatacagaagttgcctatggaggtaagaatcagaaaattcagtggttagaaacagcttacagcacatccacttgtgaggttcttataatcttattacagtctaaagattgatgaatcaccttctgaaaatgcccaacaacctcagtggagtccactagatgagctgccttgccaaagaaagagtgtatcccagttgcaatgacacagcttcaatctcaccatgcttgcatgttgagccagtgaacactatggtccccggttcttttggtgacaggaagggattcaccagtgagagctgactacaagatgaaggacaaacaaaaatgtgatcaaattatttacacggagcaactagtctgacattccagtgatcgacatctttcgcatgaacggcgtgtggcaattcattttcagaggatctccctcaagtaggcacgcatctgcagggacaatgtcaccaaacctgatgctgattatatccccaggtaccaatgtggaagcatcaagctcttgccactgctcatctctaagaacctggtagcaaatccatgtatacgtcaagatcagactagcacaatggattcgcttgcaatttttaaatttctgttcagaaaaaaaaacctttgtttttagcgccaaccggacatgagtgcagcagctgcatcgcctgcattgttttccttaatgaagctgattgttgaattgataatcgggaggcagacaattcccaggaaatcctcccaatcagtaccttggctctgaacaaagacagtaaacgattgaacaccaaagaaatccattataggcgcttctgcttattcttttcatgaacacacaaaagacttgtgcatcaaacgttcagtaacaaccatggatgtaaacgagagaaaccatgcaacagcagacaagagctgccatgagaaaggagaaacaacagagataagaatagaacactacacatcagaacataatcagcatgacgtcgaatcgttgccagtcttatggccaatccagggttcaattctgatgaaggatttacgcaaaaacaatggtaactagaggctaggtaacagaaagggcaacgataaaaccagaacagaacattgtttaccttgctcatttacagttttctacctaaaagaac

SEQ ID NO: 51562 - DNA, 2420 bp, Oryza sativa
acataatcttggactaattcgcgagacgaatctattgagcctaattaatccatgattagcctatgtgatgctacagtaaacattctttaattatggattaattaggcttaacaaatttgtctcgcgaattagctttcatttatataattagttttgtaagtagtctatatttaatactctaaattagtgtctaaatatagggactaaagttaagtccctagatccaaacagtgacttagcctgcaaaatagcagaacatggcttcaaataactatactccttgattgacagatgctgttctggttgtcgttaatgttggatcggtacgaacagattaggtttccatggcacgtacggagcaaggattaggtttggtggaccgtgaggtaggtgacaccgtgtccgtgtagtgctttgttatgctctggatcttatggtttcatcgctttcagtttcgtttgctctctcactcaacaccagttagtggttgctgacgtcttttctgttgctactattattttaggatcattctgaacttctgaattctgatccttcgtttgtgtcttttccctttagtggtgatcggttgctgtttaatggagacatggcaactaacttcattcgagcaatgtgatgtcatgcatacattaaggttcactaattcataaaagaggatggaaaaaaatagagaacttttacggtacaatttactagcattgaaaaacataagcgttgagctgttcacagcattacaggcattacagttagatgttcagtaggttactgcaagtgcagcatgatgtcgatgttcttgcgacgagtcagtctgacagatgatgcaatggcttaaacataacttaacatgagattaggagttcatgctccatgcatcatctggatcaggaaactggaatggatcatgtgaccaagtaaagagggccaaatgcctctctgcttattgcatgggtcaccttgtcaagctgcatgtgaggcagatagtcatagtcctcatcagcatctgacgatggcgagaagcaggctgcagctgttcgtctgataatccgagccaatttgaagtattctctgactactatctccctagagaggagcggtctgcggaatgcatttctgcatggggaggattcagatgccaaggaggcaattattctgttctgaaactttgtcaagaacgtcgagttcttcttcttcgattctcgatttgcagcttggaggcctgaattgcagaggtattgatcctttgttgcttcatccgtgaactaagatgcagtattgacaatgaagttaaagagggttgcttgcttcctaaatgatacaaattccagaaagaagttcagaacttacattgtcaggcagaccttgagaagacagtaacatattctcaggactacttgaagttgtcttatttgaaacttgagtgcattcttcttcctgtgttatcgttgcttctatgaactgaaacgacgagagattaaaagcttcatcactacagtttcctactttattgcatgaacagtactaaacagtactgtgcgtgctccagctactcccattgtctcagcgaagaagaacgcaatgcaaaaagagagagattcttgcaatatgatccaaccgaatgaaccgagatcaccttgcaatgttcgggatgatgatcgcaactagctctacgacatccagagctcttgctcatcctcatgaccagcttatataacgtgcagctctacaaattcagcttcatgcagaaatgagcaagataaaaccaagacactttctcatgatccatgcaagaaatccaaagtataacgccacttaattaaagaacaaagagagagacagacagccatgaatgaatgaagcaacacaaggtatttggctgcattaccctcgaagtaatggcaggcgagacgctgcaagaagagaggatgagaaatggatcaactcatcaaggccattccggagcaaataggagacgaagcattcaatggggttgattacgatggtatctgctgatgagaagagatccttctcgcatttaaggttggcaatggcagtagctggtatgaacagatcaacaagagacagtgtgtgtacgagagtgtcagcagcatatggtccatgattttgccttgcttctgaagcttttgctactcatcatccgtggcgtgtaacaacgcctgtgtgtatgattatgtcagcgcacgagtgttcagaaaaaaaaaagataactacttcttgtgtgcttgctggtttaattaggtgatctgatcgattgtaaaattctcattccaaagcttcttggctccaagctcctccagtactctgaactttgaagcttcttattcctgtgatttgcagtggctttgtgaatcatgaatgcaaaccaatcatgtggctgctcctcc

SEQ ID NO: 51563 - DNA, 2328 bp, Oryza sativa
  unsure (1)..(2328): unsure at all n locations
tgctgctgctgctgcatttgggagacgagaactcgactcgagccatggcggcagattggtgtttcacggcggaatgctaactagatccagcatctccatagcaaaggtagaatggtagattgaggtgagttttttttcccctcttctgcagttttgatgtattattactgccctcatctgatctgggtaacatatttctgagctcagtagaactgttaaaaaaaggcagaaatgcacaaactcttctcacaaaacaacatacaaatgcttatattttggagcggaggcaatacatggtatattttttaaagtgaaaaaaacaatcagacacatggtattgagtgatagcaaagctgggtgaccacagaaaatacctcctgctttaaatactttatacctgggctgtcaatcctcggagttcctcccaatgtaatgtatgaggaaaaagtattgcagctaaattttaagggtttcttgtacgaaacagggacaatcagagattaagaaactctatgtggaaaaggccatgcgcattttgttatgtgattcaccaaataagatgagnaggcaaagtcatggttctgtcttaattaccaaatctactatgggggccgttgctccctattgtccacgctccttttcttcatttctctcctgcaggatatcttgtcttttgattcttcattttaggtcttataaatatcacgtggttcaggcctccaagtcaaattatcattacgtggaactctcttagatgcttgagaaaagttagctcttacctgtccatagaagctccaaggaagcgagaatagtagatactttggttggccatggccactggtgtttctgttgagaacataaaccccaaggttatactagggccatcatcgatcgctgagtgcatagtcagtaagttgtgttcttttgtggcttgctgattcatattctttatttcaggttttacgatgtgaatatgcagttcgtggagaggttgccatccatgctcaggtttcgtggtttagtccatccatgttctgaaagtcaatttcaatttattctttttcagcaaatgctagaagagaaattaatagatatctcacatttttcttccagcacctacaacagcagctacagacacaacctggttctcttccatttgatgaggtcattgacaactataatttgcagatcacgtgaataatcggtagatgattcataaattttcaactattatatgcagatcgtgtattgcaacatcgggaaccctcagtccttgggtcaaaaaccaatcacattcttcagggaggtctgtaaatattagacaaaaaaaacttcatctttcctttttatgctctttcagtatttacgagttatgttacaggttcttgcactttgcaatcatccaaatctgctggagagagaggaaattaaatcattgttcaggtaaacatcaactgcatgccatgattcattaccaagctatgactatacatatatatttatgttctacactttctacatttctaataaaaaggtatgtaagcacattagggtatttcatttatgtatgatataaatgtttcttcatctctttgcagcactgatgctattgctcgggcaaagaaaattctttccatgattcctggaagagccaccggggcatatagtcatagccaggtaaccatctgccaattcactcaactaggagcatcttgagttcataattttccttatagtaagtttcactataactatgttgtcaaaactatcgatttctgcaaatttaactacgcaataagaatgcaagaatagctgatgatcttatcagaaaattgcaaccttatttgattggtctggatccatctgtcacacacacatgcaatactcatgtcgttgcaagtttgggcctacacatcagaaaccaataggagataaggctgcaggtttctgataaaatcctctgctattgttgcagttgtgtgaaatattcaacaaaagatgcagatttaaatcaaacactgcagtttttgtggaatttactcttctttatcctagggtatcaagggactgcgtgatgagattgctgctgggattgcctcccgtgatggtttccctgcaaatgcagatgatatattcctaactaatggagcaagtcctggtgtatgtcctacctgggttatttctgaagaaacaggaatgtaagatattccagtctgacttatgctttccctcttctaggtacacatgatgatgcagttgctgataaggaacaacagagatggcattatgtgtccaattcctcaatactcattgtactcagcatgccta

SEQ ID NO: 51564 - DNA, 1438 bp, Oryza sativa
ctacagcccaagaaacttaactggtggtctatcagaaacgctcttatggctcaaggatgaaaaattgatcaagttttagcactcaccccttgtgctaacttgtgctgcattccacaccatgtaaactgagatctgatttaaacctattaactgtaagatgtacatgtttggtgtggtgttaatgttgtatcatatcagtaataacttgagatgtaacatggtagtactggttccatggaagaaaggaaaaacatgttcttcgattgaatattggttgatttgattctttacaggctgcagttgcataagtagttacagtaaaaaccacgcaatttcaaatttgagaacacgtttaaatggaattttatcgctacctaatgctgggaaggtatatgcagaaatccttacactcgcattgcaatttcaaaacaatacagaatgttttgaaattgcgagatgccgaacacagctcacgatcaaaatgttgagcagaagaaaatcagaacatgtagcacaacaattcatgacacaagcagctatttgataaactgaaatggtgaataatccatatacaactacagattggaatacacaactgagctgtttccatggtgatcactgaccgctcgatcaattaaaaaaaaattccaaacccagctggtcaggtcaattcctgaagcaatttctccagcgcatcagaaacaagaggaatgtggaggcaatcttggccatcagagtgctttctgatcttcaccagatcatggtctttaaactccgtcaggtgggagttcagcgtcacttgactgcttacaagaaaacgctcacggcatttggtatacaagctactgaaatgcatacctggcaaacaatgtagcaaggtttagtttgtaaacaacaggaagtcataagaaaataagtctgcaacaaacttgccttcctccttctcgtgtgccaactgatattcagcaagaactctgaagacactttgcgcatttggtgtcaggctttgcagaacaacgagggcggttttcatggtttgggcatgaccgccgctggcaagaatcaaggggtagaacacaccttcaactttgtaaggtgcaaacgttgggacgtgataccagctccacttgaactgtgtgtgcaccatcttcttgtcccatactacagttatttgacaggttaggaatcttaaacagtgaaggcattacaggaggttaaagctagccaggaacttacacaaaggtgcattaacatgatctactgatgcgacaacatggacttgcgggcagcaccaaacttgagctaggtactgctgtgattcagcgtcacgcaaggcaggtccgtcgatgttgtgaataaaaaggcatacattgtcatccccattgtcagatgtctggttatttagaaaggagataatatcatctattgattgggatgc

SEQ ID NO: 51565 - DNA, 3801 bp, Oryza sativa
  unsure (1)..(3801): unsure at all n locations
tcttagatccaaatccatacatcaggagcccaaatccgcacgtgcagaagaacatcacatcgatcttttggcttcatccacatcaacatcaacactggaaggattttgggtagcagacgaacctgagctcgaacagccagttgcggtactgctccttgtagcttctcgtcagagcctccacctctctctcgtgcttcggggggatctcagcgagggatgctcgcagcacctgcaccaaatctcgaatcagggcattcgccatggcctcgggaacacgaatcggagggtttccaggaggggcgggttatgcagacctgctcgtcgacgaggttgaggtcggagagcttgccggcggcgcgggcgcgcttcttgccagaggagggctccttctccttggccaggaagtagctcctggagaagccggcctcctcgtcgtcatcctcggacccagagcttaccccagcagccgccgccgcgtggccgcctctcagtgccatcggggttcgcttccgccgccgccgccgccgcgaggatggaggacgagaaaggggaaggacgcactcgtgcacagcctgccggtatataactgtaaatggttcaatacaagtagaaaataacaaataagtagaaaataacaaatagtaacgatgcggggatataactgtaaatggttcaatacaagtagaaaataacaaataagatttaatcttacctaaatgacaatgtaaattgttcaaaaggtcttagataaatccacgggtgggattggtacatcacaagatgcaactcctttttgcttcatgcttttgaataagtaacgcaatgcttgacttctccatgcctcaatctccaaccatcataccatgcaaaaatgtcatatgaggttcattgttgcacacatttttgtggtaatttatacaaatcaatatctccttaattggctaatcacagatattattgaagaaattgatttattactaagtactggtctagtagaactctatagaagggggagagggacggccggactgagggagagccagagaggtagttcactagcgctcaccggagtccggagtccggagggggagggccgctggggccggcgcagagggcgggaggccggagtgccggacgcggcggggcggcgtcgggcgagaccacgggaggccgcgcgaggcggggccgcgggaaggcggcgccaaggcgggcaggcccaggccggggggcagccgcgcggggtgtcctccggcgtgcggcgtcggaccgtcggtggctcggtgcgtgcgggagtgcgccgtgtgggcggtgcggcgtgggactgggagaatagccagctagggttttttttttttttgttgcctgttgggccaagcttttttgataggccaagaaaactgaatacctgctcttttgtgggtctctgggtcaaattctagggtagtcttaggccgagtacctcttggggctcttggggcgcgtagggtaggtggtttatgcggtttatcggggaaaaccggttttcccgcgcttttgctacctcttttcgtggcaaatggctcgatcatggtcgggcccatccagcagtttcagttgggcattgtcaattttgttagcctcgaggatcaatttttcgtgaagcgcctacaaatcgggcatccgatttgtttgtcaaaaatcgggtgttgtttcactaatgaggaaaaaaatgtttcaccaagtagattgaaaatgtttcgatcttttaaaatgctgaaacacaatcaaattacaccatgaaacattttttttacaacgtatgaaacaatgatttcgaatatattaaaatatgaaacaaatccgagtacatcgagaataagaataaaacaccatcgaattgaaaatgtttcagtgctgaaaatggtgaaacagaatcaagtcacacaatgaaacattttactacaacgtatgaagcaacagtttcaaatgtattgaaacatgagacaaatccgagcacatcgagaaaaaaatggaacaccatcgaaaaccacattgcaacattttgatctaactgatgaaacatcatggtacatggactaaaacatcacaatattcaagaggaaaacctaaatctgcctcttcctccactttggtggttagcaaccacaaccgcatcgacgccgcaccgagctccaccgcacccgcatagccactgtcgttgacgtcgcacggagctcggctgcgcagagctccatcgccaacagtggcgggggcgctgccgtagcggctgcttgctcagggaggtggcggcgttcgacggtgtctccgtcatggaggagaagcgtcgccgtcgcggaagaggagcgattggcagtagccactggctcggggaggtggcagcgtttggtgtcatcgccatcacagctgaatgaaacggggaggagaagcatagctgtcgcagaggaggagcgattggcggcggccgtcggctctgggaaggaggcacggcgccgtcgctatgcaacgtgtgggagagagatgagcgagataaaggagaaaaaatagggaggggaaaagtcacgggtgtggaaataggtggttgagagcccccgatattttttgctcacgttgggcgcccaagactgagcatatccaaccttttcacctcttggtattactccatcggcttgttagccgatcggctttctggcgatctacgtgtttatctatcttgtcagttgcaggatcaaactgattggcactcctgtacctcatcaatattttacacctgcactggagctaaaatgatcttctaggccgctatgttcatcgacttagtcagcgccaacatagttctggcaccatcggacaagcgcggatttttgatcaacacactgtcacccagatccccgcacgccccacatgaccacgcccgatgatgtcccctctcgctatgctgggctagcctggacaagtggacaggtggtgagctccgccgaatgcatcaaaatgatcactgatcattactgtcactttgccgcatgcaatgtnacctgcagtacttagtttgtacctgttaattaccatgcttagttacacgtgctatctttgaatcataggttcccccctagaatattcttgcacaaataatcgagtcgaatatgatgctttgttattcgtcttacaagtattagaagttatatgaacaacacatatagatatagatggccaaatggggcacctggcccgacacgccacgtcaaacggtcaggccgggccgggcctgcccacggcctccacntacggcctaataagagtcaggccgtgctagccagcctaaaggcatgacgtgctcatccttggaataattctattttacctccctcattttttggccgcgccttatattccctccctcctctttggcagtgccttatatatgactcaataagtctatattgtgcccctcatgtttcgtgccaggccggcccactatgccaaggcagcggcctagacatggcccaactgtcgggctgggctggtgtcacgcccagaaatttagcccaaatttccagactattttgtgtattaaatccctgtctaggaccagccagggtacacaaaacgacaagtaatatacagttccaaacgtaaataaagcgtaaaatacttacaaaagaggcacttagtcctcgcaccgaaacgaaagcagcagcagcggaaaaaggcgatcctagcggggcttcagctccactccacaggcaaaactcaactggggtctgagccttggtcttctaacttcgtctttagcttagaagcact

SEQ ID NO: 51566 - DNA, 1303 bp, Oryza sativa
gcccataacggcgggcacggctattcgaatagctttactctgatcagaggtgtacaactgtacccacaagacgcagccccctgacacatttccatgcgcagacatgccaccacgacataccggaaagaggccgtgacaggacccttcgcataaccccctctaaccaagcacaccacacctcaggtttcaccccccgtccccagcgggcaacgggcagtcccctctcgtgcctaggtgaatccggaagcgacagaggccgtcgcagggcccgccccgctctatcacgcccacccttgcctggatgcgtcagctagaggaaagctacactacaagcccagccgttgcccacgctggcttgtggtaagtacgataagttcttccagggcatcccgcgaatcggtccttaactgccatgggtgcgaccagcaaaaccatgcacccacagcccaccattcagtcgcattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcatcaaagtaacacaagctaggcgatttattacccatggttgataaaggacagatatcaagtaaacatggcacaagcgagcagataggtaaaaccctgaccccatgtaattagcaaaacatgcatatttatttgtaaacggtaaaacatttataaattgggatcaatatgctcaaggggaatgtgtgacttgccttgcttcttcaaacaatcttccgaactcttatccttgcgaccgtgatcttctgaaacgacggattctacacgcaggcacgcaaaacgaggaaaaactctaataaaaaccaaggaaacagaacataaaaagtaaacaaacatgtagagctcaattttagatgaattttgcaatttgaatggcccaatttggagttcgaatgaattagatatgaattttagaagttttgagccactaaatgaatttctataattattaatgatttattgcgcatttattaaatattttcacaaaggaaaaggactgccgctgacgtcagcaagagagtgggccggcgccgacaggcggggcccgcatgtcagcgagacgaggtggcggtccaccgtggaccgggaccacaaggacggtccaccgccggtccacgggttggacggcccagatcggccaaggccgatcggacggctggggacggccgggcggcgcgcagacggccagtcaac

SEQ ID NO: 51567 - DNA, 1068 bp, Oryza sativa
  unsure (1)..(1068): unsure at all n locations
ttacataaacataactaggcagatatgacgctcggatcgtcactagaattgacttgtttagctaaaacaggcatatcaaaacgcagtacatcacagcagagaaaacagatgcgcccagagtatcttcacgcgctcagaagttctgtaatgcaaaatctcagttggtctggttgttgactcagctaaggacagggaatatgcgagttacatgctcgaacggaacagtttcagctgtgttcttcttgagctcagggtgattgaactcgttgcgtggaaggacaatcagctgagatcgtgcacccttctcgatcacccaaccggagtttgcaatatggtgctccaggaacttgtccaatgcaagaccctcaatgttgatggcctgaaaagaaaagtaatgagtttcagccaacaagggacaatccatgtgcgaggcaaccaataacacctaaatgatagcaaaatttggatgatgatggtgacacttctggcgtaacaaatatttgtagcattagtaatatgaaacttaatattaccacgaatccttggtcatctaaagtttaaacaaaaaggattgaatgaaaactcatgctccctcgaggactcgtgtaataattaatttaaaatgacatcatttacctccgcaagaacaggcctaggaactttctggtatgtcaaggagagcacatgtatcgcataggattggattgcctgctcaaaacctgtaaagggattagttaagtaagccttcactagtgtttcaaaaaaaaaaaacacttcaccattaggtcaaacggaaagaatccatatcaattgccataagaaagtgtccaatatagcaaacattcataaaaataatccataggtagttcatgttagattaaaaaagaatcctcagtngtcagtngaaaagatcaaacaagagttcgctcaagactgcttgatatggaaccaatctctgggcatctacgatactaatacatactcatttacatgacaatgcgggcatgaacatgccacataaacacatggtaaacgtctaaacgatgataagtcacaaagttactttct

SEQ ID NO: 51568 - DNA, 3215 bp, Oryza sativa
cttaatcaatatgcgagatacaatctgcacactcaacctttctggttcgaactgcaaagggaaacgcatcattaaataaacatataactcgagccaaaatatgggtaaaagcggtttgtacagagatggactgtcacctggtacagacgaagaagactaagatttgcatccaagttatatgtttggttggaaacctatatgaaaagaaaaggtcggtaaatttgaaagcattagaaccaaaaacttatgctggaataaaacagatgagctacaaaagatgcatgcacatactcacaatagctagagcacaaaaaaaaaggtctgttgagtttgtttctttatatgctggaataaaacagatgagctacaaaagatgcatgcacatactcacaatagctagagcacaaaaaaaaggtctgttgagtttgtttctttataaatcgtaagccaaacagcatgtcaaatattgatatgaatgtgtgtcatctgaccgaaatctccatcttgccactttcatgaccaacgacaacagatattatcaattgaaaatccatcagttagcattgagatgactgacaataagatttattgatgtaccaaacagcaaccattctctttacaagtgctgccgcttaattcacaactcctccacaacgatgtgctccactacagtctgcccgaaaaaaatacacaaatactgctatttctagctatcgccatagcgcatatgaatcaggattttttttttcataggagaatttaacgatttgcggaccatgtaaacatgagaaggcgcgaggctttttcagcacagccacggaccaatccttcgcaaaattccaacaatcacacgaacaaaatcaaacggggccgcaagtatcccatggctagggtttacctgatcgttgacgaagccctcgaagtcgttgaggatgtcggggttgaggggttcacggcgacgagctcctccaccgtgtagctctccgccgcctgctcgctcgccatctcggggaaccctaacgcccgaatgctagagtagatctcgcgcgaaaccctggagcggcgagaggaggagaggagagaagtggcggcgcggcggagggggaggcgatggagaaaagggttttcgggttcgtgcgaattttttcgctttagtccctcagctatccttatactcctacttcgtgtgccgcggatgcaaaaagatgctggtagaaatgcgcatgtgcccttccaaggtttggttatttcatggacacccctgctaataaccaaaggtgtggcataagcaacaactagaattgctaatcctaacaaaggtggtgttcttttcttttaaagatgaagataaagatagtattaagtgttttatgtaaaacgagatggtattgaggtgttattagttaagttttaatcaatacaaacttgatgaaaaatagattaatttgatatttgagagcaactttcatatagaaagttttcgtacgaaacacaccatttagcagttgaaaagcgtgcagcgtgtatcaaaaattttatcgaacttttgttggagaaaagaacaaggccttgccacttttgaaaaaaaaaattgaaataggagcctttagaaaaaagtggatccattttattcattccatgataccaatctattaaaagtaccatgagttcatgaccacgatttatttttggtaggaaccatgatattgatactagtaaatcccctcgagcaatcacatacaatggatgtgatgacacgaattatatttcgtcttttttacatgcgggacaattatacagatgatgaacatccttacgatcctatcacctactcctccgtttcatattataataatttctagcattacccgcatttaaatatatgttaatgaatcaatacatatatatacgtgcctagattcattaacatatactccctccatccataatatagaaacctataactagatgggacacttcatagtataatgaatatggacaggaagcatgtccatattcgttgtactataaagtgtcacatccggtattaggttgttatattataagacggagggagtatatgaatgtgggtaatgctagaaagccttataacctgaaacagaggtagtacgtaattattaaatctatcacaattgataataacatgaccttaatttgctcatgtttgaaattttgttcccatgacaaaccatctgatgaagagctgaaaaccaaaatttagttgctactattatttatttctatattttacacaccaatctaaaatactattgttcctcacaaaattaaagcttgcaaagtcacaaggatacaagatccacacacacaatcccacaaactttacacaggcactttgcaggcttgcagcacaacgcccagttgcagctcaaaagcaagcaaggcaaacggacgtctggcccacatgtcagcctcacagtgaaggtgaaacaccatatggcatagtgcagagttcagacttcagacaagctcaaacattcagagttcagttcagcaagatcgtcagtcgagcagaagagaggcctgcctgaccaggtggcctctgcgctcgaacacctgcctcctgcgcctctcgaggtccctctccacggcggcgatctcctccatctcgcggtcgcattcggcgatcatcgccgcatactgcagctgcagcgccatggacaggggcaccatgtttctgctgctgctcgcgtcctcctccatgagctcaggtgtggcgctcgccatctgttcgtcgcgaggacactgcttgatcttgcactttgccgcgctcagtgcttcttgatctgcgacggcaacaagccaacaacgccaatacattagtaaatctacttgattcttcgaaatttgttggtttggtttgatcgagttcgctcattttatcaaccttgatcatcattcatcagtgagaatattggaatcctttctttctttcgcaaaaatcgagctcaaccgtatgatatgatgcgaacagggcaatgctccatgctacgagcctacgagccaagtttctccgccagcacacatgcaaattcaaattcaacttctactcccgcaacgaaaaaaataaaaacgaaaaaaaaataaattaaactataactagttaacgtatattcacaattaaattgttttattttattttgagatgtaggagttaattttaaacatgcatattt

SEQ ID NO: 51569 - DNA, 1086 bp, Oryza sativa
  unsure (1)..(1086): unsure at all n locations
taccattggatatggtattatcccaatttctccgttgcccccttgtgtttcagtgtttatgtgtttccggtgctgcccatgttgtctatgttgttgtaatcacgaactttttctagttttagattttgttcctttccatgtcatgcaaaggaagttcattcctaacctattcttacgctgtgttcggcagctggagaaagagagatagtttgttttgttttccgcgcgcacgcttcccaaactactaaacggtgcgttttttgcaaaaattttctataggaaagttgctttaaaaaatcagattaatccattttttaaatttaaaatagttaatactcaattaatcatacggtaatggctcacctcgttttgcgtatcttcccaatcttctcaatccccttctcctcaaactcacctagtatggctgtaagaagttgtaataaatctagaatgtgtagataatagcacatcttgtgaggaatctttgggtccttcatctgaactttgatatttatgtcaatgaagatgctattaatctttntaaagtaccagacatgtgaattagttaagggcattttgtagcaactagttattttcctcgtgtaaaatctttatgttctgtactggattctttattcaggacaaggtttgttcactaagaggggatttaagggcttgttcagcacccagggtcctctgccaaggttaactattgataatgtgaattcagttcttctgtacatgaaaatcatccagacaccttgctcataacataaatttatcggatcaaagttttgcagttctctctggcgtccattgtctagttgtgtgcctgttgagaaggctgcgtggcaaagatgacagtatgtgcattgttttagttccctattttctgttaacatcgtgctagttttttagatgtaacatcttggtagttgaatatatagcactaattatgaattcttcatttgcagttgttaatgctggaatagctggttgttgcactagccttgctttgagctttccaggtatgttctcattgaatgcacatggtattttttgggggggtatgatgttctatggggg

SEQ ID NO: 51570 - DNA, 730 bp, Oryza sativa
ggcaaggcaaggcagccacatcagaatgcatactctgttttttctcctttttctgtgacagcaattcatgttgaatgtggacccaagttcaagaatgttatgtatcatgcttttagttcaataaatatcaataatccatctatgattttgcataatttccagtgaacaaagtactaatgatttaaactacatattaatagtagtgtcctgctgtaggtttaggattcaatgaataattggattgtgcttctgcaaggtaagcagagttagatgggagttgtcatttctctctgaatttattatttctgttcttaactgctacttaaattagtgggggtctattgttactctctaacagataacaagattgatcttcagaaaaattaggcgaacacaactgcttctaacattgttgattgaattcagatgcagctcatgttgattggcttttgcttgacgaggtcttaccagggagaagaagttaattatggcaaccctgaatctgcatagcattttaatgtctcactgcaacacgttgtctggatattcgtaaaataacatagcagtttccatcattttgtcttgagcaatttccattttgcatgaatttgaatgcctgatttgtggaaggttaactatttcagcattagtttattgagttctcaggtcgaatgaaataggaaggaaattagcagtggcactattaaaaaatacattatggatgtgtgat

SEQ ID NO: 51571 - DNA, 4904 bp, Oryza sativa
  unsure (1)..(4904): unsure at all n locations
cgttccctcggcaggtgccaagtgtacttggtgtacgccgacgctgggtggaggaacaccgggatgtagccggcgagcatggagtcgaacgtcgacttgcgggtataggagtcgccacgcggctggatgcagaacacgcggaattgatgagcttcatgatccggcccggcgagtttcccaagtgggtgcaggacggcgacgcgtgcactgctcgatgatctgggcgcgcacggtcttggtgctcccggggcgcggcgcgccggcgaacgcccagagccaccggcggtcgcgccgccgcatgcggtcctaccaccggagcacgtcggcgtctaacaaaagtttatctctaactctacaaaaacacgcacgtatgccttcacgcaaaacccatccaaccgcagcctgcggcgtgtatgggcctccatctgcctccatctccatcgtctcttcgcaaaccagtagctatagctagcaccacattgatttggttcttcgtgacaacaggctgtgccatctatgaagtaaagcaatgccttccctgcccaacgaggcaacgatacaccgccatgcatgcaaagcccacgtgtagtacctgttaactcagcacacaaattcccaataaagcaattaattaagtaaatcactaaccaatcagcaatttggcaaaccaaataacccaactatcctaattacagtgtcaacagaccggtgcccagccggcgggtgtacatgtacgagctccctccgcggttcaacgccgagatcgtccgcgactgccggctgtactcgaggtcgatggacgtgtgcaagctcgtcatgaacgacgggttcggccccgcggcgctccccagcggtggcgcgctgccggagcgggacgtgtacgacaccgaccagtacatgctggcgctgatctaccacgcgcggatgcggcggtatgagtgcctcaccggcgagagcatggcgaggaagaagacccgcgacgcccggagcaagctcgctccaccgccgccggacttgtcggacacgacgctcgccgccatcggagcggacgtgcgccctcgccttctcccgcatcgcagccgccgctgccgcttcctcccccacctcgccccgggggcctcctccccagcagcgccgcccggcttgcctgagaagagaagggaagagtgagagagaaatgagaaagggagagaatacgggagaaagagaggaggctaacgtggcccaagctgacatgtgggacccacgtgggtcccacgctgactcagcagccacgtaggataaaaccggggtcaaaaccgtcgagggaccttttgtgaccggttttaattagttaagggacgcgagatatctggttttatggtttgaggacgattttgtatctcgatgacaagttgagggaccttgggtgtacttttccccgcgcaaaaaccaactgggataagttcacttcagatctcttattttaacagagttcgaatttcatccctaaaccataatatcagatatgaagagtcctttgacttataaaaatcggtgcaccaaagattccaagacattatactctcatgttttagctaacgtgacgagctgacttcggtcaacccgactgatttagtatgggacacacatgtcataaaaaaaatcactacccttcttttcccctgtgtctctccggatccacccaccattgacgccgcgagttcccccacgaacatcattcgcttcccccgcatcgtccccatgaacaaccgcgcatcaaagctgctcgattcaatttgtgagcaaatcaatctaaagaaaatgcaaagatgttgatttagaaggaaggaatgcaaatgtgccttgcttggtgaggaaggtatagaaatcaatgttggggtagaggtagtcatcgatggagtactcaacgagggtgtggacgtccttgccatacctgaagagggcagggagaaagaaggcgacaacgagggtggtgactggggaagtggggagcgacatgctacggcaaggaaggagcagctagaggaggaagggagtgttggtcgtggattggtagggtggttgtggcgtcgtggagtaaggcggcgaccaaccagggggagggggtaggagcgacagttgacgggaaggcgctcggcagggaaaaagacggtcaccgacttgaagagagacggtgggtgcagcagattgtaagggcaggcagctgaacgagctcccatgcttgcgtctgcacctcacgtctccccggtgcccacagcttgccacccatctccccctgcccgccactcgttgagcatgcccgcccacatccagaggggaagggggcaatgctgctagctcatgccatcggcgtgatgcccaagccacaacaatcgcccccttaaaccaccttgcctccaccaccactgccctccacttcagcccttgtcgccgcctcctcaaccaagccaacccgctttgtagggctcatgtgggtcctatttaccacattaaccaaacccgggaagcatactatcttgagatttttggtatactggttttattggttaaggaattcttcatatctgatattgtggttcaacgatgaaattcgaactcgacgactttaaaaagaggaacataaagtgaacttgttccaaaccaacgtctcatcgcggttgcggcccttgtcgcgcgcgtgtcgcgggcttgcaccttgcggtttcgcgcttgggcttttacctgccggcccggcccagcggccagcgaattccagtgataaacattgtagcgttcaccgttatcgcttcctgcaaagtggatggataggataccatggcgtttnttctcactttggtaaaggaaaaacccatcttgcagccgatgacgacctgacaggttgcagccgcagagcatggctactttcaacgctgattgagaagcaaaaaattttgttatccatcgagatcgatcgaagctttcattcatccatatcaagtcacgatcggttggttttatgttcttcctccgatccagcggcctgccaccatcaaattcatcacgatgtgttcgctcctgataaaaccacgaatggattggcacgggtcacacgagtggagctagaaacactaaaatttatactccctccatttcacaatgtaaatcattcctattcattaacatcaatataaattagaaaaatgttaaaatggcttacattgtgaaaggaggaagtatttactaataatactatttttaatttattttttataaaagctacagtgtgtaattttacagaaattgagagagggccctaaatgataacatgaggaggagtatcatttatcacctattgactgcaaacctcatgttagttaacttaataatttcatcaatatggtaagcctgatctcacaagctgactttttgtacccatacctgcatgcttctgttgcaggctggtaggtagctaacgctaactgtttataataatccaggagcatcttaatgaaagcaaaattatgcgtataatctatcacacaagtgggcacgaactcatcaagttggatatataccacggtcagagctgggctcttctctttctctcttctggcgccaattcagaatgaatacagctaatccatccatgccaagtcagcaataataatccccaattctgttccaaggaaaacggattatattacctcaactagatgcatgacggggtgtttgaatcagaaacaagcttgcttagcttgatcagttaacgtaattaatccggtcggaactagtctaatcacatgctggttaaacatgctaatcactcaacgggtgatgctaattaaacgaatggcacgtacgtcaccggcgatcccgtccaagagaaggccaaatcggaaactgaaatcaagttgctgctgatctgatctgaataaatttaatcagaaaagcatgcgttaagcaagcgatggaaacagcatcacgtattaacgacatccatcgataggtatatatcggggtcgtgccagccttactgatcatctctggacacggatgatgtgcacgtaattaatctaatctgattgacgagattaattgcgtgtgattaccggttacgttacttgcgttgttttgcatgcgttgccctgctggggtgaatgcaaacacacagcatgaacagattaaaaaacaaagaatctgttagttagttctacgtgtgtacggagtggatgtttgcttcctaaccatagttattaatttcattagctttaggattagagcacatggtgaaataacgatggtccggattgttgctgtgcagtaacagggctttgctgttgggtgccataacaccggtcagaagtccatatattttaactaagggtgtgtttaattcacaccaaaattaaaagtttggttgaaattgtaacaatgtaatggaaaaattagaaatttgtgtgtgtaggaaagttttgatatgataaaaaagttagaagtttaaagaaaaagtttagaactaaactcagtctaagagaagttatagttgccttcactctaatcagggtggaagaaacacactatggtcggtcatgtttgtaacaacagctctacattatttaggcttaggtattttgaatcctaaatccaaaaaaatcatgaatttgaagctgcgagtacatcgatactacttggatgaatcattttatttttattttagatgaaaataaatacttttaagatagtacagtagcaatgggtgtatggttttaactccataatcccgtattcgtcacaaattataatcgactattatgcttgcttaaaatgcccctagaaacagttctctagcattgatacagggtttattttgtttcctatacataatactactcctaagaaaaccgatcgtaagttgttgcaag

SEQ ID NO: 51572 - DNA, 1883 bp, Oryza sativa
acggtttatctccatacagtaaacgatgagaagcttagctgcttgccttttcagaggccaaaacgactaattaaactgcctaaaaatttaccatctgatagctacatatgcagattattggtggtcaaaatcatgaccgattgacgccacaacatgaacggcaacttgaaaaaaaaaagaaaagaaaaacatggtgtatatatacattcatgaaacctgcctagaatagatgatatatatatatatatatatatatatatatatataacttccttaacatctgactatggtgcaacaacccgaaagggagagaactataaaatatttacagaaggaaaaaaaaacatataactaccaagtaccgactaattgaagctagcattattgtggtcaactcttagttaagtgctactctagtagtttgtatacatagtatcgactgtttgaccattttgacttggttggtttgtattttaggtatcatatatgcatcttagaagctattgacttgacccgtggaaaagttcaaaatgccatgaattgttttcttggctgttgggtgccatttgcatttgattaaaaaccaatcatactcccagatcattcataaatattgaacaaactaataaatttatccttgaatttaaccaatgtaagaaatataaaacagaacagtatatggctgatccatgaaattcacacgtacagaagcgatcgaaacaggcggatacgatttcagacaataaatgaattttattgaatttcatcatcagacaaaaaagaatgattacaaattaagaggtttggaaaaaccacctttgatcatgcacacatcgatcgtacagatcgtacatacggacctaacttacatggtcccgttcttggatatgatttgattcctctcccggtcgcggccgagaccagatcgtagttcgagtcctcaccaaatcaattccccagttcacatgacacatgaacacgacctaagctagtcctccattattattaactaacaattaattaatcagcccttaataatcaattaacttaattacttttataaacaaataacgaatcttattatatcattttatacgactgaattaacggtatcttgattcggtgtacgggaaggatggacggccaggattggctactcttccttgtagtcctggttgttgtagggggcgaagagctcggcgaggaagttggacttgcggtggacgcgggagccgaggtcggcgcacatggcgtcgctgtcgtggatgctgtaggtggagatgcagtggcggcggtagaaccgcgtcgtccgccgcatcgcctccgtctcgccgtcgacgtgcctcaccatctcctccaccgccggcagcgcgaacctcccccccagcagccccgccagccacctgcacctcagctccgacgtgtgcaggttcgacacgctctccacgtaccccacgaacgccatgttcggtatcagcggatgtatcgtccccctacacacacaaaaaaaaaacactcatccattagctaattgtgcgtgtgcgtctgcggtgtaattggttggttaacatgtgggtaccggtagaggggcatcatggaggatttgttgacgacgaggccgcggaagggctcggggaggacggagcggagcttgtccttgccctcgaagccggtggcgaggaagacgaggtcggcgtcgacgtgggtgccgtcgtcgaggacgacgccgttctcggagaagcaccagccgccggcggagcgccggaaacggatcaggtcgcggtcggccatgtcgaagaagccgtccggcaggatggccatctggcagctcgcgtagtcctccacgaacgggtgatccggcctcaacccgtacctgctcagtg

SEQ ID NO: 51573 - DNA, 895 bp, Oryza sativa
aagaccccctcccccatggtgaccaactcatgctgccaccgcgctctacattctaatcggttgctcttgctcgctcgctgctcgatccgttcattaatttgatctttctttttttggttttatttcttttttcggcggagcagaagcagaagaggcgtaggatcatcgaggcggcggtcgtggctccctcgcctccgaggaggtctcggcgcctcgctaatctccctgaggtcaagtatgcagaggtaactgctttgctttggtgttccatttacacagtaataaatgtcaaggagaaaaaaagattcagtaatattcagtcatagaaaaaaaaaagaagttcagatacacctgcttcttgttctgatgcatctggttctaagtttaaggttacaaattattgagcgtgattttcatacgttctagccgtggctgtcaatccagctagtgcaagctgtaaaaacggcctattgcacagtgaagaagctgtatttcacgttttctgaccaactgaattgataaaaaaatgtgcaaatttggtaggaactactgagcattaaataagtctctgaaacaaaccattcttagcagaacttaacaattttcagtaaatggcattttaaattgtgccattgttcctagcatccacatatgtaagtatgtaaccatcataagaaacatcttttctgtactaagaagtagcatttgtcggcaggtagcaccagatggcgcagagaggatgaaaaggtatgtcattatgtgataacaataacattaccacatgagcgtatgaagcctgtattgccttccactaagtagcaaaaggtgcaaaactacatcccgttgtccgatttcttctgcaggtcttcacgaaaagcaattgacagtatctacc

SEQ ID NO: 51574 - DNA, 1301 bp, Oryza sativa
catcaaactgtatctttctgtacataaatgtaacattagattggaaatgatcatctcagatattccttcctttccagcatcaattaagtttgttcccctcagtcctgtatatatatatatatatattttttttttatgcaaaagcaataccatcagcatataaaatggatccaaaatgtgaagactttgttccccaatcatacctcatgtcaagttcaggtttgtttttcaggctctctggtatctggccggtgagattgttgttgttcaggtatctgtctttcgcaggagcaaatgcatgaggcaagtactaagagttatcagctgtttggacatgcaacaaaaagagggttaggatacttacagctccttgagattggtgagtgttcccagcgatgggctgattggtccacttaactgattgccctcaaaatgcctttccaaattcagaaaagttagtatgatggaaatgagtctcctagctaggatgagtagtaatcaatctcctactgcctatccattgagcttacaattcttccaagatgtgcatgctgctcaaatcaggtatggagcctgtgagtttgttgccaccgaaatagctgcatacaatttcaacaggaaaattagacccaagtgcttatcccatttgatcattcggattcactctatatgatcgtgtcaatcttacatatttttcatcccagtcaaatttccaatactgtcagggagcgatcctgaaagaccatgattttttagatccctgtagtatacagaaaatggatcatatcatcacagcaacaaccaacatctcggtagcttattcactgtcaacaccatatgagttcataggtgccaaaccatgtcaatctgaacacttacagtgatacgacgcgcacgggtgatccctcggagcagataaccccggtccacgaattctgccgcggcaggcaaggatcgccggcccagtccggcggcgggttcttgatgctcctggcaagttcctccattgcaaccactgcacaagcgaagatcctaaaccttctcatcacccaaaaattaatctcacatactgaatctagctagcacaatgatgaacttttaaaattttgctttgctcaaattttgcagaaagaaactgcttgacatttggagatcagcctgtctatcgatctggagcagggtttttattttcgaaattgctttttctttgggggttgggttggagggggggggggggcgaaatttcagaaagttcgattttttttggccgaaattatttgaaattttgactgatttttaat

SEQ ID NO: 51575 - DNA, 2128 bp, Oryza sativa
gtacttgtcgaagtcggtggtgttgtacatggagtcgtcgaggctgacgagctcgagcgcggagatgaaggggctggaccgggtgtcggcgcggcgcgccaggcacacgctcatcgtcttcccctgcgcctccgccaccatctcgaagtaggtcgacatgccccgccggaagttgtcggtggtgttcacggcgctccaccgcgtcccgtcgacgatctggtcgaacaccggcggaacgtcgccgccgtcgaacccgccgtagaagtaggtcgtccggacgaggtaccgcgaccccttgacgacggggagctggtagcagtacttcctcgccgtcgcgtcggggaagtagcgcacggtggcgagcagcggcaggatgttcggcttgtcgacggcggacatgttgccgacggcgatgaacccctcatcctgtatccacttgatgctccctatctgctcctccttctccgatccacagtttatatagaaccctataataacatttcgatcacccaccattacacgtcccatttcttgcatgcaagaatcaattactccgtgtttgtgatataattagtggcttaaacttttttttctgatcagttagatataatcaagtttacataaacaattagcaacatatacaacaacaacaacattagatatactatgattatatatgtttgttttgtagaaaatatttttatattcttttataagtttaacaaaattgattatttaataaaaaagataaaatttattataatataaaatggagggagtaccatgaattacctcgaggttgtgggacgacggaggcggtggcatgggaggaggcggtggcatgggaggaggcggcgaggaggagggggaggaggaaaagcaaagcaatggggataggcatcgtaatgtcataataggattgggtgggaggggagagagcaatggagcgcgcccacgaaggggaggctccgcgaaggggacgacgcgaggaaagggggctcacgaagggaggccactactgtttatggatcaccgcgcgccacaaacgggtggtttttgcttccttggcttttcaacggcttccgcttaaatttagcaaacgttagttgaactggtcaatcttaagtgtgcgtcatgggccttgaaacctctttcacggcccatgagagaaatgaggcccaagtgatcactggatcaaattattgcgagtggattgtgatttgggcctaagttttactttggaccaccctcaaatcaatcttttcactttagaatcagatagttttgtatattttttagtttggatgatcagaaaattttatcaattttttttaagtttggatcatccttaacttcttcaaacacccataaataacctcaatcaaatcggtttcggtataatggtgaacttccccttttatatgctgctcatatctatacatgaatagtaaagagagtggggtgatccaagccaaatactataggcaaagttatccggtctaaaatgaaaagattggtttaagtgtgatccaaagtaaaactttgacaataaaaaggtgacttcattttactcaattatttacttgtgattgaattattcaccgagggcttagtaaatctatagtccctgtgcgtgtatatatgaacagaggttaaagaagagagaattaacggaggcccaaaattctaaatgcggccagccagcccatcccagcccagcccagctaagctagcaagctgccacgtcgtacggggacgggacggcggcgatcgccggcgaggcaatctactcccacttgcgggggtcggtgatgttgatcttccagtggtggtcggagaagccggcctcctcggcgaggtgtcggtcccaggcgatctcgatcttcctccgctccgacaggcggcacggcgagcgcatggcctcccccatgtcgtcgtacacctgccaccaccgcgcgtgcgcggcgtcgctggcgtacacccgctggtcgccgatgttccagttgcagtcgtagtcgcggtagcacgttcacggcttcagccccaggtagtggatcgaccacacctccgcgggatccgcccggaacagccgctccttgagcgcccgctccgccgtagtgttcgccca

SEQ ID NO: 51576 - DNA, 2842 bp, Oryza sativa
attccaactgaatagtatgaatatactgtataatcttagcttaaaacaaactagaagtgtcagacaagtcaaaaccaccaaagaatcaaatcgaattgcacaaggtaagatcaagcaataaacttaatttgcgacgatattgcgtacggttggtatagatatctggtcatccgccatggagacgaatgtagtagcatgcaatgcaagtattaattggttcatgcacaagctatctctatctatccatctagagtagtatccatttagctacacgcagctgtccggccggctggccaccaaccgaatctagtttaatcagccctgtcgaccgatcgatgtagtatgcatttgttgccatcatagtgttcgactgatcggacggttggaggtgaaaggcttccaaccagcttagctgcatgcctatcacaagttaggtgaaagaggccccagtctctgcccatttatcatcttcttctaattaatctatgagtggtcgtcatcctcttctaattaattaatcttttcttgattaatctgtcaatgctcatccatcgatctccatgtgcatcctgatctattaacatgtacaaaccgtactgtgcgtgtggcatcctatgagcaattgagtagtgtgctaggagtacttatcatcagatcaatcccttaagtaattaatatttagtgctagtatattttttttatcaactgtgaataatgtgtgttgatcgattggtttaggcagtagacctaggccctagatggctagatctatctgctcttgcaaaaacaggttttagcttacttagctctcgctagctagcttgtggacaacactgacagtgatagatccatgattaccagtagaagcttccactcaggtgggatgccactgtgctgatcaacgataggctagctagctagtttctgctggtacacactctaatcaacctagagcaattaatcaacacctgatgaaccgtataatctgaagaccaacggttgcaaatgcagttacgaaaaaggaacagatttactgttgcaccaaccggatcgatcgtcagtactcctatgaatataatagagcgtcgacgatcgaacaggactaaacacaattcaagttgattgattggaggcttcagtttcaacctgaatcaacgaatcgtcacctcgatcgatcgatcgatcaagctatagctagcaagggatcagattcttcaggtttggtaggaataatggggactactcgatcctagtgtatgttttgctaaagagaaagtcgagtgatgatgatgaattgatgatgagaaccttgtccattatcagctcgtggcctttggcaacatttcccgaccagattcctacgctctttgggtggctttgtcccacacacaccctcgttaaatcgtcctcacacactgatcatgcatatattcacattccaagcgcatacatccctacaagtgattatgggacaaaagctgattggttaattatgctgtgcttgcttgattaattgtgtgggtgtgctgtattgatgctgatcggttttcattaggtgacatgttatgcgtctaaccagcagttgggaacacttctctgaattgaatcatgtcttagtctgatgctaatgttctattttccttagtctgatgctaatgttctattttcctgcatccgttttttttttgttcttatgtgcatgcatggccttggcatattgaagtatttttttttcaaacacaaaaagtagtaaaatccacaatagatttttgttttgcataaaaacttgtaatggaaaaaaatgtcccctttaaactaggtgtttactaccttttttataattcgcatatcctattggctaaaggttactgtaaaccattaattgatggttggagtaataattaatcattcagtggccagttctccacagatactaacggaacagactgaaaataaacctaagctattgatctctgaaacttctttagctattctgcatttctttaaaatttctcacatgtgtatcctgtctcagtgtgatcatgatatattctctcttttagtttctagaagctgaaccacatatgtgccaccaatttttctcttttttcccctttatcacctgtcatatttcccctactttgttttcatgcttgactaacatgcatgcatggcgtgagcgcgtgcatctcacggagaagaaaaccaattaaccagggtgcgagcaaaaaaaaaaaaacaagaaaacattttgatccctcaaagaacaatatcatctaaatagttattatccctttgtttcatattataagttgtttgactttttttcttagtgaaacttctttagttttaattaaatttatagaaaagatagaaacaccgacactaaaccagtctcactaaattcaacattaaatatattttgataatatgtttattttgtattaaaaataaacttaaaaaaaatcaaacgactaataatatgaaagagatggagtattgtgcttagcttacctccgggtccccacagaggtagggcgaggttgcatgagccgacaggaagccggagcttctgcttcagccgctcgacgtcgaccatgtacatccaccactcgccggccctccccaccggctcgtcggaccggaacaagtccatcatgggctcgcactcgctgcgcaccaccacgcgcacccggccgccgccggcgtcggcgccggcgtcgggccgcagccccttgcgcgccgccatgtgcgccgtcacgaggtgcacctgcagcctgaacacgtcgcggttccacgcggcgtccgaacggttgcacggcagcgacgccaccaccacgtc

SEQ ID NO: 51577 - DNA, 1486 bp, Oryza sativa
cggcatggcgcggcgaggcgcgcgcgaaggacgcggtgtgcgctgtgcgtgcgtgcgtgcgtgtgcgcaacagtgtcagtacgtgagaggcaagattgggggcaagtggttgggtacggtgagaaaggatgggggtgcacccaactgagatgccacgtggcgagagtccattcaatccatgccttctcgaatctcgaggacacttgccacttcagtccccctccctgatgatgatcaagctctacaaattgcgtgtactagtgccaatcatgacgtgcgcgttgtgtgcaggagtaattaggatctgtttagctgatcgagctgaaatgcaactaaacagtttcttcatcgtctgaaataggagcgaaattgggtgtagcattttcattaaatgaactagataggtggtgctgagttttgttttatttttttcccttcagaaccatagatttatatttttctccagctatattaacatataaaactcgcactgactttcgtttaaaaaaaatactccacagctccactctatatataacacctaaaactaaatttagaagttggaatttacaaaatagatccttaacaacaatatttgagttaattttgcatcgcggtgatcccatcccctctatctcgatctctacctaggatcatggctcacgacctcggaatacaagagcatatcatgaattaaaaaattggcttaaacaaattatctcgctctatacaaacatttttttgaaactcacatggattgtggggctcttttttatatacaagaggagcatttggtaaagccaaaattttagaaatttctaaccgatgatccttgaacgtgcggacgttgatacctggtctaaataaaagcagatcgaaccttaattcccatggtcaaaaaggcacgaatcgctatgcagaataacaagagtgaaaacattattactccgtaccagctaggttcctgctagcatattgcactgttagttgacaggagccagcaatcaactttgtttatgtggtaattaagcctagctatgaaagggtatgtagcctagtggttatagtgacttgagtagtaccccaaggttctgagttcaaatctcctatggagcgaattttagattggattgtttgcggggctaagtttcctatttcaatggccgtatatatccggttaaatatagaggatgggtaaaaaatacccttctctagaaaaaattaggcctagctagagcacatattttaactttattgttagtattagtactagctctggttgtctatcactctgctgcctctgacatactgatctagaacacacatgttctctacttctctgcagtcactgctactgacatgtgggccctactctcttcgggccagcatgtcagtgtcagcagaggatctcattcctccagtcaatccatgtgtgctactccgttaaaaaaacgaattccaagctacaaacctaaacacgtttttt

SEQ ID NO: 51578 - DNA, 2838 bp, Oryza sativa
atgtcgagcctaattgcgatttgattaatcaatttttctcatccaacgatttaattatgcgtgattttaatgattcgatcggtacagttttttttctctttcttcagtgctagtgcttctactagtattcgtgacaataacctgtcggatttggaatatatgattgctgatgtggtgtcgtttttattaacaagcccttgtacagcaaggtacggttcggttgccttgggtcaatcaagagaccattcaaactgttcagggacaggaacaagaacagcttcactctgaatccgacgcaatcttggccgtccgattctgatccgacgtcgctggattagatgaccgacaaaaaaccagagaaaatgttttttgggcgccaagaacatgtacaagtacaatgacgccacacctaggagaagtgatcctaaggcttcctcgatcagcttcgtggaatgaaatattttgtaattaatggaggaaaaataggatcgaaattggcccaaaaatggtcattttccgttgcaaacagtatatcatttcactggaatatttggtaggaacaacatacctctctgacaagaacttccaaggaatttgaatattccaactcaacaaagctagcatgattggtttaatgccaaatacatgaaaattaagtattactcatttcctggagtaccttaaataagtacagttgatttaaggccaaaattaagtgtctaatctagtgagcagccatccgtaactatcataattaaggagaaaaaatatcaccggtgccctgatgtgccacatcccgattaatgctgatatgcatccatctatccagctattatcagtacacaacgtttcatctctcgtaccaaactgacatgtaagctttggtttatccctttcccttcaccttcaagaatcccaatagaagatggtcagatggatggataagctacaagcatactagccacactgttgctgattcgatcttctgaaatgctaagctgatgatggtgccaacaatctcttctctgcacttcggtccttactgcagcaaaagataaagaagttttaaccatcctgatgacctgatcagaatcttcctttttcttctgttcttgttttctagtgatctttcatgatgcaatgaatgagaagaaatatataatatactacttgagaatggagatcaggtgtgatgaacacaaaagctttctggatttaaaagtgcttcctgatatgcattataagccatgtgttcccttttgttttcattgccatctgatcagatgcttccatccaagttacagaggggcagagatgatcgaattggttctggtcgtacatacacgtcgtgctcaggcttaaacactgcgtggttttcacacgtggaaagacgacgacgcacaaagctggaagtaatccacatttagcagcgatcataaaaaaagcagctaattagttggaaccaatgcttcgaggctgcagtacgtctcctttggtttcttttctctttggtgttgctcttctcatttcctttttatctttttccttctcctttcggtatcagtgatactttcagaaactttactccactgtaatgtaagaggaataaatttcagacaaatctatgtatgtgacgttggagagagccgtttgaggggattagtgaagttacatctcacctagaatgactgtttaactggtgatttgaggcataagaaagcattcctaagtgccagctaagtcatgtaaaaatttgcttacacaccaattatattctaatcttttaaccaaagaaatgctacacatggtactattaggtgaaaatgtgttctcctttattatttgcactttatgtgcatgttctacttctactactgctggttccctactctcttttggtcttgatatactgttacttgcaatcaatcttaattaatggccgacaatatctttacaaaagttttaaagaaaagaaacctctactggatgaattttcagggtagtgcttgatcaaatctaagaggtcgattacacatgtacctttactaattattggcagtagtagctgaagaaaggcaaaggcaatgttccattctttaatcatatggttttgaatgcaggtggcatgtatttggaattattaggctatagtcacaaaatgttttttggctggcacataccatgaaggtgattaaacatgcatggttggttgcatagtctaggtccctctactacagcacacaagatttaacagcaaaagtttgataaaaaggtgagagtgaaatgagattcagatgagagtagtaggattgctggttacaaagccttgaaggcaactccatgcccaaacctaacctaccccctgcattcttattcctcttgtgcccatggatggatgatcacttgaacaatagttgtctcaattttttttctcaccaaatcctgttggatttctttgtctttcagttaagaaagtttggggatgaaaagttctttgttcttccaacatcctccaggagagcacaaaaaaaaaaagggtgataggttgatggatgatttgacctggatgcttggagggctctaaaggctttatttcgtagtggaaatatggttgtggattttttttgcctcatatattcatttctcttgaagaagacgatacattcagtatatttatttgtctggaaaaatttatacgaaaaggctctgatgatcgattgagctataattgataagccgtagaaaaataatcgaagcattaaaaaaataattattggtaaaactttatgtgtattatcagcggtttaaaaatcaaggctgtaaaatagacttcgatgg

SEQ ID NO: 51579 - DNA, 2545 bp, Oryza sativa
aatatcttctacatagtaaagtttaagtgactagaatccttatttaaaaaaatactcggtataattaaattgttgcaccacttttttatttattgtatcaaaatcacacgctacattgtaagttattgcactcgtacaatcacttataaaattcttacactaaatacctgtaagttgttgtactaggatactcatttaccaaattgcactcaacttaggtagtttatgcatcatgaatgtaatttactcctttttaaaagtttaaactttggccgtagctgataagagacgacgagagccaaagtggtagctcaaacaagatcgagaatgctggtacagtttagctcaagtcaaaccaaatcctgtactactacgcaatttagacgatttacctactgctatgtgattgctaaatggaatcctcttcctgtctcgtcattacagtatgcaatgtaaaagagaaatacagagtaaacgcaaaaccaaagaaattgtgtgttggggattgaacaggtgactttggagttcaaaccacgtacctctttacagtgcattatgctgcgttcatttctccaacaagagttgaatgaaattttagatattcgtggcacgctttcaaactgttaaacggtgtgtttcgtgcggaaactttctatgtgaaagtttctctaaaacatcagattaatttattttttaagtttataataattaaaactcaattaatcacatgttattaccaccttattttgtatgaaacactcaattttaatcatcttcaggagattcgagtgcatgtcgaaatcggtgatacacgcggttctggtcgacggcgacgagaatcttggtgcgattgccgggttgctttcggcatcttttcgcctgggccggcggcggatcgacgcaattaagttaacaaatcggcgtccggcgagtggccggctagccgccagcttcaactgctcgttcagagtagagatcgacctgtcagaatgttgggtggagcggagcgagctgaggcgcgtcctgtctcgttctcgtctcgtcgccgtcgacggcgcacctgccgatctgatctgatcacgttttttttttttttttgctccccttaatcatgattgagttggcgtgatctgatcgcacgggaaaccgcgagcagtgtgaccggcgatctgactgacggagtagtggctactggctagagcttgatagctttgcagatcttgctgtcaatcagccaccggtgtgagtacgctgtgcttgccgttgcgacgtcccgtgtctccggccaccgcgcggaggcgagcttattcgtcatcgtagatttttacgtatccagcgcagcaagaacgaacaagatgccgtcgtccgcgcgttccgcttcgcccatcagaccgcaaccaacgaaaatcctgcgcccccggcggataggattttctccgaacgcatagcctccatgtctgccgccgccgccggaaagagattccccgtcgacgcgaccatctcggtcggggctcctacttctccgccgatggggagacgaaggcggcagacggaacgctgtactagccttgtttggagtgcttaaaattacgataatctactgcttggtagctaacttttgaaaatctggtttatggtttcttagtttattttctgtattcaaaatttgggtgataatttggactgtatagggtgtgttcggacccaatgattcctcaccctctccatcgtattccgcgcgcacgcttttcaaactgttaaacggtgcgcttttttaaaaagtttttatacgaaatttgcttaaaaaaattatattgatctatttttgaaaaaaaaaatagctaatactctctctatactagtaaaaatgacgtttagaacagcatttagcataccaagaagtgattaattatgggtatttttccctgtctacccctattaaatatggttgcgcgtaagaatcttggcagggacaagttggtttctaggttttgcatggcactgttttgggcaggcttggatacttggttggctgcatggcgctcgtgcaggtggcgtttaggcgcgttttttgtttcgcttttttagtttgggttcactgccgcgcgtgatgctgaaatttttttgcatggcgctcgttaccgctattcgcgcgcctatcccgtggtaattttttcgcgtgggcgtgctgagaatgccgacgcttaggttactgcttgcccatatttatacgctaacttgctttcacgtttggagtactgagccatctcatcttctagttctaggcttctagctagcttcctctcactattgcagtacacatggccgaagatggcgatggcgagtttgcctttgatctgaacgagcctccgttggagcacggcaatggtacttttcttctctgtttgacaggatttttcttctcttgtgcatgtttgtacggcaactgtgctatctcttcttctctatatcgtttctcatatcattgttttccattttttttaactggttttgatttgaacttgccactaaatgaatttggtgc

SEQ ID NO: 51580 - DNA, 908 bp, Oryza sativa
agagttggagattatgtgagaacctgtagctgctagaagcttatgcccgtaaagacaaagaaggtgctagttcaaggcgccatgctgggccgacccaggggatcagcccaatcaagggctttctacaaaggaataagtccgatttgactccctttatgtataggctcaatctaattcatattcctcaacaacaataccacataataccaggtaatattttgacatctcaactgttaaaaccattgtaatttaactcccttagcgattttaaatgtggtttcctaacgtactctctccgtttcacaatgtaagtcattctagcattttccatattcatattgatgtcaatgagtctagatatatatatctatctagattcattcacataaatatgaatgtgaaaaatgctagaatgacctacattgtgaaacggaggaagtaactcgtttcatacgagacccacatatcagcatccattcttcttcgtcttcctctcctctaacttccttcccgggcagcagttccttcccctcctcttctacaagtgacgaatagcaccacgagctcgccgccaccggcgatggccccccctcttcatagcgaacctccactcaactctcgttttctttctccggttttcctcctctttgcctctttggtttcccctcagtcggggtctttggtaaactcttgcgaggacggtggccaggagtggcaaatatgcgtaccatcatacctgtacacagcgctgaatgttggtttgcacagggaagtaagaacatgtatcatcagtaattcagtacttctcaaaatttgcactttacacaccatgaacacaattatatatggtcattttacagatgttggatatcattctgcaaaattggtgatctttcattctcaatatc

SEQ ID NO: 51581 - DNA, 751 bp, Oryza sativa
tattgtcaacctaggccttgtttagttacaaacttttaacttttcaatcacatcaaaacttttctacacacgtaaactttcattttttccatcacattgtttcaatttcaaccaaacttccaattttgacgtgaaaacacacccctagaatggcgatgaggacgaagctgatgtggagtttgatggcgacggagccatcgccgtcaagcacgcaaacttatctagctgcgactcctgatgttcctggccgtgatcgagctcctgcgttcttgcttaatttgagtggtcggatcggctactgagctggtgcggcggcggcggctaatcggcggcatgaggatcgcggtgacgggcgcgacggggtacctcggcagccgcctgtgcggtgcgctggccgacgccggccacgccgtgcgcgcgttcgcgctccgctcggcgggcggcggcggcggcggcggcgacgtcgaggccggcctgctcccggcgtccgtcgagctggcgtacggcgacgtcgccgacgtggagtccctcgccgccgccttcgacaggtgcgacgccgtcttccacgtcgccgccgccgtcgaggcgtggctgcccgatccctccatcttcatcacggtacgtgtacaatcttttaaaaagaaaagaggattttaaaaagaaactcgcgaaagttttcaagcaattccgaaaaatatatgctctataaaattgatttggtcatttggtgttaaaaaaatgggcatttaat

SEQ ID NO: 51582 - DNA, 1988 bp, Oryza sativa
  unsure (1)..(1988): unsure at all n locations
aagggtggaagatcatggcggcgcgaggcagctgagcgtcctcgacttccatagcgccgccgcgccgcccttcttcatcctcatcggcggcgagcggacggaacagcgtcgagacgtcgacgcggtgcaggccgtaggacggctgccgccgggcgatgccgtcgagcaccagattcacaaatcgccgggggctgttcattctcgccgccgccgccggcaccgccgccgagagatccgatcccccggatctaatctaaaacgggacgagaaagagcctggatgaaatcgtaaaaggacgaagggaaagtagtactactccccttgccttggtgacggcccaagagaagaccggagagggagtaggcggagactagggcgttggaggccgggagcgaggagggaggacccccagcttgagggcggcggcgtgtagggtggagacgtccggggcggcggcgccgggggtggtggcggcggagaccagtaggcgagggagggagagagggtcgacggggagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgatgttctgttttaacaaacatcatgatccacacatgaaaattcgtatacgtagggatcacaaattgaaatcggttcctatcaaagaaaaaaaaggtgtagttttgcattgtatcggatagcggggttgatgcgacaactgcatggaaatatattggttatattacagtaatgttagtttcattttaaattaagcaatgttattgataatcaagacttcaatcctaaccgatgaaatgggatgcaatattcttttctcgaatgcacatacacgtagtcgtaccaactctatcactataaacgcattcaaaaatttaggttagaagtcaccgcagatacttcttaccacaaaacttacctcgaattaaggcacctttaaaaatacctgtctaataaaataatcacaggtcaccacaagcattgtttacccagaaagacatgaccaatttaccatatgcgccatattaaaaaactagtctagaaatcaccacacgttaccatatgccaaattcatatcctctactcagcattatgccaaagttatattgagtagaggagactcacacattgtcggacatgttgcactataagtagcctagctaattaatttatacttaattcatccgtataaagtaatttatgatagacacactacgtgtaaagaacacgtaggccaaaatcttatatttctaattaacattcttgcatatatatatatatatatatatattaaaatcaaatagctatatcaaccatgcgaactaatgagcacnctcccccccccacttccccgaatggaacttanacaactgccagcaaactctccccagcttgatcattgagaacactcaaccgccatatatcaagcaaaccatatcatatatctagctcagaagatatttggtaatttaacactccttaatattggtttcgattatttgacatattagtccactttcattcatcttagatggttctacatgttatcctcaaaagtatcaattgaagcaacaggacaacgaaaaaagtgttaaattatcatttttttccaagtttggtaggtaaattgttctaaaaaaaatgtttgctaggtaaacattatgttttagagtacaacgcaaagcagcatgcgactatgtcctcgctcacaacgtccattttgcaagtagaatcgtatcaatttgacagtgttgtaatttgaactcaagaggattaatttcaaaacaacgtgccaatcttcacgtgctcccagcaatgacacacgggtttgtcacgtttcccaaacttagcccatcaaagaaag

SEQ ID NO: 51583 - DNA, 1499 bp, Oryza sativa
  unsure (1)..(1499): unsure at all n locations
tcgctcatgtccgtgctgtcgtccgccaaccacgaggtgaggtccgggttcgagctccgcgtcgccgcgctgctcgccgacatagaggcggccagcgccgcgcgccgcgcggacattgtgtcggtggggggcggcgccgtcgtcgactggctgctcgagagcgtcgtgcgccgggccacgcatgcggaggccgcgcgggcgctcgcgcacctgctggccgatccctgggttgcgcctgctgtgctcggtcgaccacgagcggttccctgcctcctccaattcatcttctcttaccagccaaaacgcggcaagaaggtaatgtcctgtcaggtgctactcttgaattatttgctttgcttggctgccgtaattgtagctttaacagaataaattttgcaatcagtttaaattattcgagcatgccaatgtagctggctctaatctactaggtgattgttgttgtaaattctgtccaatctgcaagataaagagagaaaactctgaatgtttatattgaattgttagtttctttctttttagttgagaattaatgatttggtgtagcttgatttgttcttgtgttaggaatttcagtattgatatgctatgttataggaatcagatgttgagatgtgcatcagtacagcctgattataggtggaaaacaaaatttgcatcctcgtgtgctctgaggtttctggcatttttatgttttcatcccatgtctttgtgagcatggaacctttggcccttcaggttttcagattgcaaactcttaatatatgctatggatgttaagataaaagatctcagggggaatgagttatgttatgcacctgcatgccagttatgcaataatgcagttatgtctaatggattatcaagaccttggagttggtaaatataatttattttccttgatggcttggtgatctcagctctcctataggcaatttctttttttgcttgctggcagtgctttttcttcagcttatctcttctttttttcccctatacatgtagtattatgtttcatgcgcatcttaatctagcaatgtaggtctattaaaccatttagattttccagttctggtttccttggactttaacacaatatgagttgtttgtacctaatatattgccctcctgttaatacagaactcggaatactcttcattcaatgtctcagaccattctaaaggaaggagcatgcttgttgctgcacttatggacatcatcacttccaactgcgataatgcggattattcatcatttcagcctttattgccttcagatgctgatacaagagatattgcggcagccatcgaagtcattgagcaaggggggatgcattttgatgaccatgatgataataacagtgatgatggtgacagtggattaaaaggnatagggattaaggaacttgaaaggnctactgtcttgggattctctagagaaataaactcattggaggtgggcaactcggatgatggtattgt

SEQ ID NO: 51584 - DNA, 1772 bp, Oryza sativa
cacgatccagcggttgtgttccttcttccatgcaatcggctagaagatcattgatcccgagggactagatgaactccaagcagaacttgtgagaaccctatgtcatcttgagatgtactttcctccaactttctttgacataatgaaacatcttcccgtgcaccttgtgaggcaaacaaagtgctgtggtctagcattcatggctcgcagatgtatccttatgaaaggtacctggggatccttaagggttatgtacggaaccgttcacaccccgaggggagtatcatcgagagttacaccaccgaagaggtcatcgatttttgtgtgaactacatgtcagaaacatcttcaattggattaccacgatctcatcacgaagggaggcttgatggtgttggtactgttggaagaaaaactgttaggttggatcagaaggtgtacgataaagctcatttcacggtgctgcagcatatgactgaggtggtgtcgtacattgacgaacaccttgcagttctccgacaggagaacctaggccaatcagagagttgggtcagaaataagcacatgtcttctttcaacgagtggctgaagaacccaattgccaggtttgcagaacttgtctagtgaaacacttcagtggttgtcacagggtcctgaatggagtgccaccacctggcaaggatatgacataaatggatatacctttcacacggtaaagcaagacagcaaatgcacagtgcaaaacagtgggttacgcattgaggctgctagtgacagtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgtttgttctcgccaaacaagttgttcaagtgttctacatagttgactcgtgtaacaagaaactacatgttgttcatgaagggaaaaggagaattgttggattggacaatattgcagacgaggatgattacaaccagcacgtccacagcatatgtcaagaaatacctctagaagaggaggaagaagaagatgacgttcaatatgcacgcgtcgaccatgaggaaggattatttttgtaatttatgtacgtagtttatgtctacatgtcttatctatatgactctaataagttcgcaatgatcaatagtatattgctgatgaaatagtcaaataaaataattaagtgaagcacccactagaagtgaaataaaataattaaattagtataaccattggaaataaaataataaaattagtaaaataattattgtgcaattactactgttagtgaaataaaataattaagaataacaaagatattagtgtatgtggaaatatgttaaggaaaataaaagaactaagtgaaataaaataaaataaaattgttgtaggcaaactcacctgtgacgggctcttattgcggggccgtcacaggtgacctcacctgtgatggcccagactgttgggcctgtcacaggtgatgtcacctgtgacggctccacagttggggcccgtcacaggtgacatcacctgtgacggccccatcgttggcgcccgtcacaggtgagtttgactagggttgacctagggttggacctcttctagatctatccagatccggcacccactctcactcactcactctctcgaccaccgccgccctct

SEQ ID NO: 51585 - DNA, 3233 bp, Oryza sativa
gacgccggcctccaagacgccgcctccccgacctcttctccacgaccgctgaccaggtacgacgccccctcctcctgaacatgagatgatgaatggatgaattgcagtttggatggatgacttgcttaaattgaatggatgaattgcatgattgatgaaatatatgcatatttgagatgtgaaatatatgaggtgatgaatttgcactgtttgtggatgaaatatatgcagttttagagctattaatctttttgtattagatgattttaggattaattttgctgcgttggctgaatgtagcatgattttgaattttttctgcactagtatagattaattttggccagtgatgttatgtggccctgctactgctcttattgtgcctacttgttcatttttttatctacaattgtttatatacatgatttatataccactgctattgttgccccctgtacttcttgttaaatggccaaggatgaattgctcaataacattctatctatacttgttcttttctttatggataagaatagattatctacacttgttgatttatatacccttgttgtctatgtgaatatccctctgttgttgctgtttatgtgaatttccccctgctgttgctgtttatgtgaatttccccctgctgttgctgcccctgtggcatatatacccctactgctgttatatggccctgctactgctcttattgctgctattatatggccctgttgttgctattgctcttattttctgcacttgctcttttctttatggataagaacagatgaactacacttgttctattttatggattgataagaggagactatctacacttgttcttttttctagattgataagaggagactatgtacacttggttcttttttacactttactttgggttgctttttctcctagcacctgatttcctctttttttttgccttcatgcaaatgatggtaattcatgcataatttctgagcaaaactgaggccatatctttcatagtataccccgtattatattggatctaatgctatttagtataatggttggaaatttataagatttttcgcgaaaattagaccatgacaacgcccagcgcaaacccgccctccccaacacctgcgaggatccaggaagaagcaaacccagccacggagacagttgccgaaggttatccctcgacaacgacggtcgaacaacccgaaattcatagtaatttataggataaattttcaccacatgaccacataaattttagctagcaccccttagcatatgttgccttctgtttgtgctgcagaattgccgcaggaacaacatacgtcgatgtcaggcgggacaactgcaagtaggtcgagtagaaatccgcggtcacaaaatatatggccgaccacagtgcaagttataagagaggttgacgctagtggtaggcccacggcgcccaggactgtcattggaagatggtctaactactgcgggctggcggcacgtgagaacttcgggatcctccataaagatatcggcaaggtcacagaagccgagaaagagtgagcttggacggcaatggagaaatggttcacatttccagctgaagcaaaggataggctcaagcggaaggcattccagaagatgggcaaagcttggaagaattggaagtcgaagctcttcaccgagtttgtcaacccgcccggcaatcatacgccgttcgatgaataccctcaaataactgaagcggtgtgggaggaattctgctctctcaagaacccaagagtttagggaatcaagcgaggcacatcgcctactgcaatagcggaatgagcacccatatcggctgggcactgcagggtacatcggcaaggaggcaatatgggcccaagaagatgcagccactgcagcagcaaatgtccctgccccgttttcagacatccctgaacaaagagctcgcaactgggtgtgggcaaggggtaaagtcaacccggacggctctgtcacatttgagaacaaaagtgatgttgtcgtctatcaggaactggtgagttcactacttaacctaactaatttccgttcgtataaagtagaagttcgtataaacgactcttttttttctagttgggcttggttgctgaacaagcttcacaaagcgaggttgagtccgcgctgaggaggcgcgaagatgacatcctcacaaaggcgctcggaaccaaataacatcctgggcggactaggggaattggtagcgatgtgccctggaagcatggactcccgcagtacagctcccaatacaggaaacggaaagtctccaaggaagagagggacgctcgtttgaaggccgaacttaaggttgtggtcattcaagaactagaagctagcatgaacgctagggtggaagaaagggttaacaaggtcctcgccgacatgaatataccccgaggcacaacacctgctgtgcatccaactcctcgtgcacaacacgacacgagtccatcacagcataggagtagttgtgcatccacagaggtgccggcccctggtctcctggtcgcaccactagctgcagtggaccacatagaggtaattgatgttatacaatccatatctattaaaaaaaacctttacacgttccaatattaaattcagactttcacatatgcagggtgtagtacagtgtgtcctactggcgagggtccacctaactttcgctcccaaagtcactgagggcatggcgttcaagccctcggttacagacaaggtccacggcgcagacctgctagctgggtatgccaaggtgtccatcgatacagtaaaggacacctggtcaggctatccgctgcacgtgccccccaatgatgaaatcatgactttgggcgatgcgcgcaagacgttcatacaatggcccaaagaagacatagttgtgaagatgactcctcgtccaagtcgaccgatggagctcacacctcccaagtctaagctatcaattgaggctcctcgtggaccagcattgtcggtacctcattctcctggtggagctgatatggacttggcagatatagctcaaagcttggctccaataaagaccacaagaaaggccaatagctccccaccacttgtcaagggccagaagcgtgaatgcggcaaggggaaggtcggggagttggcgccggagccaaaaaggggcaaggctgcgacgtcgatgccgatgagcaaagcggggaaggtcg

SEQ ID NO: 51586 - DNA, 10292 bp, Oryza sativa
  unsure (1)..(10292): unsure at all n locations
tgagggagtcatccatagttggacatcacgaccaccatccgttcctatcattgcctgcttatataactataggctttgatgacctcttcgaccttttcaggatccggaagttagacactggtcttctaaaatgctactccttgtaagtgcataccttctatacttgtgatatgattggactatatctcctaattaaattagttctaatacgtaaatgttttaaggttttgttggatcgagagtcgtcgccttggtaatcaggttgggttccttgatccatccatggtgaacgaggttaatttacgacagagcttcactgaggtagttgactatgtcaagcagtgtttatgggcccatcaagacaaggagtacatcatgtgcgcacacaaccaagagtaagaggacaataccctttgtgtatattatttttgaagttaaggttattagtactaacgctacgtagccactacgcaggcgacattggattctcctagtcatcgtacctaagtggagtagggttacctaccttaactccaataagtccaaagattatgatttcactgaaatcaccaaggccttaaatatggcttggggcccatatgtggaaaagggtggtaggcacaaggagggcaaggacgaactttaccatgacaccaagttcgcatgcgcacaacagatcggagaccaatgtggtttccacatgtgccacaacatgtcaacacttctaagagaggtgaaagatttcgaccctgaggttgttgctaatggcgaataagctcatttcaataccaacattgctattcaaaacgtgctaacatcttatttattaaacagaaaggtagagctggcttcaagatctcacccatcaacccccccgctatcagaggcgaagtgtgcgccttcattctggcagaaataatgaacaagaaaggacgttttcacgtcaaatagactcatgaacttggctagataatttattgtgatgtaaaaaagatgttttcataatttcttgtgatgtaaacaaatatgtttttatggagtgcaatgtaatttactttcatatgtgcaatatttatggtagtttactaaattgtcatcaaatttgatcaactatgatttacgttgtactattcatatgttttctcctttttttccttattgacatgctgtggaggtcgaggacaatatggctttaatccatttggtaagtatatatgcggttatatgagcaacgactaaaattgtggctttcaaggggtgtgaatttgctgtgcaaaattgtggcatttgaactgcatatgtgaatgatgtcaatttttgatatggatctgtgttgttggggatctgtgatgtttgagatggatctgtgattttatattggggggtgactggaatatatctgtgatttatctgtgtttcagagggcatgactagcaaatcctgaggctagccaatatttagcatttatttttttttttggaattaactcatcagtgacgggtcggaacaaaaatccgtcaaaggtaacatcatctgtgacggactagcaaataaaggcccgtcagaggtgacctacctgtgacgggcctttacttttggggccgtcataggtagatcacctgtgacagcttctaactacggagaccatcacctttgacggcctttatttaaagggccgtcagagatgtgtcacctgtgacgggtcccaactcgccttaggctagcggagaccaacacctctgacggccttctagtaacttgcctgtcagagttgggtgtcacctgtgacggccggccacccgtcaaaggtaactggactcaccagtgaccactgatcactgaccatgcatgaagccgtcaaagatcagggtttgggcccgtcacaggtgacaatggccagtgtagtcgaatctaagtttccataatccataaataataaaaaaaagattacgcatcatagaattatcgatcgaggatatgcttacttagatttcccatccctgcctccgagtgggatatttatcaccgtgcgtggcgtggagactggagactcgatccatccccgttggatcatcactacaggcggcgcgcgccgcctgtacacagctagcttaaattttaagggcacacacaatatgattccccgcaaaaaaaaaaacctgcatatgattaatgaaaatcattgctcattgatagtatttgtagcaaaagttatcagacacctaaactaccncagttgctagtaattatagttacagcacaatcattttttttgacataattacaacaaaagttcctaatgacaattaacccatacgaaagagcactacaacactgaagataatccacattcattcaaagccacaccaccgttggttttcggatgaccaaagggttttgcactagttgacctactttgcatatcaaatacgatgaaaaggtatagctgcactttaaactgttaaaacatctatattttcattgaagggctaggcatttgtcatgctatggttaaatttgcttccaggaaatcttaaaacagaaaaccaaaacaaatgtttcaagcattcaatggaatcaccctctgcctctcgtcctccaccaattaccttttctacaccaaaagctcaactaaatttcagtacaaactatgggtataatataatgcactcggtaccatggggcctacataggaagagcaaacaatcagtattatagccatttcatctctaataggacatgacagtaaaataaacctggaaacaagcacatgacggattttatccttactatattaattttcaaaagatatatttgtggcacgggatataattttttattttgtcatgatacataggaggaaatctggtagggttaaatttcttcgtgattcttttttaagtgtcactaaacatggatattatcttaaaatcaatttaatacattaataatgcattcagtacacgtaacggaagaaaggtctaaaagcctaagcttatttcaactattaaatttgagtcatatcttagtatgattcaataacagagaaacaacgaaactatagtgaaagtatacaaatcatcaaccttcaccaagaccactttaggaaatcagaaatacaatactacggatggacatccattagtgccaaggtgggctcgatttctgtttataagaatcaagcttggccgagattgctgaactgacaattacgacacttacccaatcctcttgaaaataatatcttgtctccttttgatcatagatcaaactgtggagaacaaaaatgttggttccaatcctcttgaaaataatatcttgtctccttgtgatcatagatcaaatcgtggagaacaaaaatgttggtttctgctttcttcagattctgcagttaatgaccataaaaattaatgtgtatgataatgatctggtcagacattgcacaactgacaccaaatattacaaatcaatagcagcgcctccttaccatttcttataaagatagtctagggaatctaataaaaaagaagcctgctgaaagagaaagtcgtaagaaacaagctccaaacatcagaagactgattttccaatagacataattagtgtccccttcggatgtgtttcctgttttttgtacactttaaatgaagatgcaatggacataaaaataaagagcttatcattatcaccttagtagtaacatcaactggaactaaagatcaaaaagttctcttcagctttttaaccggaactaaaaaataatctttagtttcaatttttattcgaaccagaactagtgtagtttttggtgacccaacaaagatcagtctccggcagtggatctgaacggtagaagcataatggatcctcaccaggcaccgactgccgtagtgtcaccggccacagtgctttgatcagctgaagttctaattgacttcttgattgaacgttccatctataatctgttctttttcccctaaactactacgtcaatacgaattacccccataatctgcaaaaccagacattcgacatctttattggtatttcttacgtttacagataaatctacaagtgcactgataccgatatagcacttcactcatgaatattcttaagggtatcatatttatatttcacagggaagacagtgtcgtaaagataattatacatcattaatcaatctgtaattaatccaccataatttaaaaggggtaagataatataattaagatagtagactcacatgagattcacctctgtattaatgtttagtagaaaaaatattagggaattatgatacaactgtatttttatactaataatgtttaatatataactagtacatgcttacgatataggactaagttccaacacccaggttatttgtgcttctatactgaggaatggcctttagacaaaccgatgggctctgcggtggttttcgagtcactagagccgttttcatcctagtcgcgacgtgtgttatgtgtatccagctgtgtactgtgcgcggtggccacggccacacgcctcagcccaactgggtactggtaacggctagtccgccgcgccacgaaacctccaaaccctcgcctcctctcctctctactttcttgcaaccatccatcctcgccgtctccaattccctcgtctcctccgcccgatggcctcccacatccacgccgcggcggcgggggacctccccctcaccgggatgcacgacctccgcctgcgcccgcggcttctccgccgggtgctcgccgagtgcctcccgctcccggatccggccgcggacctccagcccacgcgcagccccgccgacctcgcccgcgcgctctccgccgtccgagagcagggactcctcgccgtcgagggcgcggcggacccggggctgctcgaggagtggagcgccgccgtggacgcctgggtcgaccgcctcgtcgcgctcctcgcgagcgacagggtatgtctccgcgtctctgcctatcccctaggtttccttcctatacctgcgagtgcgatccgatcacgtctcccgtttttgtttcgtcaagtattggtgaatcattatgtctttgttgggggcggaattcaccctattttgagattttcttttatgctggatgaccagtgccaagttccgaatttttcctttggtagtttggtttgatattagtacgacgtgaccaatgttagatgctcatcctctcttgaggacgtctttcatactaggcaactgtgaccattaatcaggcaagttgcaaatcaagaaaggaagcacaattgttgactctgcaacctcaactgcacatagaacgcactgtacttcatcatctcttctgtttatcagcatcactgagttcttggaagttcagtctctggtgcactggggccaaggcccaagagtatatttatatggcatattcgcattcactgtcaatttaatatcttagatcatgtgattatgagacaagccgtccacaactctgcataagaggtttatttgagttaggtcccttttgaaatggagatttgtatatgttttacatgagcagttgaatgatcaaatcccttagggaccaaggacagttctcgcattttaaacaggtctaacaggtgttgatgactgtcacccgattatagaccaagacgctatcacatatatagttgactagctaaagctaatgacagtagccgatgaatatgtacatgactaaaacataatgatatcaacagttcaacactccagcactgcaatttacacaaaatttcaccaattttatagggtatgaagatgaaattgcatttgtctgttgattgtttgaacatttgtcttagtgaaaatttcaaccattttaaccctcaatacttgttatcacctcttagataatatatggattatctatagaaaactgattcatttttctagcaattatttctgctcgaaaatataacttaatactgttattatgtgcttgggagattgagaaattaaggcaggtagaggagaggacctccctggttgccagcactggaaagcctcaacagcacagaggactgagtcacgagcgcatggcaaaatgagggacagagagagatagattgaacttgcttgatttctcaatagatttggccgccattatatgataggttccccctaatagatgaggattcaaatctttgactccgaatcgatgacaactctgactcacactcttcttgatatccttctcatgtgcctaggatcatgactccccaattgggccactagctatactagagctcaacgacatcatctctccctgcagagacatcttgtagtcgagctgaaatgagggattgctgtagatcatcctttttgtctaatacagagaactccagtttgtgatattgaggaccctagtgccttccttgtcatcttgcgtgcatgctggagttgtagcagtgctatttcaatcatgacaccaagatactgttggcatcaccataaaccttcatcttctcgatgtgtttgaaatgtgctttatgcctatccaggtgcatgttgattgtgaagagctgagtgttctccgtatcaagctgcttagtcttttcttcaagcttcatggtgttcttcagcatggtgccctggattccaggtgtgatggatcttgacactgataacattctgttgtgtgctggggcaatgagagcaaatagaagagggatctccctggttgctgacaacatattattaggattcaagttgcttctagcatcccctggatcaggattctatctttgattgtgaagtccgtgacttgacaacaatgatgactggaccatgattcttggagttgacttgactaggacttttgtagatgaaaactactcccactcagactctcttgcgatccttctcgtgtccccagcactgcgacatatgttgccttgccccacgctagactgctctgtcctgtgcccggagcatgattccctatcttagctatgggctgtactgtattccaaccataacaaaccttctgctggtatcttcttttgttttgctatgtgataatatgataactcaacaaattaacagtactataactgcacttttactaatatactaccctattcaaattttggtcaggaacacagttgttgggtgggcacttcttttcttggtttgacatttgaagagtgcagtgaggaccgctttgcaaactcatactctttctggtttgagaagattatgaaaaaaattaaggtaacatacatattttaatgcagttttaaatacatgtattcacattttgtaggtttcatgcattatatttctcataattctgttgtgaactatatgtttttttttttcacttttttgcagttctaatggaaaagaaagtttgacatttaagttactatatgtgtgatcagatgatagtgaattttgctgttataaatatttagatattttaagaatgtgcagaagaaatgaggaatcctcagtacaactcatgcagacaatgttgttctaaatatgatttagcacactagacattctattgaacaatctattttggtcttagtaatcgttgatcaataaaattctgaacagtgaatgcaaatgaagaagttgggttctggttcaactctatccttatttctttttgctcctagatccagaacattttagtttgcacaccttgttagaaggcaggaaaaaacagtccaaacttcaaatgcttttggaatgctcaaaaacaaactataagtgaaggtcaatctgaatttttttaataggagggtctatctgaattaatgtaggcaaaaagaacttttatgtattaggattcttatgttcctgtttagttattttcctgaaatctaggaagtaattgatcagctcttataatgatccacagagttgtttctggtcttcctgtaatataaaattacaatattgttctatttcaagctgtatgtgggactgagattctgtctactttttaaaactacattacctttattttcaattcatattactgatacatgacatgccaaataattataaatcaagtcattacagtctgtgactgagtgactctctacataaggtgcttcagaacataactgcttcaaacagttgtatccatttcaattcccttttattgttactaatcaaattaacatataatttgttccaacacatgccaatctacaaacagaagaatggtatcatctaaattattctgtttatgttccaaatttgattatttatgttgtattagtatataatatggattgtctcatgcatggcatggctattgtttcttggaatataaactgatagattctctataatactttgagcaggtcccatctagcaacaaaatggtaagcatagccacttgtactgctatggctagtctgtttatgaggtatgtgacatgtatggctaactgaatttttttgactatcctattggggagtgcatttatgatcatttaatagtaaagcataaaggaatacaaatgggttgcaatgtttcaacagtgagtcaacatctatcacgtgtggttttcatgaacacatcagctatatagagctgcaaaaattgtacaagtaaaataaaaagaatgcataggacatggtaataaaatgcaaattccttcaaagagaaaatatatacgaagatgaggttaaaccttgaaattaagcacttttagtggcattctaacgtcatttcattatggatgtaaaatattacaactccttactatctttgtttgtaaaatttgtagtcttttgaactacaagtttaaatgtgcagtttggtagtttgttataacctatacaggttgtaacttatacttgcccaaagtattattatatatagcatataaaggcccatattcagcaggtgtaccagtggcaaatctagtacaaaagttaccgagggtcctatacgtactaatgatctaaccattgactaatatgataattagcatggcataagtcaactagaggagaacaatctaccgatggtcctgtgttgtgcacatgggaagatatacataggtatgcccctgaggcgtactgcttgtgtctgagaatgcatgattaaggtccgtactagatgatcaaaacttggagttctatgttatttctgtgttcatgacagtaaagttccttagttgtttcacttaagtcaaactgactaattaagtcaaaagaaaaatagtgcgattgatcatgcagtcaccaaactgggttgccactgaattttattgagttcaacaatctcaataaaattctttaacaaggggagaattctagtggagggcatcaatggaaaaagcaatgtgcaccactcctaaaaagctagcattattgctcatttgttgcaatttcatagtataagaatgcttagcataaaagcaaggcaacccatattttttttaacagattggcgaagttttcaaatttaaaggacgaggcaacattgttagcccaaaaagttgtccaaccattgctgcggctgttggacaaggatggttctgttgcggtataagcttctttacacttcaagcaagatgatttcctaaatacaaacttctccactaagaaaatatattgttgtttatgtgtgcaggagaaagcaactgacttacttggtttaattatgaaactcttcccatcatcagtatatcggcgtcttcaacaaagtatgagatactttatttgtaatctcctttgttgtttgtgaatttctttgtttgtaccagccacatcataaaagtatagtgaatttctttctggttattgttttacattttgattgtccagtgccattaaaatggagtgattagacaaaattagatgtatgctaacttgtacgggtgtctgtggcttttgatcgttcatattactcctttgcctgattttcatcatgaatattcataaccttcttgttcctttagacaggttgattgagcatttcctatataatactccctctgtttctaaatgtttgatgccgttgacttttttaaatatgtttgaccgttcgtcttattcaaaaaatttaagtaattattaattcttttcctatcatttgattcattgttaaatttacttatatgtatacatatagttttacatatttcacaaaagtttttgaataagacgaacggtcaaacatgtgctaaaaagtcaacggtgccaaatatttagaaaaggagggagtatacagaaagtcacactgattgaaagtttgacaccaagaaattgctgttatttcttga

SEQ ID NO: 51587 - DNA, 12413 bp, Oryza sativa
attattggaacagataatccaaaccatcttgcgattctggatatgaaattaaatgaagaacacacttctatttatgtggggaatctaaaccatattttgctgacagttctttgtaatttattttataaaaggtttttgatcatgtgtagtgaagtgataactgacgcatatccgtctgttatgggctttatcagcgcaagcatgtccacggagagatttatttcatgtaggcagttatgatatggtttggttggctaacttcatgtcctatgattttggtaactgccattcttgtatctgtagatgtcggatacatgtttaacattcaatggctattattcttctatgctttcatccaaaggcttccaatttttctatgatgtggcttattgggaatgcttattttagtaatcagaagtataggaatagagagattataataacctctaccgctcattctgttgtcataatttgttggtaccttgagctcaagttgatttatgaatctagcacgtcaaatgcatctcttaccttttacctggtttgacacattaagtacaaaatggagagcacaatctggctgatcaaagattcacagtttccatctggtcggtagcataccccacactcatttcttatatgccttgcaatgatatttctatgtgacaatatgatatacgctcaccttcacaagtatatggataatgctgacattcttacatcaaagtgtggatctattggttgtgtctcactgactgtagtaagttttatactgatattagtaatttcaggttgaatccatcattgcagcaaagattatgagtggtcaatgcaatctacaacattcaaaggcatggaatttgcttttattgaaccattttaattttcatttgattccatcattgatttagttttcattatcatcagtttgccacttgtgactgatcctttcatttttctcatctttcagaaacttgcgagcactttagcactattgccttgtgtcagagtatcacataatagtttgtcactgatgatccagaagatattggttgtggtcaacaatttgttaaatggtagttgtgttggactggatgaaggcaaagatatttggtgcctcattttttaccttctcagttgtactacaattttgtgcaatgttgaaccacaagttcattttgcaggctatactggatttgagttgatgccactaatttcacctggaagtaaacctccaccactgtcaggaggccagacaacctatggagattggaactttcattcagcaaagaaattttgcacatttgcagttcctacaatttcagcacttatacactgctgctccatgatgttaactacttcttatccaattcaggtttgttagaaacattgtttttgcttttaatctttagcactaacagacattcttgggcccttattttaattgaaggtgaatattccagtgcctgcggtggtaacttttatacaacgagtgctgctgacagatgtaacatttcataaatcatcactagtacaacaagacaccccttcatgtcatctttctttttctgagattctagaactgcattcatctttcttggattttcttggtgccattattaaaggaatgcgcaggtaacatgcattcttgatcttttgtttctgccttactttcaaaattattcacacacaaatcaccaggattggtgagtaattgtgtgatctttcacaaaaaaaaaatttaaaagaacatatgaagaaacagaacacataattccacacacgcgcacacacacatcattagcagacaagcttcagtacaatatttgaaatttatgatctttagaaaaataactttgattttttgtttgtctaaatgatttccagaagtgctttatcacttgaaattttgcaaatgaggctaatgatgattaccataccccttatctaatttaattgcagttggtactagctatagtattgtagccttcatagatatctcatgtgatgttaagatgataaattgatttaatttttagttataatttctcctgcagttcactattaccacatgctggtagtgttgtaacgctcataactgagtacttcaaaggagcaaagctgcctgcagtaagaagaaaactctacactattgtgcgattattgatgagctcgatgggtgttggtaggtcattcacacttttataaaaaatatacttaacacaccacttgcattagtagtcgaaacaaaacactgatgcatttcttctgtaagttagtggataaatagtgttgatgtaatggaccttgtagttcgatgagccagtggcccaaagcatgtataatagggatacatgcgtagagactacttaaaataatcacgatgttacttgagttccccaatcacaattctatctgtccattttgttcacttattctctacaatagccctatggaacaaaattttagttgattagaacttagggattctgctactgtttatttaaaaacaatcaaatataaattgatagccacgtataatatcaaattaaagtgaatagtatattactaaattgccaacataaccaccgaatattaaataatagagttgattatggcactatgggtcaccctgtcttagttcggaagttcaaactatcatcacttttaccatcatactccccctgttgcaaaatgttctatccaagagtcccatctaatatttcttagttaagtatgttgttaaaagttcactccatttggtttttttccctaagcaatctcatggattgtttcatgaagaactgtaattccttccatggtacaatgtccaagcttaaaagttgtttgcgtggatcttataaaaattttgcactccagcaattctcattgtggtcacttcagtaaagtttttctctaaactcacatttagtagacaaatggttctatattgttgtatagttgtcatctctttgcttttttgtaacaacatagtagtaccaaagatggcagtaaaggggaagtgtgcctttgcgaatcatatactatggccatcaaatcagtccctctgatctagaaaacttggtaaaactctagctggaaaaccatattgtcctggggccttatcatattccatccgaaatatcgcctccattctccacaatccacatctgatatttgaggaatctccctgcctccttgggcctcaaatatttgaaaatgataactaatgtctgatccaaataacctctaatcatctttagtatgcaccttatcctctcgaactcaaaacacttgttttgtaactcttaccattagctactgttgatgtcatttctggatctctttgggggcctgtctgtacaattgtgaatagacagagcaccattgaaaatcatttcgggggtcttaggaaataatgagctgttgagttttttggggggaaaaggatatcaaaccaactgtagagaactccataagtgttctcaatctgagttgccaaccaataatatgttttcatttaacttttcttattaaaagtactagtttggcatatttgaagttgggttatcgaaattagccaacttgtgagttaatcgtacaagtgttcagaaatgatagtcctgaatggaaattgatatgtttcgcgtgctgttttttgtcatcgattctattgtttaattactttgttataataaatatcacatctttaatttcttcgcagagttgcatagccccctttcacattcaatagtgaattgtcgcttacacgtgttgtaggaaatttctatacatgttaccacaaattatcaggttctggtatgcacagatatttcttactgacacgacactggtaatgtacttgtcacatttcaaattgtgtttgtttttgaaaagttaaaaaagttgccaatatttcctattacacagtgatagatatccaatattgcttggcacaatgaagaagggagaatactgtagtttaaaaactgatcgagatattgacatgtccactcttccagttccgatgcccgatcgggctaacgaggttaatgacattattctacgccactcttgtcctctcacagcagtaaagctcccaagcactatcccttgagttcgactccatgtaaaataatgttatgttaatctaaaactgctgcataagtgagcatatgccaggtgttcgcttctgctggaaaggatatatagagggtttgtacatgaaacaggtcagctgaattttgcttagacaacaacgttcgtacaaaccagacaagctggcattctctttttctttatcaaatagacagtcaggctctatatttagaactgtatagaatctatttgtatatttatgttactgacactaagtcactttatgcctgcttggagccttggagcaaaataaattttcatgccattagcagatgatctacgaagttttatgcttggaaagggggttccgggagaaaacctttactctatgtacttgctgtaactgttatttttttagtagttaacatggacgtatcaaatgttaaaccacctgttgagtctgagccaaacaactgtggttttgtagtccaggatgctgcattcactggatatgtctcagatgatttcataatatttcacttgtaatgcacctttctgttaaagctcttaaatttcttgccactaattgaccagggatgggtatgcacttgcttcaggtggtagttagcaacatttctgctgatctggatgataattctggcaacagcctattcgttatgagttcagctccaataggaggaataaatcagtcttcattagaaagatcttccagcaacaatcaggcattgcatgggaaaagctcaattgctgggagccctgaacctacatgcattagaaaatcaatgtcttcactgtgtgtcaaaatagcagcactggaaacatttgaagtacttctgactctggtatgtgtataactgtatatttacgcattcttttgcttaagcaatcacttctcatgcttaagcgaaatagatttcttttactaatacattgtagttaaacaagagtgcataactgtctaattcacctatttggctcctcaactagattattgtaaccaaatcataacgtcagctttctaaatgccttaaattttttttcctagtccacattaaatacatttttcctattgtaactatgcttagtgcttatctggtagtgcaaataaggtcagatgagcgagggctccctcatgtttaggcctgcttggttgggatcaaatgggttcaatgagctgatttttagtttgggttttgctcagtttgagtgcacaggtgaaatggataggtgcggattggtttcaattaggtattttcgagttcagaatgattgtaaatggactaagcactttgaggtggtgaatgccatcttcgctccagattctagaacacgcacaaccttggtaagctttttctctttgataaagtttgtaggctgcctttgaatttcaccttcaagtccattcttctcatctcagccatctcttccttcgagcgccgacagtatatacgtagacttagtccctcctcgaagatgtaagtatattttcactagtcactagtcccaaggctagttgacacccctcactccgcgttgctcctcaaagccgtaagccacgtaagtatatatgtagacttaatttttccttgttctcgggaagtcttcttttgctgagagctttctcttgtctttgtaggacttcccctgttgcttctgaccagtctgttagtcggatgcctgcagtcgggctagccattgctccggccttccattcctcagcccccacgatcacagatgcatcagtgctaatcaccggtgtcgcctggtcattggtgttgctggcagcagttcgagaataagcatctcggagccagagctggatgaggccaagaaatacagcgctgaactccaaagcaataatgaggcaatcaagacctttcttctcggtaaaggaagaaggtgtggcaaatggaggagatccaagctgtagcctcctgttgtggttgctagggaacttcaagagaaatttgacaataagccatccaatccgcatgccttctctaatacaccactaggagtgctaatttttttatttcataccactttctttctcatcattttctctttttctttctctttttatgttttatcctccttttttgggactgttttacccctggccccacttgtcaggtaaaacagagagagggagggttttacctgttgctctgcggttaggagccagggtgcttgctgcccttgcctcttctcgccagagaaagaggtcaggagccaggaccaaaaatcttatccttagccatgaacacagtatggtttcctaaagtgacattgtacttggtttctaagttcccccatcaacttctttgcacccatatttggatccttttttagaaaaggaattgccttctctgccacccactaacttgccattttggtctttattctcccagttgatgcacaagtatgggcaaatttgttcaaggtaacccgcaacatacgcaaaaaaaaaggtaacagccatgagacaactcatacagtcaaaccaatatttgaaatatgagacattgtttagttagttattagtaccctcatggatttttcatttaggcatcagcctggccgcgatagcccatgggcattcgttagctgtgcaaaagcccctaaactcttttatcagacttctctatcccaagctgaaattgtccctttatagcgtgttgcctcacagctaacctaaattcattcatgcttacatatgagctttcaacttccataggaggatcatccctgtcatagaaaatttcagattctccaggtattacacattaacagcaatctttaccttgttaaggttcaaattccctttagtatgagctggacctggtgtaggaacataattcctttgcctctcagcttcaattctagcttgctcagctctctcatcctcagttctaagtccaacaaatgtatacatttcattttcctccaagttgatgttgtggaattggttctatctcgaatgcatcccaatcaatagcaagctgaggaacttggttatgtagaattggagctatctctagactatcccaatcaatacaactgctacattcttgagcatcaccttgtctgcctatcacaacttcacccattgctacctcattgacctataaaactatcgagttagttatcaactgaataggcttatcctccacatcaacaaataaaatcaactttctatcactcttcataacaaataatgcatggactacattcatattatccttaaacggtgtttcctcgccggtgctcatgtcatagccactgatcagaacatgttggcattttacccttgctgcaaggtccttttccaagctctccaatgtgcactgatgatagtccacaacccattcaagccatttacgcgccacttcaacacaagtaccatcatcaagtttagttgtaaactgaccgaactgaacgtgcacgctaaactccacatcatggtcagtcctatcgcgtacgaacaagaaaaatgagagtaaaaaaatcattagtttacccgctaaccaattacgtcctagttctgctcctcagcccgttagtgcaaataatggagatgtcgagggttatagcattacctagaagggagttcacttggaatcgaggagcatgccgcttgcgccatgatctcctctgcagcagaaccgtcaccccctttccccctctcccttcaaaccctagggaccggaggctggctggcagtgaggcaaggaggttggccggtggcagcgggttgcagggtgatgggcaaggaggctggtagcggtgccggcgacgggtcctagtggcggcgcccggcgatgggtcctagtggcggcgtccagcgacgggacctggagacggcgccggcgcaaaatgggagcacaacaagtgtcgcctccccttcccgatccccttctgcggtaaaacctctctctctctctctctctctctcttacctgataggtggggccaggggtaaaacagtttgaaaaaggaggataaaacagaaaatgagagaaaatgagaaaatgatgagaaagagagaaagtggtatgaaataaaaaaaaattagcactcctaatggtgcgttagaaaaggcatgcggattggatggcaagtttgcaaaggtatgcgtatttagtggcttattatcaaatttctcggaacattcaaagaggtcatgaagtcttcaaagtggacattcctgcatcagcgtctactgatctgctgtaggtagtgagttcccacggtgacttggtcgccaacattgtcatgcttccggacaccctcagcaggtgttcgaccatggtgatgaggccacatatgctctcgcctgcgtcgtctattgactcattgcaattgacctcactatggacttagaggggattcaagtggagatgtggggggttgaggaggaaatgatctagcggtgttgaccagcatgtgatgcggctctctgaaacattatttctagtccataacttctatttgttggttttgggtggttgtggtcagtgattgcaatttcagtaattttggaccccctcccctcttgggcaagtgattatctcggccgaatttttctgtttttctcaaacttatgcaaatttggtcataatttagtcattcagtaaatttatgttaaaatttcaaaaaaaaaatcggtccaaaaaaaccaaattttcaggaatttcgatagaaccgaaatggctgaaatttcggcctaaatcgaacttgaaaaccatggttgcggtggtgttttgtttgcgcttgtacgtattggaacttcctttagtgtatattttcttatgtaaagttgccctttgtatatccatccttttgtcttcatttgcaagacaagttcttttgttcatatctatttcatgtgcaattctagcattttgttttttgaacggtgactatttgaactggtattactattttactttcacggtggcattccttataagaacggtttaactgttggtcattaatacaaacagaatactgtagagtaccattatcttcttaatccactcatcatttcgtatctctactcaattggctaggttgcctccaaggtgttatttattgtgccactcttacttttaggatgtatagacatgtgtcccaaaaagacttcgtttgtccagattcatagctagaaatgaagtctttttgggatgggggactagtagtagataatcttgcgtatattctgttgaaattggctattgactctcaacatgagcagggtggttcattcagagcatgctactggaggacacaaatagacctgcttcttattaatgttgcaagagagtctttctgtactatggggatgtatgaactaagaccactattggcaggagatccaactttttcagacttccagttagccttgttaaaatctctattggcatcctttctttcttctcctgacaattgtccttatttagaacgaggtcttgagctcttcaacaaaggtaataccttcttccaggttctgagccaatctgtatttgctgtatttatcatctatttccacatgcattccagttttgctaattcattggtaaaacgtagagttaacgatatacagaagaaacccactaggacacatacgcatgaaatttgttaagctagctaaataaatcatgcatttcatatagcagttcattacttaattacatccatgtaattctcaaaacgtgttaattttggttgttgtagtatttatctttccttgtcataacagggaggctagagctggtaccgagcttgcaaaattttgttcacatgctttgctggctttggatgtccttgtacaccctcgtgaacattgtctacaatatgatccaaagattcctctcagaagagcagctcatggtgatcaaggatccctgtcgattgcttcagacaatgaagtattagattccgggagatgtaagaacctccactctgcatgtaaaacccagctccgagattcaggagatgagtcaatgaatggctattctctactgacgatgctccaattgatgcttttgtggaagacaatactgcggagaaccatgaagtgaaggagatgtccagagatcatttggtgcagaagaactctgtcatcggagaacatcaagaaattgttttaaataagtttcatggggaattgctggttccaacgtccagtaaattgatgccgatgtggctattgcaggaacaaaaggaggaacatacaacagccctgctgattacatggtgggttatcctactcactttttcaatgttgattcagctcgcatcagcataacaccacctgatactcaggatcttgggggtgctacattttcaaacaataaagacgaccagcatggaaggaccatttcaggtgccgcttcaagtagccagaatgtggcaaggcacaccgcaccgatttgtgatgcttcaggcgtgtctggtactgagtgggactcacttgacccattcctggatataggtaattttggcactgagacaactttttccttggacatggctaatcttgatccaggctccaattaggaggtgtcaggtgtcataaagttctgccttcctagatttaattagataaagatccagatttctaacatataataatgatatggctcaacattgtaataatggaagttgcatttgagatggtgcgcgttgggtgaatatgatgcgtgtaagagatgccaatttaccaacatcactacaggaagaaccaattgatgaggacatattctatgtgtgttagcctgttaggtgttggtaatgtaggaaactctttaccttgctcgatagtaacatctatcccctaaataattagataggttattagcctagagatgagctattattaggtactcccactgtcccattttaaacgtcagccaatgattttccatgtccaactttaatagttcgttttatataaaaaaattatgattaatatttttattgttattagatgataaaaaatgactagcactttaagcgtggcttatgtttttttaatttttttaaaaaaatttaaataagacggacaattaaatttggatatggaaactcatggttacatttaaaataggacggaggggtatcatttgtaaagtatcggtttaggagacatggtttattacaaagcccaggtcgcccgttctgagatgattttttgctctctttcttgacaataacaatacgggctcctttggaacaaaagcttttcttttttaaaagaattttgtaggatgtggagattttccgatatgctccttcggaacaaatgaatgctatatagacgaagagctactatatctagtaggttgatgggctttttaggcaaaaaagagtttttaattttaattattatggggataaaaaaaggaaaaaaggaaacggaggtcggatggatagcacgtacgttgcgcgcggagggatcctaattacttacggagggagattatattcttgtgagataaatttaatgattaaaattaatgggtccaccaatttaagtgaaaatcaatgctcgtatttatctattttattagtcatgtgacgactcgaaagcgtttttagaaatatatgtgaatatcgatggtcagatttatctattttattagagtgacatgttgtgactcgaaagcgtttatacgataccacatggtagcttaggagcatttttagaaagtttaatggaattttagtatataatttttttagatttcctctaatttaaaagtgttatatagatgtttagaattttttttagatttcctcttatttaagagtgttatatagatgtttagaaatatttacatcatgtttaatagagtgtttattaggagaggatagaggaagagctagcaatatatctagtaggttgatgggctttttaggcccaaaaaatgtttttaattttaattattatggggataaaaaagaagaaaggaaatggatgtcggattgcatagtacgtatgttgcgcgaggagggatcgtttgtacctgcagagggagattgttttcatgtaaagataaatcaaacgatcaaaattaatgggttcactaatttaaatgaaaattgattgtcaggtttatctattttattagagtgacatgtggcaactcgagagcgtttataagatgccacatggaatcttaggagtattttttggaagtttaatggacttttaagatataatttcttagatttcctctaatttaagagtgttatatagatgtttagaaatatttagataatgtttaata

SEQ ID NO: 51588 - DNA, 10739 bp, Oryza sativa
tttcatgtaaagataaatcaaacgatcaaaattaatgggttcactaatttaaatgaaaattgattgtcaggtttatctattttattagagtgacatgtggcaactcgagagcgtttataagatgccacatggaatcttaggagtattttttggaagtttaatggacttttagtatataatttcttagatttcctctaatttaagagtgttatatagatgtttagaaatatttagataatgtttaatagactatttattaggagaggatagaggaaaagctagctatatctaataggttgatgggctttttaggcccaaaaaggtttttaattttaattattatggggataaaaaaaaggaacaaatgaaacagaggtcggatgcatagcacatatgttgcgcgtggagggatcgtacttacctacggagggatattgttttcatgtaaagataaatctaacgatcaaaattaatgggtccactaatttaaataaaaattaattatcagatttgtctattttattatagtgacatgtggcgactcgagagcgtttatcgggcatgtcagtttaggagcggttttaggaagtttgacggtcttttagtatataatagataatagatgtggcgactcgagagcgtttacagaatggcacatgttagtttaggagcatttttaggaagtttaatggacttttagtatataactagaaagttagcccacgcgaatgtgcgggcatgcattgtaaggttcatttaagacaattatagaagcagaatattaattggataacatttgcatgccatgcttcaaatgtattatttattcattaattttctttttggcattgcttaaataattttttttaacctatcagagttgttccaattatctaaggcaattattatgaaatggttattgcaatagtagcttcaatttaagtgtgaagtaagaagcaaaatttctccaattggttaaatttactcccaattggtattttttgtattttctatttattctatataaatcttattttaagtataaaatttgtgatatgataaatagtaacagagcattacacttttttttcaacttccatggaaatttcaatgacattttatataagttggtaaggccaaatatatattctcattggtcaataattggtggattggataggacatgagactacactatgtacatgggtttgtagagttcaacatgattatgtggtgtgacacacaatctatttatgaacactatttgtgtggtgtgtgaggcttcacgcaacctagcgtgaacacaatcgaacaactaaaattatataattagcatgcatcattatttttagaatgtggtatattgtgattgtttagatgatttaaatacttttccataaaaaaaattaatttaatattaggaatttttacttgagatcgactactatgttattttaatttttatttagttagcctgtacctggcatgtattaagtatatttatattattatataaagcctataatacctatccagttgctaatcgtatcaaagaccatagaaaatccctgtgttcccaagaccaaatgaattatttcattttttttcatttctagcatgaaaattatttggttgctatacgatcatatctaattcctagtaaatatgttccatgcctaaaaaatacgctcgttgtgccttgtcccatctaatattgatacattattcttagcttgtcaagactggcttactaactctctccgtacttctctttctctcccatgcacttgtttgcgcaagaaaatgtctgggttccaaagtctgaataaatttattataatttgtgtgtataatatatgacaattgtttttaatggttcatgcacaaagaaataaatggaattgtgttcatacctgaaagatgtagaaaaaatctacatatgatatatgagggcgcaacatgtgttgttgaattattttgtagctttttattgcaattcagacgacatgtaaaaaggcaagtgttgtctatcgataaaagtattctttcatacttgaatttataaatatatattttttattctactaatttagtttagctatgcatatttatagaatgatctatgtaatgatgtaatatttgttgatattctttatcatatttctttgttatttggatggcatatataatacatgcattgactatatatatttcatatatagaaaaacataggtatatgaatcttaatttgtttggttaattataaatagagaaatagttatattagaaatcatacgtgtagcacgtagtttaaaaattatcatcatttgaaaattacaattacaaattatttctattttagttggataaccaaataataggaatgggggaaaagaataaatagtgccagttcaagcaagaggaaggagcaaacagggatatacatgaggggaaggggagggggaggtgaagtagatggaaatgtttggaaatgaatgtggtgttccgtaattattaactctattttgtgagaaaaggcataaaaaggtataatacagtttgtgattttttaattaaaatattgttaatacgtgatgtagtattttttttcttttattatagagagcatggatgttctatgttttattgatcgttgtttttctcgatggtaggtgcatatgtacgtaggtacatgttctttaattcttttttccatcgatactgtgctcagttttgttattttttctggggtatgtacgtacatattttattttcctttttttccccatgaatacgtgtatatatttacgtacgtgcatattattttttttcttgcttttttctcttggggccgccagcggagaagtgaaggatcatgtaccatataggccaatagggaaaaggagagagattgcttatgggggttttattttttttctaaaaagaaatttaatagttaaaaatagtgggtccaccgatttatgagagtgccatgtggtagcttaggagcttttataggataccatatggtggtttagaagcgtttatataaagtttaatggatttttagtatataatagatagatagatggcccaattcagagtaattttagagaaaatttgtggagtgattgagaagcggtctttccaccataattgccacctgccggatccagcgtgttagctgtggtctgtggaaggctagaagctgacacccatgcttttgatccatccaagtaccctattagtatgttctaatttttccctaaagtatttgctcaattatacaattatacggttgtattcattttgattaatttgaaagaggccataggattatatgttaaagaaaaaaaatcaaccgttcaaatttaatgatccgtgtgtgagaagccaatatttatacgactcgttgcacattcaatattttcgatattttggtaattgggtttaatgtttaatgtagtggttattgatttaagggcgatatttttttaatgtgtaattagttgatacatttaaaagtaataaaataatttacatagaagtggtgaaacaacgcctaaattttcagaaatcgaacgcacaatttgcagtcttccccaaatccatttggatcattttagtacgaagtagaaagttaggtcattagttgaacagatacagtgatatgtgtatatatttgacagtgatgattaaacaaaaacggaaaagcaaccacgccacgctagtccacacgaaagaaggggaaaaaaatgaaaaagaaagggcagaaagtccctcagattgattagtagtgcatcgtctctatccgtcgcggattgcccaccaagaattcaagaaaggcaagagcagaggtgagcagcgatcctccaatggcggctgcaaggagagtggtcttgttccccagcctcggcgtgggccatctcgcccccatgctggagctcgccgcggtttgcatccgccacggactcgccgtcacggtcgccgtccctgacccggccaccaccgcccccgacttttccgccgcgctccgcaagtacgcataccgcctcccctccctctccgtccatccactccctcctcctcctcatcctcctgcctcctccggcgccgatgccgccgctcacccgctcctccgtatgctcgccgtcctccgcgcccacgcgcccgccctcggggacctgctgcgtggcccccatgccgctcgggcgctcgtggccgacatgttctccgtctacgccctcgacgtcgccgccgagctcggcgtccccgggtacctcctcttctgcaccggcgccaccaacctcgccgttttcctccgtttgccacggttttgcgccgggagcagcggaagcttgagggagctcggcgacgcgcccgtgtcgtttcccggcgtgcgcccgctgccggcgtcgcacttgcccgaggaggtgctcgaccgtgggacggacataagcgcggccatgctggacgcgttcgaccggatggcggacgcgcgcggcattctggtgaacaccttcgacgcgctggagggtcccggggtggcggcgctgagggacggccgctgcctccaaccgcgccacgccgccggtctactgcgtcgggccattgatcaccgacggcggcgcggaggaggagaggcacccgtgcctcgcttggctggacgcgcagccggagcgcagcgtcgtgttcctctgcttcgggagccgcggcgcgctctcgccggagcaggtcagcgagatggccacgggcctcgagaggtcgaagcagagattcttgtgggcgctgcgcgcgcccgcgggcacgaagccggacgccgcgatgtctcttcttcctgacggattcttggcgcggacagccgacagaggcgtcgtggtgaccgcgtcctgggtgccgcaggtggcggtgctgcagcacgcatccacgggcgcattcgtgacgcactgtggatggaactcgacgctggaggctgtcgcagccggcgttccaatggtgtgctggccgctcgacgcggagcagtggatgaacaaggtgttcatcgtggaggagatgaagattggcatcgaggtcagagggtataaacccggggcacttgtccaggccgacatcgtcgatgccatcttgaggcggatcatggaatcggatgcgcagcagggagtcctggagcgggtcatggcgatgaaggagagcgcagcggcagcatggaaggaagggggatcatcgtgcactgcattcgctgaatttctcaaggacatggaggaggggaatgttgccatggcgcattccaatcaggttgaaacttgaatttcttcctgagcatggctcttgacctttgcatttgtcttccatcaattaggatccatagaaaattgtccaaacccatctgcaagcaccacagttggtcaaatgcttgtttatgataagcttaagttcaaatgaaattcactgaccccaaatatgtgatgacaggtctcttacttgttagaaattcaagcttttcaatttcgtagttcgtagtggtctggtcaattatacatggtgcttcattgctgttgaacagttggggaggcctccaagataatttcccattaaggccttgttcttcggttaatccccataatatgggtataatatgtacataagagcaaggataatggtgagctataagcaagctaaatgcttatgtggaagagagagataaataaaagtggagagtgttggctctcatgcaagagctagctacacacaagctctaagaaatatgcattaaattcgtagagagataaagagagaggatgaaaaaaataaagctaaccttatagctaacctattatatatgttagctttaacattggcttatagtaagtagtgggctgtactactaaacttgctctaagaaaacataaatttatggaaccttgtggaggacagggaaacttgttaaactccaagaactaaaatgggacttatgatcctattgcatccgaaacaaatgcaggacgatttttctccttgaataaatgccaccggtcttgtgaagacgtttcaatcagattctaccttgaggctctccttgtgcatgcatttatctatagaaaactatgttgttcagcagtatgtttccacctatctgaattcagagttgatcatggactcatggttgtagacttgtagtaggtaactgaaggtatgacaagcttttagttcagctgaatttatctgacacccaaatatatgatcacaggtcttttcctgctagaaatatatgatcagaggtctcttcctgctagaaatatatgataggaggtctcttccagctagaaactgaaccttttaaattttgtccttacaataaactgaaccaaagcaacattggtccgctagtccggtttgatagttgtcaacagtaaagtggtctagtgataagtacggagtacattccttaggtgcgttctaatgtaaggattagaaacttctctcatgtaaaacggagcgactcattagtgtatgattatttaagtattagctgaaaaacttaaaaaatggattgatatgaatttctaaagcaatttttctatagaattttattgaaaaaaacacatctaatagtttagaaagcatgcacacgaaaaacgagaagttagaagttgggaaattgccctatcgcgcggaaaacggggaggtagtgtgcaattggtataatatgtgtggctcaatatattctcttttttttttgtttataggacttaccaagcaaatataggagtcgtattctggttttatgaaagctgaaaagatgacacaatactttgaaaaaatgtgactatttaaccgcttgcaaatatgtgatggtaaaaacaagtctagttatacatagtggcggagccaggataaaattatagtaggggctaaaccaaaagtggccaataaaagttgagatatgtctcatataaattggctatatgtctaatacaaagtataaatatatagagttaccgaaaaataaacattatccatatcaaagcaatattgaaatgtccaatagatgatgcatgatgtgcgacactagtacaccctatcgccaattattcttcatcaggggtagtctataaaaaagaaatgtcaaattaatgaataatgacaattgacaaacaatagcttcaaataattatttttaggtagtaacatccgacgcgctttcatatcttcaaacctttggatgattttttcattactaatacttctaaaaatttgcttctcagtatagcatatcatcaagtcatttagccattcatcccccattttgtttctcaaatttgtctttataagagacatggttgaaaaaaccctctcaactgaagtcgttgccaccggaagtatcaatactaactcaatgagcctatacaccaatggataagttttgttctttcctgtttgaaccattaattctgccacctttgcaagatctttacatccaacaaattctttagctctcctaatattggtaataaaatttgcaagttgaggccgtagaagcataagatcaccaaccaaaaaatcttgactataaatttcagcaagcctcacaagcttatccacatcaaaattagataagaaaatccatggattaaaggctgacatgcatacttagtaactttgaactaacttcactaaactgacgattcatttctgccaaaattgcatctatggctgcaagaaagatctcaacatggtaataatgcttatttgttaccttgtgctttcgacataaagatgtcccactttcatttacctccttgtccattttgggaacttcaatctcatgtttaacacaaaatgatgctactctattcatcaaaggctcccatccattctcccttgtgtaacataaatgattaaattcattgcctcaacaatgtattgatccttcctttgcaaagcacgtgacatgtcatctgttatactcaagatgtctatcatcaaatgcattatgaacacaaaatcaaaccattgcattttacccatcaaaccaaatgctccaccaataaatgttggtttagtagaatctttcttaacattctcaagcacatatatgtgtcgacgtttgatgtcgcgattccagtatttgcatagtatggggatcgttggtaccagggtatatgcgagattgtaataaaagagatggggacgaagatttttatataggttcgggcccctgaattgtcaggtaatgaccctactcctgttggccgaagccggtcgttgctcttattcatcataatcacaccaatacaatatttggggtagcctatctatctgttgtcgacttggcggtctgaagtgttgactcgtagtcaacaacagggtagccttcctcctcgaatccgcatccggcgagatcaaagacagcgcttttgtctctcctgacagtatccgtagacaccataggggactaggcatgcttatctctgaagtcgatatccggcatcttgtcttagcgtatgttggcttgtatgttgatcttgtgtcttgatctattgttccgtgtcccctctcctcctagggggccttgtatttatacccataggtgtccccttgtccaagtagaactagggaaaccaatatggatacaatccgagtagtccttgtcgtttccatgtagaactatactcatctttccttatgcggaactcctcctatatccgaaggttgtttccgtataagacatggtatgtggtgggtcctgccgagatttagtcaactactattaggtatgtggtatccataaccctgacaatatgatagcttcccacattaccataatgcgaagcaaagttttaagatgtgatccccatctagtatctccaggcctagctaggctacattcttggttcagccctcttcccgtggtaatctcaccattctctaccttttctaacaatacatcatgatgttttgcaagcaaggcatcctttcgcatgcaagatgcacccacagtgttgactattaaaggcacatagttaaaaaaatctatcgtggctgcagtagaagatgaaacagtaacaaccactaactgtaattgatgggcaaaacaatggacaaaataagcaaaagggttttcatccctaatcaatttctgcacaccattaaattcccctctcatattagaagctccaacataaccctgctcacgaatcctagagatgattaacttataactagaaagcataccaaccaaagcttcttttaatgcaaccgttgtacatctctcaatgtgtttaagacccaaaaatctctccatcactttcccttccatcattcacaaatctgcatggcaaaaattaatagggttagtacttaaaaagaaattgaaattttacaatgaaagcatcacaaaatggcaaaaaattaatagtgttactactaacctcaagatgacacccatttgctcatttatcgatacatcacaagattcatcaataagcacggagaaatttcaatgtccaatctcatccataatcacggccgtcacttcttctgcacaagctttagtaagatcctgttgaatgtcatgtgataacatttggcaatttttattgctcttatgggaccttgtctttgtaccaattaaccatctctctaaatttacccttattgagggatgcattggtcttatcttgtccacggaaaggatcaccttgcttaatgagaaaccttataacatctaaagaagatgtcaaccgaatcttgtatctaatgtcttcctccttgctaacaatctcaattttcctaaatatacttgtcctttggttcataaagtctttgcattttttcctagtatcattgtgagtcttacaattactatgtgtagcaagcctatctttagctttcttccaattaacaaaaccttccttagcaaatacagaacttccaaatttttaggttttcctagctaaaagaaaagataacaatacaagcaataagctgcatcctttgaaacactatactcaagccaatcgaactcattgaaccaagctttttgaaaggacctccattcaccactttgccacttacgaggaaatgtgcaaaaatctggttgagttggaccactcaatgcatatatcctttttacttgatctctaatttcaggttgataattctcaattggtttccattccactggatcaccaatgatatccatatgactaaactctgccctaggcctctttgactgacttgcaatctcattattgagtggaggatcgctggtatttgtgttacttaaactagaataatatgtgagcagtgttcttttcggcatcttcacaacctagcaatataacaaagtagcaactaggaatcacaaacaaaatttttcagttcaatatctctatgatttcttgaagacttgagctattagtaacaactagacttgacaattgaaattgattttaaatgacaaatcaaaaatgttatataccacaattcctcaatctgctgtgctgggcaatgggctgatgacctgctgcagtgctgctgcttgctgctgacgccctttgcaccttgcccagatgcccccttccctgcttgatgccgcgtcacgccgccgcatcccccagctggccgccagcccacctgcaccctgccttgctgccgcccgccagtagccagcggccggagtgccgcgtgccctgactgctgcagtgtcggcgcgccgccgctacgctcgcgtcccc

SEQ ID NO: 51589 - DNA, 2851 bp, Oryza sativa
cgccacacgtcaacgggaacgccgccaggaggccaagagccgtcgtcctctctctgcggctggaggcaggagattagggttgggtagggttgtggggattttttgtgctttctaaaaatctcaaacaaagtctatcttagccctcccataggattagaattttagggggtattaagggggctctaatggttcattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttagggggtagtggggtctaaagaccccctgccccacccccacgctgtctccgccatagattgtacaatcggctgcttactcctaaaatatcatgtcagtacaatactaaactattgtatagtagtccttatatcatatcatgctctatcctaacagtgggcattgtctgtcttggagtgtgtgtagctagtacttataggatccatatatagtactccctccatcccataatatagcaatctagtaccggatgggacacttgatagtacaatgaatccagacatgcttcctgtccagattcgttgtactataaagtgtcacatccagttctaggttactatattacgagacgaagggagtatatcatgcatgcatgggtattaaatgtggggcctatgtcaggcatagcaccccgtgagaactggtgcagtgtataaattgacgaaagatattatcacggccccatatagattaaaacaagataaagaaaaccagtcatctctcttcaacatactggcaaaagacataatttgtctgacatgtgggctcggtcacattctctttccattagaattggactatgattagtacccagctcttgctcgagattggccaaaaatgataccatgcacggtgtatgggtgtggctctatcttcctccccccccccccctctctctctctcgtagtgcctcctctaagtgcaacactgcatatgctcttagtcgctggtctgtgttgtctctcctcaagtcccatctctagcttacttttaaaaccaatgtggcagattttcagctagcaattatagttggtacttgctcgtaaagtcataagatatccataagagcagatttctagattccatgattattggaatcgtttaccaagagtcgatgttaaactactaaaattcagtgcgcggaacgtacgtttggaattttgtatcctagcacacatgtaaggccaagggtactctgtccaagagatgagagcaaatttttgtaactttgttaagcaacgtccaactttgacgtttcccgagcaatgtgtgcagttactcaagacttggtgaaatttcacctgagaaacaatctgtgtggcttggagtgggatctggtggaagtctatggcgcagcccaggtacaagcagctcgctttggtgagcaagcacactcacattaggacagccagaccataataatgacatgttgatgttgggtcgaatgaaaactggaggaaaattaagtaggctaattgtgttctcaaggaattttcaaattaaaaatagagcaattcatcgaacaaaagattaaggttctgtaagtgcattttggattgcttgaaaggaaaatttccttttgaaggaattctagcataaggtctaaccaatacaatattagtttcgtttgattatttaatattattgttttaaacaataaacatagttatgcataacagtcactaatattaggctcttaaaattgccactaaggcaaatttctgtggtatagcaaaggaagagtagagagaaaagtcgatgttgagcttaacatcgattattgatggctttccgtgcgtattgattgcaaccatggtagccacacaacgaaacactcgagtaaaagtaaaagaaagaaagttctagtctaacaggtcgtgtacatgacaacggctgatgtttgtgtgtactagtccaatgcttcttcctacaagttagttttaaatcaatctagtactccatctgttctatactacgagaaattttagagttgtacatgattattaagaaagtaggtagaagtgagtggtggagaattgtgattggttggaaagagaatgttggtggagaagttgttatatttgagacaaatcctaagggctaaaagttgttatattttgagacgggggactatgagatatggtcatatgacatatcctagtacgacaaatttaatatcacatctcatactaggttggtttattttgaaatggagggagtactaacgcaggaaattctaactttgcttcttcctccataggtgttactgctagccaccattcactattcctattcctatataattgtccccatgagctgtgattctaggctaccacatcatcttatttatttcaaccattacatcaacacaaattttgacaatttgaccctttgtaaaaactaattttacaaatgaaccgcggtcaaaacttatttcagaaat

SEQ ID NO: 51590 - DNA, 2369 bp, Oryza sativa
gtgtatcgtccttcttgatccatgttaatcacaggtccagcatcggttaatttcctctactgttttagttttattgattatctatgtaatataggataacttgcctgtttttgttatagtgttcttcccagattgaaaataaatcttaagtgcttcattgcttctactcccttatttctacacacattgcaaattttaagcacatcctttttttatcaagttttcaagcacttcattggtccagtttcaacaaatttgcttattccccaatacacatacaagaacaagttttactaatagacaactcaatcatcatacaaaacaagacacacaaccactttataggatagcaaatatattttttttactatatttgtctttctagatttccaatatatgctacgttagttaaattagtttcaggttacgaagtggtacctactgtctactaacagtattgcaatataagggcccctttgaatcgcaggattgagaaaacgtagaaataggaaaaatataggattttgataggaatgtaagtataaaacagaggattgcaaaacgcagaaaaaatataagaataaccgtttgattgaaccgtaggaaaaatataggaattggatgagagagatagactcaaaagaaagtttaccaagaggttgaacctcttgctaaatttcctgcaaaatctctatagaattgtccattccataggaatttcaaaggattggataggattcaatcaataaagggcttcataggaaattttcctataggtttgaaatcctccgaaattcctatgtttttcctccaaatcaaaggggccataagtttgctttctagaacaagacttgatagcaactacttccagcaaattctgcattttcaaagcttcctccaaatagttgtcttgaagatgattcataaatacaacgcatattgcaacatatatcatgaccagtaccataaccactcaattcacctggttcatatcaatagtttggagggcttcacattacacatgtccattatacctaatttacataagtatatcatatggcttttcagttaaaggaaagcttatgtgaaggcatgttcaagttttgactatttgaagtaattctatactcatgtgacttttaagttccttataatgaagttgagagtttctacacattggatttttttatttacccccacacaaatgtttatacctatatataggtaaaaggaaaaccctcagtgacataatagtacaaagagcctagcctctcatgttttaagtaaaactagacctacacgatcatatgcattattttccttcaattttcaaactaggcattgtcaaagagaactataatcatggtaaaaaataaaataaacaattatcactgttcaatttttttctattttgcaccttcaaaaataattctcctttttttatataaaagtacccaccacaatgcgcggggcattacctagttagctacacttcgatgcctccatcattatctgaatcatttacagaggatgtgtacacaaggcactttgtaatttgcatgttgatccgctctaaattgtactttcggtaaaaaaaaaaacctttttcatagaaaagtccctccgtcctaaaataaaataaagctattttattactccacctttatttaaaatgaagttatttcttcacatgctctctcatctcaaacaatcacaactattttttattttatattttctacctactttttctttctaaccaatcaaaatatttcaccaatcatttttcacatttttaatacttgtgtccacctttagaaatacttacattttatgacgcagggagcaagtcctagccgtagaccttcgtactcaactctattgtagaatgttggggtgtacggcatagtgatcaaaaccaacatttttatggcaaaaaacagcttcaatagaaaaaaagttttaaatctcacatgttggaaggtaaaaggatattgttacatgtgctccaccaagaacaacattgttgggtccttcccaaaattttcattattttagatgtattagattatatcatgcagaccaaagcccttttggcatgtaggatagatctaactttgagccctcggtgttagatgatgcacaaacggtatgttgtttgttgtccaagatagtccaaacgaaaatttttcacctgtacaaactttttccatttgtagaaaccttgaagtcaagatacgaacgttcaattaaaccttcaaacagtaaaacaaattgaaagcatcttttacataatctttcaactcaagtcgctcattttctttagtttgtctgaacttgcaacttcaaaatcatgaacttacaacata

SEQ ID NO: 51591 - DNA, 13704 bp, Oryza sativa
aagacccctaagggcatggccaacgcagggtaccctaagtgctacctaggatgggccaacactcccaaaaagctaatttcccacagtgcaagggtctattcggctactttgtaccgctgctgcactgccacaaccggagaaacaatatacagtgcttgttggctgaaccacagtgaaaataatggcagccgaacagagcccaagttgcttcaggtggtagtctcatttttttttatttcagcccctggtgtttttcattttagccctcacaattttacaatttatatagaagttcaaattttacactaaacaccccaaaatccagaaattaatataaaatctctcctcctccctcttctccccaccgacaccccaatcccctccccacgcctctccagactccagctcgaactctcctcccgctgcctcttctctcctctcccctccccggtagcgtcagatcgacgcggcggcggttctctccagtccaccccttctccatcttcttccccggcgcggggcgatggcttgggtgaggcatctccccaacgcagttcctcgcccacaagctgacgaaactatgcggtcccgcccgagctggcgtgaatattcgccttgggacggatgagaccacactctagcgtggagcgttggctatggcctaataaataacttgcactgtatcgtttgaggagcttggtctaggtggcatccgaagcgcggcaaatgcggtggccgcactgaaatcgcccttagagcaaggataatagtagagccaacttcctactaatacatcttaaagcctacatgtataatcagtgttctaaaaatcggccctaggcgccgcctaggcgcccattaggcgctaggcgccgggtagccgccgcgattaggcattcaatggtgcattaggcggttaaattacttaggtagtgttttattgctattttagtgttatatagtctaatttctatgcaatatgcctactaatttcttgaatttaactatttgacccgacctaagcgcccgctaggcgccgcctaggcgaggctaggcgccaattaggcgctaggcgccccctatccgcccaactagcgcctagcgccttcttgaaccatgtgtataatagagattagctataaggttggctacaattttcttctcctctctctatctctcacttatatcgattatcctacgcctcggtcgcctggggaggggaggggaaaaatcggtcgctccctcccccccacgacatgcgcgcacgtgcaccctagccccacgatgtgtcccagtctacctgctacgtgtccctaccacatactccgttgcaacaaatcacacacatattttggaaaccctctattaagggatttcgtttcattttttgttccaccaaaaatgtttcacctagtgtactcacaatgtttcactatgtatagatgaaatgttgcagtgaactgaagcattcttttgcaacaaatcagccacatattttagaaaccctctattaagggatttcgtttcatttctgttccaccaaaaatgattcacctagtgtactcacaatgtttcactatgtatagatctaatattgcagtgagctgaaacattctttcgctatttgctaaaacattgtttttatataaggtgaaacaatgcccgatttaaacgattgaaatattttcgatctacttagtgaaacaattccgatatacttggtggaacatcgtgcaacatttaaaaataattcaataataagctaaatttttttcgtcagaatatatccatgtgtggtcttgttttaaagatttaattgcaacgaatttaatggtgtaattaaatcatgatttagataaataatttaagagaaaaaaatagtttaaagtggttttgcacgaatgcgtcatgctgacgttagcgcctgatttttcctcttccccagcgaacgctcgattctaagttgtctcccacttatctatactaatataaaaaagtacgagttcatcaaacacccatcttttctgacccttagatcgattcatctaacagcttatatcaagatctgcccctcaattagcgattcccatgtcggtaaccagcggttagcgaaaataaaaagaaaagaatccactaacgccgaaaaagaaaaaaaaaaaaagaaaagctatcctcctgcgcggagccgcctgccgccgccttttacgcgcccaccgctcgcctactgcgcgcccgccggcgccactccgctcgcgcgcggctgcactcaccgccgcctcctcccgcctgagccgatgcgcccaccgccgccgcctcctgcccaaaccgcctgcttccctgctcgcgccgcgacggagaggaaggagagtttgtgctgctggttctccattcaaggtggcttgggtgtgcgttctgatcgatttggcgttctgatcgatttggtgtgacgtgtttgtttcagcagggaaggactgcaaggagcaccccaacgtcaagcaggtatcttggtgacgtgtttgtgttcctctgctgcgttgcctgctacaatgtgtgttctgatttggttgatttggtggtgacaagttcaagtccatgcctgatgctgtgagttcctcacttcctgtgcccatgttccaaaccgttacatatgcatttctcacttgatgtcctattgtttgaaacttgctgccttttagaacctccttagttgtctcaatgcttttacttttattactgccatgttaatgatcttgtggctgagtccttctgttttcatggagtgcattgcattaaaaaagatcccgtagatttttcttcatttgttaattatattgccaaaacgtgccttgcacgcgcacgataacatagtcagcttagtagaaagactgcatttttttcaatatttgcaatctggtttattttgagacatggtttgggcttgattattatctcattcttttgctgtactgaaattggttttggatttaattgtggactatgtctgtgtcactacaacatcaggtattggttataattcagctagaggaaagtagagtactttgaagtgtttgaatggttttcacatgtatactctgctagctaccctttagtaagtatattcatgtaaaggggagtaatagatcattgcactaatgttcaaactctattgagattgtcccaggtgtcactttgttcactgaaaaaaaaagagaacatttataggttttttttgctgcttgggagaggatgctgccgaattgaattaagacagccttcagaatctggtatatctaatggtctgtaaaattttacacaagcaacaggagggaccatcaaggtgagtgattatcttatccattcactggcagcgtacattgtcttatatgatgagaatagagttgaaatgtatttgagttcttatttcagtgcttcgtggtcgtcatttgctatgtaaacaattactaaactaataaaacacttaaatgttgcctgtcaattagatttttttaatatgtattaagattagtacgcagcccacacttttgctttctgtggtaggccaagtccatatccttattaggattaggaggaaaactgatgctccatgtgcccaaaatgtgtgtgaactgtacaagttagataataatagatggttggttagctagatccaaaacttgagctttactatggcttggtgccctgttatacaagacgtatatggataatgttttcagtattctgctttgtttgctatcagtatttttagtgcagaaatgcctcaagccactgtataatttgtatatatagtgcaacttggcagttaacaatttcctctttcatgtgattaattttcctgttacaaatttgcttccatatattcgtatccagaatttacttagcctaaagatatcagaaggagaacatatttatggagtgccgatataaatcggtaacccaacattcatgagcaagtaattatcgtgttataaattttatgccacattccagagttttataaccttaaattttatcttattacacacaccggaatcagttttatgagtcacaattcatgccaattgattaggtagattttaagaattaaggatttaaaaaataatgctttaagatgatagaaagagaacatatgctaggtaacccagcattgatataaactgacaacatgctgctgctgagaatatgtgtaacaatgccaaaatctcacatcatattatgtgtaacagggaatgtttcacatgtgatggattttgtatagaaaaaggagattcattgtttgctgaaggtgtattgaaagttgcttgccgataaataaagaccccatggatagatgcaatgatgcattaagctcttgaaggaggattaacggaaaactatgtcgagtttttagtagccttgtttgggctaacgacactcggtttattgttctagatctctgacctaagaatcctgttttagttttttttagatctcttgctttgggtgttgtttgctctaggtgttctgttgtccgcagtttcaggtgctttgtagtgtagtttagtttgggggtgttctcaaggtgttgtacagtgaattggtttcggtgcttgccctttgttgcgttggtgttgtttatgttctctatatcgatgaaagatgttaaagcttttgcctttgtttcgaaaaagattgaaaccacatacaaataaatggttgtgtgaaatgtaacattcatggatgcaaaatttaccactaagttatcaaatccagaatcatggcatgtactaaaatgattaatattatttataaaatcataaaaatgcttcacctgtaagatggcatgttaaaattaacaattgtagataatacagagtatgttttgtacaatttatattggtatatacgtgcattacatgtgcaagattactagtacatttaatatatttatttaatgtatttgtattagcttgcaatagcctcaggcctcagcccttagtaaccgactcgaacccaaaccgactatcgttccttccggctgacttaacaggaaaaggtgcaagagaacttctattggccgttcgacacgcgaaaaccaacccaatggtggcggccaaggtgtcgacccctgccggcggcgcggtgcgcgacgggctccggcggctcacgcagctctcgctcgtctccaaggtctgctcggagctggaggcgcacctcggcgtcggcgaccgcgtcctcgcggagttcatcgtcgacctgggccgcgcatccccttccgtcgcagacttcgacgccaagctcaaggcccacggcgctgacctgccggactacctcgcgcgcaccctccacaccgtcatccacgccatccctacccacgccgacgacgcccccgcccccgccccccaaaaccctgcctcccgtggcaccggtgcaagggtttgcgggaaggacaaggcggaggagcgggtgagagatggggatccggggctgtaccaggtgtgccgcgggaaggtcaccggcctggcggacgccgggtgcttcgtccgcctcgacgacgcgcgcggccgcgaggggctcgtccatgtctccgagatgcccggccgccgaatcgccgtgaagcgtgggcaggaggtgttcgtcaagatcgtgtccgtgcaggggcgcaatctggggctgtcgatgcgggacgtcgaccaggacacggggaaggacctcctaccgttgcagcgtgctaggggggaggatgatgtgccgaggccgatggcgaatccgtggaccgatcgagccgccgccactaggagaaggacgggggtgtcaggaattgtgatccccgaggacaaccagactggcacggcatcgtcgcggcggccgattaggcggatgagctcgccggagaggtgggaaatgaagcagctgattgcttcaggggttctgaatgcgaaggattacccggcgttcgatgatgaggatagcgaggggatgaattaccaggaggaaggtgtggaggaggagcttgagattgagcttaatgaagatgagccagcattcttgcggggacagggtcggtccacaattgatgtgtccccagtgaggatttccacgaaccctgatgggtcgctgagtcgagcggcggttctgcagagtgcgcttatcaaggagtggcgtgatatcaggaacgaggatcaaagagcattggttgactccatcccaaaggatctgaatcggccatgggaggatcctgtgcctgaggtcggtgggcggtatctcgcacaagagctacgcggtgttggattatctgctgaaagcatgccagagtggaagaaagaggcttatgggaagactgtaacatttggtcagacttcaaggctttcaatcctggaacagaggcagagtcttccaatattcaggctgaagaatgagcttatcgaagctgttcgtgacaatcaagttctggttgttattggtgagaccggttcagggaaaacaacccaggttacacagtaccttgctgaggcaggctatattacgagggggaaaattgcatgtactcagcctcgcagggtcgctgcagagtcagttgccaagcgagtatcggaagagtttggttgccgattgggagaggaagttggttactcaatacgttttgatgatcacactggaccagatactgtcattaagtacatgacggatggcatgctccttcgtgaaattttgttggacactgacctctctagttactccgtggtcatgcttgatgaggcacatgagaggactatatatacagacattctctttgccttactcaagaagctaattaggcgtagaactgatctcaagttaatagtcacttccgccactcttgatgcagagaagttctctggatatttcttcgattgtaatatttttacaattcccggaagaacatatcctgtggagatactctattcaaaacagccagagagtgattacatgcatgctgcgctgctcacagtatcacagatccatctgactgaacctgaaggtgatatcctcttgttcttaactggccaggaagagattgatcatgcctgtcagtgtctctatgagaggatgaagtctctaggtaggaatgtaccagaattgctgatatatgcagtgtacagtgctcagccagctgaaatgcagtcaaagatctttgaacctactcctcctgggaagaggaaagtggtcgtggccactaacatagcggaagcatctattacaatagatgggatatattatgtaattgacccaggatttgcaaaactcaatgtgtataacccaaaacaagggctggattcactgatcatcacaccgatatctcaagcatcagctaaacagagggcagggcgtgctggacgtacaggcccaggaaagtgttatcgtctatacactgaaagtgcctatcgcaacgaaatgccccccacaactactccagaaattcagaggatcaacttgggggagacggtcctcaatatgaaggcaatgggaataaacgatctactgtcatttgacttcatggaccccccagctcctcaatcactcataactgcaatggaacaactgtacaaccttggtgccttagatgaggagggtctccttacaagagtagggagaaggatggcggagtttccacaagaaccaccactttcaaagatgctccttgctagtgtggacctcggatgcagtgatgaaatactgaccatcattgcgatgattcaaactgggaacatattctaccggccaagggaaaaacaagctcaagccgatcggaaaaggggcaactttttccaaccagaaggggatcacctcaccctgctcaccgtgtatcaggcgtggaaggcaaagcagttttcaggtccatggtgctatgagaattttgtccagctaacatccctgaggagagcacaggatgtcagaaaacagctccttgagattatggacaagtataagcttaacgttgtctctgcagggaatgatctcaccaaggtgaggaaagccatcactgctggcttcttcttccacgctgccaggaaggatccccagggaggatacaggaccattgctgatcatcagcaggtgtatatccaccctgccagcgctctcttccagcagcaaccagagtgggttatctatcatgaagtcgtcatgaccacaaaagagtacatgagggaggtgacagccattgacccaagatggcttgttgaactggcaccgaggttctacagatctgcagacccaacgaagatcagtaagcggaagcgccaagaaaggattgagcctctgtatgacagatacaacgagccaaactcatggcgcctcagcaagcgccgagggtaatttgtctgtatatagtttttacttccactatagctgctctttatgcaatgtaagctgagtacttgtatgtaagtgtaaatatactctgctgataagttccaatacatattgggatattaagcttgaccatcttgtttctcttttcatttaggaagcagatgctgaatgaggttgacaattttgactgtttctatattagttgatcctgaaacattactatctttcgcttatgtttcgtgaaacttgctctttatttcatctcgaaaatttacacattgaactgttctgttcggggttgtcgagcccagcaatcgttgaagccttttttcttcagcgtatatagtgatttcctatcaagcagggtttgtaattttgaaagtaggatttctaccgcaggtgggcgatagaactgaaattttggaaatttcagattttttttttcgtacgaaattttttgaaattttgactgattttgaatgtatctgaataaaatttgatcaaattcacaaaaaattacaaaaaaaccgaaagtttcggacaagatatgagcatttcggtgggggcgaaatttccgaaatttcgaaccgaaatttcaaaccctgctatcaagcgccgaaatttggctccgtagccagaaagggaataaatttttcacacaacgaaatgataggcggtattgattatggaggtcataaaaacagaacgatgaacttttatcgctgcagagcattataggaacttttatcgctgcagagcattataggataatttgtattcgatgttcttttcagcactacaaatccgcacaacctttgctgtttcagtctgttggtatcacagctgaaaacttaggcattctccagattaatttcctgccaaaagaaatgttttacaacctttgaatatgctgtttcagttttttgctaacatcacagctgaaaagatttctccatattaatttcccgccaaaaggaatgttttccatatttcagcagttgctagtgacctcaaaagagtgaaggaatacgctttaactatctaatcagctttcctattctgcaaaaaaatgaacccaggcttccaggcatgcaactatatgcagttcctattatgcctctgttttcgggttatagatcgtcccaggcgaagccgtcgtgccgtgagagcatcaagcaagacatccaatgaacactccacagcttcagcctgctttcccagctcaaaggcaccgagctcggaccgcatatccaattcccagaggaggccagaagctgctgctgcggtgcacgtacgatcccacgctggctgcggtctaatatgagagcaatgtcaacagaagtgagttgcaggcagccaaagaagaaaattgtttaaagcaataatgtaggaagaacttgtgtcacctcaccttagcttatgcatgactgaggcgctaagcgtagacagtgagatacaaggtatgtcttcctctccccatattgcagtccatctctcctgtataaaacgttaacattagggtttacttagctgaacaaactggatgtagttgtgttccgttttatctacttgttgcataagcattagagctttgaggaataaagagttcccaaatgctgagatgacaacaaattatcgctgtctaaagatattaggacaattggctgagacttaaatggaagtgaccgaaatcagagtcaagcatcagagtcaaaagaaacctgcctgataaaggtgctcatgttgtacaatcaagtagtccaccaatggacctgtttggggtggctactggctagtgcttcctcaatcctcagaagcttccttttggttgtctgcccttaggaacctttagaagccaagctagaaacccatccatttttggtctgagctagcttctttttgttcatttatagtgctcgcttgccttaaactttcttttgtagtaattcacttgatgtattaagtttggtgatgagttgatcgcacgagaatattgttttctttttgacaaaattaaaaagtgaaacatcaatggtgcagaatcactatcaaaacaacaatgaaatatcatttgatttcatctacaaattgcaaacacatctgcaaaagaaccattcatgttgagtggtttgatctgtgctcacagacccaataattcttcctttatttgataaagggatcatggccatttttttttctaccagcacaatttaccaaatcaatcaaaaaatctctgcaagtcatcgcataagaaaatatctacttctaataccacccatttgcatcagtttctggtttggagaaaatacagtttggaacccagccaaaaaggcccttgccattgaagacaattaaaatttctcctttggaaaaaagcaaattagatcattaatctcaatctttcttttgtggccaagatgatacaagcccaaacctgttctatactgtgaatgggatctggaatttgtcttgagatttcgagtaatggtgcagggtgctggactttgtgatcttatcaagaatacttttcaaatctaagtgggaaaaagtacgaattacccccctgaactatcgtgacagtacgaattatccccccgaaccacaaaaccggacattttacaccctaaactttctaaaccggataaattacccccctaatacaaactggagtggttttacatctatgtggcgtccacgtggcaatccgatcagaaaaaaataataaaaataattaatgggcccacgtgtcatctcttcacactgtctctatctctctcagatgctcaatacgaggcgagtggagtgcgtgtcctactcatccacgtaaccacatgctccaattccatctcaaggatcaagcaatcccggacgccgccgatggcctcgcgctcgcggtggtagtcgctggcggcgagcgcgctgatccagtgctttgcggggagctcctactgcttcgccgtctactcctcggcactcaaggcctcccaattctacggccagtccgccctcaacaaggtcgccttcttcaaggacgtcggcgccaacgccggcgccacctcgtctgggcagccggcggcggtggcggaccaggcagccataggtggaggcggcaggcagccggcagcggaggcggacagcggccacactccacctcgacgccgtcgacgccgttctgcgtcaccacggcgaggaagctcgtgtcctggtgcgcagggagccccagcctcccgccgacctccaccccactgccaggcgccacgtactccgacagccgaagcatgaacgccatcgccgctgcctgcgcctccccggcctccgccgacgttgcaccgccacctccagcgcctccaccgtcgcaccatccgccgcaccgcagcctccaccgctgtcagcttctccgtgtacgcgagcaccgcctcctccgggaacacggtggccggccacatccaggcggcgaaggcgcggacggcgtcgggggagagcgggtcagcgatggccaggctctcgtagggcaggccggggatgttgccgacgtagcccatgacgagctccacggagacgtgcgccgcggcgccgacgcggccctttctacgactcccgcaaccatctccccactgtcaggagccgcggcggcgagccgatgcgcgagtggtcgtgaggaggcagtcgcatgaacgggaccatgccggcgcctagtcggccttcgcctccgtcgtcggccgccattgcctacctgcggagccgcctgcctgagcgtgcacacgggagagagaggggtatgacaggtgggaccaaggaaggcatttttatttttatttgctgactggattgccacgtagacgccacgtgtgcaaactcaagtgaaaaccgctcaaaactgtgttgaggggggtaattcgtccggtattaaaagttgggggtgagtaatgtctggtttttgggttcaggggggtaattcgattgaccgcgatagttcagggggtaattcgtactttttccaatgataaaacagagttagcgaaaactcaagcaatgatatttcttaggaattactaattatcctaaaactttcaagaatattaatatgtattaggtatgtgatatactttgttatcattttattcaaatatgggtatactgtctacagattatctggatatattattccaatataggtatgttgtctaggcatttttaggataaaaattaagagtaattggttttttctaattgccaatgaggttttttattttcaaatatttcttatctttatattataatgtactcttactgataatacatgtaattggacttggctactagtatgcatcacattacaacacgtcgaggaaataacaaccttcacatttgcttgaataaaaagttagtcctctctaatcgtattgtaatcaatcatcaaaatcattaggggcctagatgcacttccaatctctccatttttgctgattgatgacaatacgattagatcacaagagagaatgaatataatagatgattttggtgcaaaggtttagtgaaagctccccctcaaagtgtgcattaaagcaagtgaagagctccccgtaaatctttgcatccacattgaatctcacaagacaacaaatatatcacattttactcatcacatacatcacttcatatgcataataaccattacatctcatcacaagcacaatataaaggaaatgagacattgcatcacattaatcataaagcataataatatccattacattccaaacatccataattaaacaataaggtcttacaataacattaaactaactcaagaaccacacatagtcttatacaaagaaaaaccaactatgatcgaccataataaaaggatagatattctccctttttggcatcgaagcaccaaaaagagaggacgaagagagaaactcagacaaacggcgcctgggaggatcctcaagaggaggatagcgaaagccatggccaaaattgaagaaatcgtaatccggaggcatcccagcaaaaggatcctcgatctcttcctacccatgctcatcgggctcggcctcaaagcccgaaggggagggagagacatccacgtgaaaatgctcattgagctgcgcctacatgttcttgacgcgccgagccgtcttcttgacctcgttccacgctctgcggttctttttggcctccgcagagcaaaggccaaagagactcagcaaaatgcggaataagggagactgctcacaacgagccacaagagagggacgctcacgaggtagtaggaggctgagaggatgtggaggggatgtcctgaggcacagaacaacgcttgggtaagcgcagggagagaga

SEQ ID NO: 51592 - DNA, 12563 bp, Oryza sativa
gcccctgcaatctgggggcccagatcggcggcaccgctcgccccccgccagggccggccctgcatgcgcagctgcccactgctccgcccgctcacgagctgcctccctcgtcagctcatcatcggtgttgtcggaggcggagacagagctattggtgctactgtcgcgcaaagccttgagctctgccgccgccgcacgcgctgcatctgccgctgccgctgcttccacttctacccttgccgccgccaattccgccgccaccagccttgatgctctcgctaccatcgcagaagtctctgccgccgctcgctcgtgttcccctaccgcggcgagctcggcctcctgccggagccgcgcgctcgaggcgaccgagcgctgagactgtcctacggacatggcacgctactgggaggctgctacgtggggaagaggctgcctctgatgagctgctgcttgtcagcacaggggaaaagggatgagcaggaacagtcggtgttcctgctgccggctgaggacagaggggagctcaagaaggggatgagcaagagatgtctaggctacaggatagaatggctctgataccacttgttagtagcaaaatctttactctcattgagaggatggcgctaggagagttggggcaattttctgtttattttctcatgaatgccataccatctcgggggagggtgggatacatatttatagctggtagctggctggctgcagctagtctagagcatcctagagctagtctagatgctgtcctagaaagtgaaaaaggaagatgctgtcctagagcatctaaaacagaaagtgaaaacgaagattatgcctagagcatcctaaaagctgaaaaagtaaaaagatgcaaagactaatcagccacaagacttattccatcaaaccataaggttgaccttagagatggtcagagtcaagatgtgctataaggatcaacagcgtactccctccgtttcaaattatttgtcgtttcaaggtttgtcctaagtcaaacatgtctatctttgaccattaatttttagaaaattgtgtagtttaacatgtgaattatatattatagaagtatttctcatggtgaatctaaaaatataaatcttataatgttaaactatactccctccattccataatataaggcagaaccacttttcttagatgttccataatataaggcatgcatgcaagcatgcaattaactatgacatatctctattaaattactacttttttaaaatattccactctctatgttatctaatcctatcggatgcatgcattatatttattaggatgatctaaactataagatgataataattattttttggtctttgggttaatggtggttgtgccttatattttggaatggagggagtatgagtttatagaaattgatggtcaaagattaaaatgtttgacttagtacaaatatagaacaagtaatttgaaacagagggagtaccatatttgttttcaattctgcttcgctttcatcagccttattatgagtttgccaaagggcagcctcatattcaatatactctcctcccttgaagattgtcttatgttgatgcaagagtaaggatagatgtcttattcttcagtgttgacatagaatggctgtagaccctcttctctcttgtagttagccttatttattccaattcctaatctataccataaatcaaagcccttttagcgcaaggttctctcctccgaatacaattctcactaataggagtaactatatgccaatgtgccaataattgtagaagactttattattatcctaaataggcggcaataggcccatcaagaaaaagtctgactaataaatagtaatatagctagttgccacacatagacttgaggtaagggcttactcatcctagtcttctctttagtacactacttagttataagttataggatcagaatgagattttctttgaacgccgttatggggagtgagaaagcaagctagacacgaaaactcaggatagacaaaggaaaactcgggatagatgcgctgcttttctagctttggttggaaatagaaaagtaagttatagggcccatgcggcattccctcaaatagcagtttttttttgtctgaagaaaagttgctattaataacagtcttccctctttcataaggctctaaggctgagttcgggagcgagggttgggaaccttcactcccaacacgcaaaacggagcgacgatcagtgcatgatttattaagtattagctaaaataaacttgaaaaatggattaatatgattttttaaagcaactttcctgtagaattttttttttcaaaatacgcaccgtttagtagtttgggaagcgtgtgcgcggaaaacgagagagttgagttgggaaaggttggggaagaacacagcctaacttgtgtatggaatcagggagctacagttgtttcccgccccttctgttcggatcagatactattctctacggaaattgaaagaattctttgataagataaaaaaaattaattcaccatggtaatatctcataaccctgttatgttcaagtgtactataataagaatttcaataaaaaagattgaagcccacataattgtgtgtcagtgtcactctatgtacttggcagtattatgactccctactacagtgaaaaaacagtatattccaaaagtgatcttgatctggagaatgaagatggtgaacaattatattctatctacaaaagatctctttccaggtttcctttctgttttgtttcccttcaatcttcatgcttcaattatttgttattaagttaccaagttttccactctttctttaattatgattcctgatgactatggatggaataatttcatgggaagaattaattccaaaagaggaagtgaagtcggggcaaatgaggaaaacgtcctacagcttcgtcattgggcttctcttagagggcagacactttgtagaacaggtagtttgatcataccatctggcttatcttatcaaataaggatgatttggctgactccctgttatatttgttttctttttccgtgaatcatgatgtagcatcaagcgttccttgacatggttttttaatctagtaagcctcttcagattccaggtggagcattatttttagttccttcaaaaatagtcctgaatctggaagactttacctagctaatagtggactgagttttcaattatgaagcaagcatggatgagggggaatagtgcaattcaagaagctatgggatctcagtcaattgtgcagctagatcttttgatgaccttagccaagactgaactagcaagaggtttcagaagcaccctgggggatttcataatcatgacgcttcagctctgttcagtgttcttcactttctaccttgggaccaagtcacattattttcgacacacaattctccatggtggtgcaaaatatagagcaactggcagatgtttttttgttcgccatgtaaggttgactgagaaatacagaatgtacttcagaagccactttgtgaaaggacttgagctgatgttgctgctagtagtctatcagttttaaggtgatgttgctacggattcatctgcctatatacttctgacatcatcaatatagctcttggttatcacttggctcttcaatccatcaggatttgattggcagaaaatggtagatgactggaatgactggaccaagtggattagcagtcgaagtggcattggggttcctgctaacaaagcttaggaatcctgatgggaggagaagcagaaacatttacagtctacaggtctactgggctgtttctgggagatcatactatctctcagattcttcatgctccaatactgtatgtctgtatcatgtatcactgaacaaatgcacctagacacatatgttgctactttccagacacacaaaaatcagaattacttacttaactaggtaatgagcccacccaactacctatatggaaatcggaattatctataatttaattacgcaatgagctcactggagctttcagttgttttagtaaactatctagtctgaatcatggtatcaagataacatgaacaaataatgtttagatgtaaacagaaatccagactaaagagggagtgcattacgttgaatgtgaaactcactgaactaaccttgagccttctgtataatgcagcagaattactccatgtaccatcaagcaaaacaaagttaaaaggttcatctttcacatcctacattgcaaaagatatttcattatttcatccatacttatttacatgatgttttagagtgtgcagcgaacctatttggatgtgccatgtgcagatgacattgtgtagatgtctcataaaggtaatctttgagaacttataactagaaaaaggaatggtcaaatgggtgtgggtaattgatatcttattgatgtcttaaaatgagaagtaagaaagcatggaggaagtaccatgttacttctacaagaaaatacttgttctaactgcattagcatgggaaaccagttaccccaaacaccatcagtacttatcatgttggataaaaggaggtgattggaaaaacagatcctccaaagaaggcagcattgtttatgctatagaaactttactaaagataggtgtgttggataagtctttgtggtccttggtcgtgattcttctttttgcttttgggtagtttcacctttttcaggacagcatctaccctttagcatatttttcagttgctaggacagctgcggttagtaggacagcagcagttagtatctcctttatgcctcctttatgctttattcagtttggatgccctctaggacagcatcccattcaaatttcgaattttagactaggagggtgcagcaataggctagcagccagctatggctatatatatgtatccaacctccctcgggtaggtatggcttttgtgttttgtgaatgaagaaaaccagaaaattgccccatctcgagtgccatcctcttctcaatgagagtaaccattgaaattctaacatctggtatcagagccacactttcctataggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcagcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgggcaaagcggtgggcagcagcccacctccacggcggtggcggcggcccaagggaccgcgcgcccgccgacgggaacccagacgggcgcgggcgtgccggcggcagcccggagcccacacgtggccctcacagacagcgcggctctcccctgaccggcgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcaggcactggatgccctcatcgctgcagtcccgcccgagatgcagttctcgctttcccagaagcggactgccaaggaggcctgggacgccatcactacggcacgcatcgacagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacaggcagatcgctcgctcgatcgaatctctgctggacctctccacaatgtcgatcgaggaggcgttaggtcgcctcaaggtcgtcgatggtgatgagccacagcctctctcggggcccatcaccatcggcgggaagctccatctcactcgggagcagtgggaggcctctcagggtgacgggaggaagagggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagcaggcacgagacgacgcctgccgcaactgtggcaagcttggccattgggccaaagactatcgacagccacgacgcggccaggcccacgtcgcacaggtggaagaggaagagccggctctgctcctggctcacgcaagcatcgagctacctccagcggcaccggccgcagcggctttcctccaccttgatgagccgaaggtactcgtctccctctgcaacggctccagcaacgacaaggctgatgagtggtacctcgacaccggcgccacccatcacatgaccagccgacgggagttcttcaccgagttcgactccggcgtccgaggctccgtcaagttcggggacgcctccggcgtggagatcaagggtgttggctccgtcaccttcaccgccaagtccggtgagcacaggctgctcaccggaatctactacatccccgcattgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtttgcgtggtgacgaagcagcggcggctcccctttccccagcagacgagcttccgagccaaggagtggctcgagctcgtgcacggggacttgtgtggcccagtgacaccggccacaccaggaggacgacgttacttcctgctgctcgtcgacgacctctcccgctacatgtgggtgatggtcctcggcagcaagggagaggctgcggacgccatcaggcatgcgcaggctgctgcagaggcggagtgcggccgcaagctgcgcgtgctgcgcaccgacaacggcggcgaattcacagcggctgaattcgcgtcgtactgcgctgatgagggcattcagcgccactacaccacgccgtacagcccgcagcagaacggcgttgtcgagcggcgcaaccagacggttgtggggatggctcgggccctcctcaagcagagggggatgccggccatcttctggggggaggcggtggtgacggcagcctacatcctcaaccgctcgcctaccaaggccctcgatggcaggacaccgtacgaggcttggcatgggcgcaagccggcggtctcccatctgcgggtcttcggctgcctcgcgttcgccaaggagcttggccacatcggcaagctcgacgacaggagcaccccaggggtgttcatcggctacgcggagggctcgaaggcctaccgtatcctcgaccccggagacacagcgtgtgcgcactgcacgcgacgttgtgttcgacgaagggcgagggtgggtatgggacaaggcggtggacgatggttcgactccgacgtacgacgacttcaccgtcgagtacatccacttcgagggagctgggggagtaggcagctcttcttcaccgagcgtgtctaccccagccctcgaatctccaccgactccgacaccaacacaccctcgggccacgacttcgactacgacgagctcttcgtcgacaccaccccagccagtgactccacatgctccagcaccaacagccactcctccaagcacgtctactccgacgccagctcgtgttgagcgcagcccagtggagttcgctactccgctctcccacgacagggagcgcatcgacgcgtaccacgacggcgagcagctacggtaccgtacgatggaggatcttctcggcgaccaaccggtgccaggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgagcgatcacccttaagtgggtgttcaagctgaagagggatgaagccggagccatcgtcaagcacaaggctcgcttggtggcacgcggtttcgtgcagcaggaggggatcgactacgatgatgccttcgctcccgtggcacggatggagtccgtgcgactccttcttgcgctggctgctcaggaaggctggggcgtccatcacatggacgtcaagtcggcgtttctgaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatggcttcgagcaaagcccgcacgaggcggccatctactggcggggcaatggaggaaatgccttgctggtgggtgtctacgtcgacgacttggtgatcaccggcaccaaggatgcggaggtcgcggcgttcaagtgaggagatgaaggccaccttccagatgagtgatctggggcctctctccttctacctggggatcgaagtgcaccaggacgactccgggatcacgcttcgacagaccgcctacgccaagcgcgtcgttgagctgcctgggctcaccgattgcaacccagctctcactccgatggaggagagactgaagctgagccgcgacagcacggcggaggaggtggatgctacacagtaccggcgtcttgtggggagccttcgctacctcacccacacacggccggacttggccttctccgtcggctacgtcaatcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctcttcttcctcggcaagtgcctcgttagctggcagtcagtcaagcagcaggtggtggccctgtccagttgcgaggccgagtacatggcggcctccgccgcttcgacccaggcgctctagcttgctcgactgcttagtgttctcctcggcagagacactggaacggtggagctcagggtggatagcaagtccgctctggccctggcaaagaaccccgtttttcacgaacggagcaagcacatccgggtgaggtaccacttcatccaaagctacttggaggaagggagcatcaaggcgagctacatcaacaccaaggaccagcttgcggacttgctcaccaagcctcttgggaggatcaagttcctcgagctctactccaggatcgggatggcccaacttccccacaagacgacgcacaagacttagggggagaatgttggaaaagtctttgtggtccttggttgtgattcttctttttgcttttgggtagtttcacctttttcaggacagcatctaccctttagcatatttttcagttgctaggacagctgcggttagtaggacagcagcagttagcatctcctttatgcctcttttatgctttattcagtttggatgccctctaggacagcatcccattcaaatttcgaattttagactaggagggtgcagcaataggctagcagccagctatggctatatatatgtatccaacctccctcgggtaggtatggcttttgtgttttgtgaatgaagaaaaccagaaaattgccccatctcgagtgccatcctcttctcaatgagagtaaccattgaaattctaacagggtgtgcaacagtgcaacttattaatacacagcttaaagaacagaataaatacctcctccggatgatcacaactcaagttcaaaccatcaaatttaagatctttgacagacatgggggttgtactcttattcggatatagaaatgaaacctttccctttcctggcaaaaaccatatcagaatggaaatatacagtatttaaacatgaagtgcacagatacatatatccttgctaaatatagcagggagagtagagatattagacgacaaattaatgaaataatcttccatgggccacaagaaaattaattcaaatcttatttctattactagttcatacatttttacttctggtttggatttgtttctgtgaaacactaccctagttgttcaatgcgccaacaggttcaaaacagcagccacgaagacaacttccaatatgcaacagtatattcatttatgcaatgattaaaatagaaggatagaatgcaaacagaaaaggaacatcgataatgcaaatattttcagtactagcaatgcattgatgaaataacaaagaaaagatcccctggtcattagattgtcagtaaatgtggacatttttaagctccttctaaattaaaaatgccactcaatatgtgaagagggttgggacaggaatacacttatctagacactagcacagagaattccaaacgagcaaatataatcttttactaagcatttgcatttctaaagaaaggtatgttgcagtgtaatcactagcataatttgtgtagttcgcactaattccctgccccttccaagaagaatacttaacagcagttgagagtctaaaggccagttatgtttccagatcataaacaagagcttaaactttaaacacatcgggagagattgtgtgcgccaaagaagcttaagagaaaaaaaacgttgaacaagcatgctaagtgaagctaatgtaaactactatacagaaaatgggagctcctgaaagcattagtatacttttttaatgtaactgatttcatatgtttaacagatgaaagttggcattgacttttgtaacaacctgaacgctggaaagcatcccacataatgtcttcgtgctcttggatgccaaagagacacaagggtgcagcttggatgccaaatacttgccatagtaactttccggtattgttttggcgcaaaaagtcctgcaacaatagagtattagagatactggcatacccagaagaaagaacagaacaagaaattcaacataaacccctttgaagagaccttcggatgcatatatagccagaatctaattccctgccatagattgcaagaaccaagcttcgcacacatacaatcttccattggcagccaacactgtagttttaagaggtaggcagatcaggcaaactgtgggaaatgaagaagagcaaagaaagggcacataaatgttagtagcaaaaataagcttcagttgaataaaccattaaggcctgattgctgcattgtgtatgatcgctgcaaaaagaagtgattgacaagatgtgcatatactagctgacactgtcacatcaccttctggcacagatatcctctactccctagcaagcggcaagcaatctgccgcgcggagaagtactgcagcttcttgtccgagtcggcgagcgtctggtagacagccctgtgcttcttgtcctccatgtctttgaaatcaccctatgagtaaccagttcaagaaacaagcaaaccatgagccgatatcagtttcaattcctgcaatgctgtatcacctcgggaatctgcaagcagcatccaggacgtggaaggggattgagatgaagccaacaagccgtttaccttaatcttggagccgacgccgccgaagcgcatcttctggccagcctcggcctccatctcgagaagctcgccgacgacggcggccaccgcggccgggagcggcgaggaggtgccccaccgcctccactcctccgcggtgacctcgccggggccggtgacgggcgggagggcctcctcctcagcctcttcggccgccggctccgcggagaaggccatggcaaagcgcgggggagcacggtgggtggggggctggaggaggtgggggcgaggggg

SEQ ID NO: 51593 - DNA, 1308 bp, Oryza sativa
gggggagggaagcggcgatggaggaaggcgagggcacgcacggaggagggagaaaccagcatctccgcccgctgtattttttaatgctcttcggatcggccagcaggcggcggcggcagcagcagcagcgcaactgtcgactccactagtcaggattccacttttccattctatgaaaggcaaagcaatatccttcttttgatttggagaacaacataaaaattatagagaattttaatcttatagaaaaaaaatttataaatgtctttaaatcaaatgattgaattatattcaattctttaaaattcctatgggatagacaatcctacagagatttcatagaaaacttagcgagagcttaaacctcttggaaaatttccttcgaatctatctctctcatctggttcctgtattttttctatggtccaatcaaacggttattcctgtgtttttcccgttattttacaattctctgttttacactttcattcatgttagaatcatatgtttttcctattcctccgttttttcatttttgcaattcaaatgagccttaagaatatttggtctacttatcactattttaatattactcaacatcaaatattattgatcggaagaattgttcttatcctcaacattcatcacggtcaataatatctcatgatattagcaattactccatctatactaaaataactcaatctagatgtgacatatccttattcaaaattgttatagcgtgatacttcgtatctccaacccattatagcttttgttgttttggaacaaggaagtaaggtcatgtttagttcccacgcaaaaatatttcaccatgtcatatcgaatatttggacgcatgtatggagtattaaatatagacaaaaaaaactaattacacaaattgcgtgtaaattgcgagacaaattttttaagcctaactacgtcatgatttgataatgtggtgctacagtaaacatttgctaatgacggattaattaggtttaataatttcatctcgcagtttacatgtagaatctatgatttgttttgttattagactatgtttaataattcaaatgtgtgtccgtatatccgatgtaatacgccaaaaatttcacccctaaactaaaaagggcctaaatcgtttgtaattggtctgagtcatggtttaaagcattcaatctaaaccgaaattgttggtttggcttctctagcactacctccatccaaaaatataacatttttagttatgaatctgaacaagtgcaaatccagatttagagttaaaagttacttcctccgttt

SEQ ID NO: 51594 - DNA, 2174 bp, Oryza sativa
  unsure (1)..(2174): unsure at all n locations
cgtgcgagccagattttttgaaagaaaatgcgagccagatttcatagagaacgatagttagttttccttaaaagagctaagagacaatgcgccacacacaataaagcagtggcggatctgacatgggacataggggttaagttgaaccccacccccccccccccaaccccaaacttttttcggaacaaacatttgttagtattaaggttaaggcaaatttctactacaacgaagctagggttaacgcaaattcgagaaaaaaaattgcgtgggtggagagagggagatgagacaagaggatgtgcgtcgtaagggatgcggcggaagcagcaggacaagcgacggcgaccccgctcgctcgctcgagcgatggatggatgggaatcggcgcaagcggcggtggcggaggatgtgctcacctggatgcggcggaagcagcatgacgaacgacggcgccgacggcgccctgctcgctcgcgcctcgcgggatggatggggatcggcggcggcggcggcgggcgaactaacggataactcacgaaaacaatacgtcaaaaacggcgagggtaatttagtaatttcgccaagcactctcaatctgcatatcctatccccctccaaaacggtgcaaatctgaaaaaagaaagtatccatagcttaattctattttccaaacggaacatatatgacacctttgggatggtagatttttattttattttattattcggaattgcatgattttatttattactccctctgtttctaaatattattaatttttttcatattatttgattcattgttaaatatacttatatgtatacatatagttttacatattttcagaagtttttaataagacgaatagtcaaacatgtgctaaaaagttaaaggtgtcccatatttagaaacggagggagtatatgattgagatggtggataataaataataaaggcaattacaaatttgccactggtttaaatcattaattattattgcaacactgccactaaaaaattgtaaaaatactactagaactgtctttcgagtagcatcttgcaaaattaaaaaaatatggacaaattttacaaataaccctaaataataatatgcatgtctgggtagtgggcactgcccgattagatatggttcactggacaggccgtgtcatgtcagcccacatgttttatcgagtgtattcttccgaaaatcacatcgtatagtatcatatagctagaaatgcgaagttaggatattgtctggtaaagtttgactaaaatatgttacgagtataattaataaaatgagctacttttgaggaaaataaaaaaaatagtactagaagccattaaaacactctgaaaatagacaaatagtacaggcgtacagctaaccgacatgacagtgatcagcataatgtttatgaaaaagttttgaaaatggacggtgccatctccagaacttagacatttaaaatctattctcgngatattttatttacttttctaaatattaaaacatactactaccaactactgcaattttcgcaccgtgtcgatatatacgcacacgtccatccacatcatgtactataacaacgccgcgtggattccgagtaattattttaaactagtaaaatcataatattgaaaatattttttgacgattgtactgaaataactttcatatatcaataaattattcttagagataatgataaacaaagtaaccggaataaaataaaatgccacttcattttctgttgtagtcaaaactctaaattagacaatttggtgctaagttctcccacatcatcgacttagcaaattaatggatgtcaggaaactaactagtctacggagcttaagaggctcacttcttttgataatatcatcatatccacggctcctttttttactaagtaccatattaccgcatctaaaacgacggatattatcatcagcaaactctctgaaaaattgtcatggtctcagcctaattaagccaaacatgcctctgtcggctattctatacttggctctcttgagtcttgaccaaaaataattagcgcgtgaagacgtgcatctatcgatcaccgtgtgcacgacccccaaatccatcaacacaaccgcaacatctgtttcaaccttggttttccaaatgatgatgg

SEQ ID NO: 51595 - DNA, 1562 bp, Oryza sativa
ttcttgtggccacgcaacttgtgagatgtgagttgtgactcaacttgggcctgtacttgaggagcaaaagaacttgtcgcaagttgtactactaaggcgctgtttagttcgcaaaaactttttcccaaaaacatcatatcgaatctttggacacattcatggagtattaaatatagataaatttaaaaactaattgcacagttaggggagaaatcacgagacgaatcttttgagcctaattagtccatgattagctataagtgctacagtaacccacatgtgctaatgacggattaattaggctcaaaagattcgtctcgcggtttccaggcgagttatgaaattagttttttcattcgtgtccgaaaaccccatccaatatccggtcaaacgtccgatatgacacccaaaaattttcttttcgcgaactaaacaggccctaattaataagtaggagtacacactacacagcacaagcagtacgagctccatggaacttgtggccgaaactctctgatctatctctccatgaaaacgaagaagtatgagtttcgttttcggcagctcgaaataacaattttcttgtttttcgttttcaaataacacgttccctagatcaatataaacaatgtgttttgtgtaaaaaaatatatgtaaaagtattttggaaaaaaatcaaataaatatatttttaaaatttataatagcacatatatcatgtgctaataattcacctgttttcttagccacaaatagcagcttgttgatttgaaccggcccatagaaaccaaaggaaatttccctttcctacaagttgtagagaagaaacttaaggaattttttatccactcaaatctcttggaaaattcatatagactgaagtgtgcatgaattcctattcctccacattttcttattcatgtgtgttaaaatccttcaaaaacgaataagcccttaatgttgcaagtcgaagccaagtagctttgaatacaataataataaagaaggaacgaattacaacctacaagtataataacacataacaccatgggactaatttcctatcttttttactgccatgatggataattgaccatatttgtctttctgaatgttcagattaattgggttgtttgggcctgttggatcatagttttctacagctacatgcacgctgaatctcttgtttttactgcagtccatcaggcccggtttctgtcaaaattttcacatgttaaagggctcctttgccgcttgaggtgaatcaaggtcagaagggacacaggttcaaatcaaacacaccccaaacgatacgacaactacagattcaaacaacacaaacatgaaaattttgaccacacacgcagaattacaaactagcaagattgctttatggcaacgttaacaatcagtacaatacagtacagtacaagtaaagtacaagaactatggaagccctagctaatagtacgacgcgttgagaaagtcgtcgccgaagctccagagccccacgctctcgccggcgacgttcgcttcaccggcggcgaacagcccgtccatga

SEQ ID NO: 51596 - DNA, 1340 bp, Oryza sativa
ctcagagtcctcacgtccgaatctctcaaacgccgcctcgaagtcgtcatcacacccgcctccaccaaccttccgccgcttctccccgtcgccgccgggccacacatgcgccgccgtggcgggccgcggcggcgtggccggtatgatgttagccagaatcgcgccgccacacatgtcgtcgttggatcttgggtttcctctcgacgatctgatcagttcgcacttcgcagtagctagttgccggagctggacatggtggcggcgcgcatatatagaggcgggcgcttggatggcgcgaggggaaagcagcgcgggaaaagtagggggagaaaataaaagaaatggtcacgcgggccacgagctcagtacgcgaccctccaaaattcgtgggcgacgagacgagtcgagccgagccgacgacgttgcgaggcgctcaagggtcgtgggtgggaggatggaggaattgaggataggaacggcatattgcaccaaccgagtacacttctgacctttctctctcgtcgcctccaccgcttggcaccaaaaggttttcagaacctgaacctggtctaatttctaaactcccagcctggatgctcagttcctactactactccttgacagttgacacacagtttacccttgggttagaatttcgtaagaagttccataaaaaggataatccctttgagtaaatttcacaaaaccgtttacccttcattgaaaactactccctccgtcccaatatataagaacctagaaccggatgggacatttcatagtactacgaatctagacaggcaccggatgggatatttcctagcggcatgtccagattcgcagtaataggaaatgtcctatccggttctaggtttttatatattgggacggagggagtaccatagtaattacagacttaaagctttacacataatcaacgtggtccaatttatcataaaactatatttttaagaaatgatatcacgaagctacagatttatcgctttgtacccagtttaactttgtgtattttaaaagtttcatcaagataacttttacaatatatacttttgcaaagcttttgcaattaattatgtgtttaatatgtgctttttacgagataccatagcttagatctatacttttgtgatcaattcgatgttaaatgcgtattttgtgacacaacaacttaaacatgtgattttgtgacagttttatcaaaatatctgcagttttgtgaaatttttcaataatcctattttatataattatatgcagaaattttgtacgagctagttgttcatttactgcgatgaacagtgaactccaatgttataaac

SEQ ID NO: 51597 - DNA, 1543 bp, Oryza sativa
gtccatacatgattgcagcgtttcggtttgtataatgcaatgaaatggcgctgtcatgcgtgttcccatccatgattcaacttgcccaaaaaaaagaaagaaaaaacttttctttttgaagttggctggctcttgctgtgatcgatttgctttgtcgtatgctggaattgctagttgagcaactcaactctacctacttgagaaagcatcttgaacaggttcactgtttctctgccaagaacgcatggacggcttctagacatagcaaatatttattcgtgtcccttatctctaacatgggggaaatatcactacttttttcctagcttttgggggctctgtatgtggcctcgcagtcaagttgaggcttaacaaatgtatatatctcgtccttttttgtttactcgttcggctcgaacaatctctgctgccatctccaatcaattgactttgatgaaatagtccaaaacagaaaaatgaaaactcaatagggttgtactcatattataaatttatataattcatggtgaccagaggagacgaacaattacaaatcctctttcgccttgtgaaagagagagatcgttctgtgtcgccgtcgagagccaaagtaacttcactgcatgagaaagtgaaagatctgtttcgtgccatcggtgacacggctgtgtcaaagctttgccttcacaagaagggaatcagtgacaggaacaaacagattagcagacaaacacggcatggctatggccatcacccccgtgttgtcacagcgatacagtatcccacgacagggaaattcaagaattcagaactgtttgaagttactttctttctttctttctctgtatattttttgtttcttttttgacggagatgatgttaatggaacaatgaaggtactagtagaagtagtgtagggataagatcgaagattagcagcatcttttctcgctgtttggaggccatgatagttgctactgccgacagcaagttcgttgaagcgacctgatataaactcgccaccgaaatgatcgacagcctgatagatgctggtgggtcatttgatttctcgttggtagagtcgcatctgaatgtgaagcagtgtaaagatagatggggtaattcatccatattccaaccgattttgcctttcatgtgaatctgaataggagcgcgtttcagataattttgcctttgcactcgcagtagcagtaactaatggtctagtctttgttcaaaaagcataccagatggtgctgcgttcggcctaacactatcttcttcttgtgcaaaagattcatcaatcatgttgaaagaaccaaagaattcttgaacatattaatcctgtcttgatttcttgaacatcaaacaacataaacatggggattaactgaaactcagatttttgcatcaaaggcacagccaaaaagatcttttacgagaacgagaagcctcacataatttttcattaccgaaaggaaccaggacgaacacatgcttgcttggcaaaaccactcttctatgtacatgacatggtacaaga

SEQ ID NO: 51598 - DNA, 1009 bp, Oryza sativa
gacatatatattttgtgtggatgatacgcatatcagcatatggcatgagaacaaacaagtagcgtagcacacagcggatggatagctgcctgcaacgcgtcactttaatcttttgtaggacgcatccatatacatgatccacatagctagatcgcttggttgctgacaaagattggaaccatccatccatggatggatcatacatatatcctggacatacaacactgatgaattgatgatactgatacacacggagtacagatcgattcagttcattgcaaacgcggcatctacttattaatggtagaatatgatatctaacgcttaccaatattctgtaatccatatccaacaccactctgcctgtctccatacaattttttttttactaatgcaagcataattggttggtacacgaaagtttagcacaacgtgttgagaaatttatctctcggcatgaaaactgggagaaaatcacgctatggccatttccaccggttgcccatgcgactttatttctctattcacgtgcattgatcaatagcgctaatttctttttttacatccccaatatccataacgaaatattaatagaggatgccggtgttgtgttatgctgacgaataaccccaatccttagagagcgatggaacatatccaaagggtggttccagatcaatgcaggtggcactccgaaggacgacgccatactgcagttgatcgccggtgacccatttgggatcaagccagtggcctcgcatacaacactgcttgcagccttgctatgactgcctcgcatacgtcgacgaacattagagcggtacaagggacaacgtccccctattttccctctggttgaataaaaaacaggcgcaaatatgtcaaacaaatggccagttagtccgttacccctaatatttaacatcggggtaatctttaggcttattatgtttagaagattagaaaatctacacaacatactttgtcttttttcgaacacaatattttg

SEQ ID NO: 51599 - DNA, 711 bp, Oryza sativa
taatcggttttacacatatcagtcaaaactttgcagctaaacatatattttgcagctttttagtacgtaaccgcaagatatccgacaaacaatccaactgggagtttgaaaacgataaagcaagccagtaacgcagatgattacgagacatttactgcttttctgcccaacacaaacaaaattgatgatgcaaccacggggctcagtagagagatctcacggtatggccagttacaggtccgtcgtcttcgagctctttgaggacgtagaaactggccagctgcaagtattaacattaccgtgattacaagtaatatacctaccctgagtttccagttagcaacaggcatgctcagttttatcccaactggctcggtcccgccgatccattccgcgcgaccgcggcgatcccgcggctccgttccgcgcgatcgagcggacgtcggctcggtcccggacgtgcgctgccaccgcgccggaccggctcggttccgtactctcggtctacgtgaccgagccggtcccgcgtcaccgttccgcgcaaccgctgcagctctcggtcccgccccaccacgccgtgcatttgtttcgctcccacgttcccaacgcacgggagaggtgtatttgcgcaaatcctcctaatcctttatatataaacataaattatgagaaaaaatggttatttttaattttttttcttcacttatgtat

SEQ ID NO: 51600 - DNA, 1523 bp, Oryza sativa
caagatcagactaacacaatagattcacctgtatttttaaaatttctgttcaaaaaaaaaaaacctttgtttttagcgccaaccgggccatgagtgcagcagcagcatcgcctgcattgttctcctcaatgaagctgattgttgaattgataatcaggaggcagacaattcccaggaaatcttcccagtcagtaccttggctctgaccaaagacagtaaatgagtgaataataaagaaaatccattgagttgcttgcacaaattttcgacgatttgatgtcaatatttcaataacacaaagcaagcacttacaccaccatttgctagaaccaatgccatcactgctgctgcctccatcacccaggacaaaggattccacataaagctgaggaacttgatgatcttgttctcctgacaaaaaagatttttttaaaaaaaaaaattcaggagttcagaaaaggaatatgtttcagtttcaggtaaacgatgatcagaaagaaaacagtcaacttacacgcttctcctccaatctgtttgcaccaaacaacttcaagcgttctgcagcatctgctgatgagagcccactctgagacgtattcagctgctcaaaaacgtcttccaggggcagattctcctgtcacatatccacaagaatcacggcatttttcaaagaatgcttcaaatccacgacatcctaacaaatgtacttaccaaatcaacatcttcgtcgaagaaattctctagcccaagcaaaggttcacctggttcatccatgccttcagctaaaatctgtcgcccggaacagaatgtgaaataatgaacacggctacagcatcgtcattttcattccaaatgttgcagtgaagatctcaccacgcattagacaatctgatggacaagatcacaggagatttaagtggcgttagcgaggggggttttggttggttcttcttgaagtgttaaaaagatggcagcttggactgaactggtacagtgagaagaccttgatttgggctgatccaaccaccggtcaaaccttcagttagtgagcggacggtcacctgaaaccaaacagtcgcctccgattaccgtgagaactgagaaactgcatgctctcgtgtgcagatgcacgcacagttctgtctctgctatggcaaacgcgaacatttgataaacattacttatacagggattatactgttcatcagataattacttcggagcagcacatcttttcattacttcatgactgttacacttattcccccaggaaagaattcttcatgcatctgaaattttcatgactcagggatatgttgggtctcatctcttaaaatatatggtaggaggcgtattcatagagtgagtgtagtgttacgtgtgcacgtatacatctcccgtgtaatcggaaaaggaaaatactcctatgatttcccctcagtaatatgagttttttgagggtgatggactgattggctgatggtggtatataccacgtagaacgtagagagcagcaggcgcca

SEQ ID NO: 51601 - DNA, 1349 bp, Oryza sativa
ttgatagcagtcacatcgtggtcttagcattgtagtttttagctttgatttttttttcaggattagctggtttatcaacggcaaaatatctggcagatgctggtcataaacccatattgcttgaggcaagggatttttgggtggaaaggttttactcttatgcttttatgttgcatttaattttttttgttattcattcttttttttttcccgttgcctttatcttaatagctcatattcactgttagtagcatttgtggattattgtttttttttttggggaaatgccttgaacagatagctgcttggaaggatgaagatggagattggtatgaaactgggcttcatatcttttgtaagtaataactctggatttttaaggttctcgttgtgctatattttatttaggttattaccgccagcactgatagatatctctaagggttttgaacaaaaaaacatgtatcaaactctttcatcgataaggtagaaatgccatgcgggaagtatgaagtgatgtctgaggattaacacacatggtagttttattttgtaagaaacttttagattggtttttttcacagtactaaaaagtaactttttactagcttatatggtgataaattttaacgtcacataaatatcatgagctaattgaatataaatcctcctgttcatacatagtcttctttcaacctactattcccttccaaacatatatgaatatgacagatactgtttttccttccatgctcacactgttttgtcgtccacaacagtacatatgtgacattgttcattttgtgcctgtatgtaaccatatacctttttggtttaagttggagcttatcccaacatacagaacttgtttggcgagcttggtattaatgatcggttgcaatggaaggaacactccatgatatttgccatgccaaacaagccaggagaattcagccggtttgattttcctgaaacattgcctgcacccttaaatggtgagatcatatgcagcgctggagttgtttaattaaaccaagattcccagaagtacatcgtattggtggttacttttgttttactaacacatgactgtaattagggggtatattactagcaacgttaatgatagatcaatagatcatgccatggagcttttatgttgtcaattgatgcctatttattatttatcattgatcatgcgtgcatttaacaggaatatgggccatactaagaaacaatgaaatgctaacttggccagagaaggtgaaatttaaacttggacttttgccagcaatggttggtggccaagcttatgttgaagctcaagatggttttactgtttctgagtg

SEQ ID NO: 51602 - DNA, 965 bp, Oryza sativa
taattcctcatcagttttgctgtcctttcactgcctcatgcatttgctctgtgctatgactggtttatgaactaaaacgatttgtattgcccaaattgggcacattctatcctgattttgtatacattcttgattaataccaaatatcatatgtcccatgtattgatcttgttcccttttctttcaggagttcacttttaagtgtttatgcggacatgtcagtaacttgcaaggtactaactaggagacattatatgttacgaaatagtaactatctgtcatgtattattgctcttgtgtatttgttcttgggtttaccatcttcaagcatcacatgatatttattttagtagctgtaacaaaaggcccaaaagtgcatgtgttacagaaggaatccagtattaattattaaacttggaaagtagatatattttatttcagattcatttaggcaacatgtcacttggctctagagtctagattttatggaccataatagctcaggaaattaaagacatggatgcctactgaacggttttctttccttttgttttgaactctttacaggaatactatgatccaaaccgttcaatgctggagttggtctttgctcctgcagaagaatgggttggacggagtgacactgaaatcatcgaagcaactatgcaaagctagccaagctatttcctgatgaaattgctgctgatcagagtaaagcaaagattctgaagtatcatgttgtgaagacaccaaggtgaggacattttgcaagagcgccccctatctgatatatcataggtaggtctaatagttggatgcacacttctctcacgttcctttcttttctgtctcactggtacagatctgtttacaagactatcccggactgtgaaccttgccgacctctgcaaagatcacccgattgaaggttctatctagcttgtgactacacaaagcagaaatat

SEQ ID NO: 51603 - DNA, 740 bp, Oryza sativa
ttacctaatgaggatgagcagagaacttggcagggtctgcagggactagcattgtttaaatgcaagttgagtgtgctatggcattatacaccaggaccattacatgctatacctaatctcatctccttcagaaaaaaaaaactactagttgcacacttgcatgattgcatctattatactatgcatgtagtcgtagatagctcgggaagatagcccaattcggtggtccatgattctccattgaagattggatctaccattcattgttcatttgttcttgatataaagttgtgttgagtttcaaatggctacttgaacctgttccactatctgaataattttccctgcagatcctaagaaaaaaaaaatagaatcttcaattctcttgatgataattgttttcatggcttggagggtttgcacaagcttttcttatcctggcatagaactttcaggatcaatagaagaaactgaataattagtaccatcataaccagctcctaacttcttttacttggagaactaccagttggccatgcttatggttgtggaattgcaaatagccctaaaaattttcctctagccattttgtggaattcggattttggttctgaattccatcaaacagatagaactcctccaattaccttcatttccatcgaaaaagaccggtagaacgtgaccaactgcctattcacaacacacaaacattgtgcaagaatttgtagtactgagtgctc

SEQ ID NO: 51604 - DNA, 1234 bp, Oryza sativa
  unsure (1)..(1234): unsure at all n locations
nnnnnnnnnnnnnnnnnnnnnnnnnnnnnnnnnnnnnnnnnnnnnnnnnnnnnnnntaaggaagatcacaggataggtactctgcaatagctctggatttcaacagaaaatggcaacaaaagcaacacagagaatgtttattagtacaaacaaggattttcacttttccatatactggtgaaagactatcagcaattgcttaatcatgagacatgcgtgattaatttaaatatgttcccgcattctttacatgatttcacatacagtattcatccccgttctttaaatatgtttgattaatttaagtatgtgtgattattatgtttgaatcgaagccatatagactgattaatatgccaatttaactgttaacggcagtgaaggatttgatcaaaaagaatttaataagctataagcagttgttgatatttgaatagataaattatactgtttcagaattgacgacagattacgggcctgtttagttcccaaacaaaatttttcacgctgtcacatcgaatgtttggacacatgcatgaagtattaaatgtagacaaaaaaaaataaaaccaattacacggttcgctaggaaattgcgagacgaatcttttaaacctaattgcgcgatgatttgacaaggtggtgctacggtaaacatttgctaacgacagattaattggtcttaataaattcgtctcacaatttcatggcagaatttgtaatttgttttgttattagactacttttaatacctctcaaatgtgtgtcgatgtgacatacaggggcaaaaatttttgccaactaaacaagccctacgataactgaaaagatagggcagattagttctactctgagcgcacagataaatcaaggacgacccaagtacagaaccacctataggggattcagttaaggcaaatccaatcatgagtggacagtgggcaccgaccggcgagcagggaggctggtggcgggggaggagtagccgttgtagtcgccggagcggacggcggcggcgacggcttcctctgcctcgggcgcggtgcggaagcaggcggaggaggaagggtcgccgtggctgagcgggatgacgggccgtggcccgttctcgtccaggcacgcgtgcagctgaaggaggtaccgctggatgctgcgttccccggccgcggccacggccagattcggggtcgcgaagcgccatcgcttccccccgcggccgccctccatcgccgga

SEQ ID NO: 51605 - DNA, 8561 bp, Oryza sativa
cgattgtggctgcaagcatctctgcccttaagcgtgtcttcccaggaagcctcggctgctctccaggggggtctatttttttccccaccggatgattcatcccccagcttctctttctgcatgcagtccacacgcttcctccgtcgatccatccagcgccgccgccggcatcgccgtctcccttgcccagtgtgtttttgcgccttctttggcttagctgtggacggccgcggtcttctgctcggtgatttcgtctccaccatctccattccatctgtccacggccgtcgccatccacgagctgcagcagcctctcctctcccagtgacagtccactcagttgcgccaccaccgacgaccttttgcttgaccggttggttctccggtggccatcgccatcacgtgagggagcaatgccctctttttcccacggcagtcctggcaagaaaatccttctatccccactgttgtacagaagaaacccttaggccccttggaaatgtcgttctttgatttattatgtaccaccatgacagatttcccttgacctgtatttttaatggtgcaagttacttattgtcaagcatgtgattcaataatccctactaattaagcattttctaattgaatttgacctgctacagtggttatgggatagttgcctgctgccccaagtccacaacatacacatattaaaggtgtccatatttagattcatgcttagctttccataatactccattgtgtactcatctgctggctttatgattttgttttgccattttgtataaatatctaggagtggtttggtgattgggatggatgtggtgcctgacactctaacaccaacaccattttctcagctaactaacttagggacaaatgagacagagaacaggctaggtgctactcctacgcattattcgcatattcaactttctttgcattttctcaattctcaactacagttttcttacgttgagcggaaaacttattgatgatttatttctttgtcttctaggtgctcctaacagtgaaagctctaatcataccatatcttttatctcaactcctgaaatagggatctccatgtcagtgtttcgtcatccatttcgatgacctattaacaggaggcttgcatttaaccctgtcaatcctgctactccaatagattaacactttgtctcctcattagatggcccaacagtgccaggtgttcagtcccttcctgcagtgcgcggtaaaggtaagcccctctattaagaattactctctatgtgattgtgctcaaacttgctatactaccattgtaccattttagattcataaatgccagttcaggtacctgtgccatagtatcatatatctatatagaagataataatcctacgtacaatttgcccatgttaatgtactaccttcgccccatattacttgttgccttgagttttttttaatgtttgattattcgtcttattcaaaataaacttagaattattatttattttatttgtgacttattttattattaaatgtagtttacttatcattttttatatttgcactaatttttcaaataaaacgaatggtcaatcattacaagtaaaaagtcaaaacgacaagtaatataggatggaggtagtattgttcctagctagggctaaaaatggtcggaccatataccatttttattttcatactgttttctcgaaaacggtatcagaatggtagacacaaaaatactaataatagtcatataaatactaatgatagttatatcggtatatcagaaacgggactgtcggaacagaatcttcggaagtcgaaaattcatgtcaaaataagcggagtatggcatagcacacatttaactatgcatgcatatgactttataatttcattcttgcatcatcacactacacgtgacaccgttatatgatgattaatgatattgatgataagttcgatgaataatataaacaaaattcaacgatacatcaacattgataagttgaggagaccaaagttcagcaaaatccacgtaccacgtcctaggtttaacagcattttcccgtggtcacttctgctttctaatgggctaaaagcttgccaggttttcatcattcataggtttccaataggttgggatggctgagccattcgggaactttcggcattttgatgaaaattaccagacaaatatggttactgacaaaacagtgagaaaaacctccatccatttccgctaccattttcgaataatattaagtttctatttccaacaccgatagttatcaatactgactgaaacgatcggtgtaaactggaaaccatagccgaaatctcggaaatttccgtaccgttttcacccctattcctagctaaagcacatcactatcgtccgtctgatccaccgcacaaagagcgaaggagcgatctagccatccgttatgagagcctacctctttcgtgtcgatcccctcctcccgtcgcagaaattgccactgctatggccacctccgccactgccactctttgccagcgtggtccttggttgctcctattcatcttctccgtcgaagcagtgtccatgccgaggggtcatcggcacgggcgatcccctccttcccttgcagaaattgcagcagccattattgctgcctccatgtcgtcccaatcgtctacccccacctccacggcgctaacgtccatctcctctaggccgtcgccatcttccgctcaaccctatggccgtggcctctaagactgccgctgggtccgtgctactgttccgcctgtaggacgaggacctcaaaaattggcacgctgacttcgtcaatgctgactagccagcctcttcgactcctcttggtcaatcctccaccataattacaattaggaaatgatgatttcattaacagtctgccacaatattgtagtttgtcttcttcgcaagcagactagctagaagaagctggacaagaggtcaataaataatatatgcaggagtgatataccaaacggtattatttgcatgtttgacactacaggttcaacatattattggataacgaccataaacatatgaaaagactgacttgcaaaaatggcgtgccaatgcgggtcacggacgacgttgaaccgaacgagagtacgagacaaagcacagcagattaattagttgtcatccactgctctggtggaatatccgagctagtacagctaatatgacaggaccaagtgaataaccggtcctagtattttttttcttaataatagaatgatttacaaacctactaccttcatctaaaaataaatcaacttttatagttcgtatacaatagttgaaaaggagtacaatgaattctgaaactgaaatgaaatatgtgaggttatctggcaaacctgctgtttgatgaaaacaaaacaatgaacacatagaaaatagggaaaccctgtattttattaatcatgattcattaacatgaatgtttacaaatacatgagggctcccgcaggagttcgccttttgccttcgcgaggaatgcttaatggaaatgtatgctgactggagattgcgtgtagtccgctgattcccggcgcctagcaatgagactaccggttaattacatccacaggagcgagcctatcgaacacctccgattaagctacgctttatgatcgtcgtcttcaaagttgtttgctcgccgaaggttgaggttagtgcagacttaatgttgaatatagtgaatgtggaacgggtggtttcgtttcgccaaaacctggtcacagtacactaccatcacgtcggtgtgcggagggaatttggtgaaggggtgacctttgcctcgtcggtgcccagtcatgtaccccggccttcatcaaacatggattttgtggttgctttgcctcgtcggtgcccagcaacggtgtatccggttcccgtccattttagacgtgttaataatgtagtgacctggccttgtcggcactcagccatggtttcgtctagcctcatcggttatagacaaatgaaatgagtgaatggctatagctttgttagctttggccaatatgtcgtccggcctcatcggtctcggacatagcataaataatgataaatcggccatttcatctcgtcaacattcggccatgatgtcgacgtgtgttttaaatctgcatgccccgccctcctggctagcattgtttttgttgtcttcaagaattttgagagtcaccccatgcatctgatagaatttagagagagaagaaattgctctcgtacatgacatgcacgaggcaaatctataactctttcggcatgaatataaatatatataaatcatggttggtccgatgccaataattaaggctcaaacttatcccaagtttatataaataaatatccacatccaatatttgatattgataatttagacggtccaaccctcacgagggtcaggctcgccttgtatttatttgcagctcatgttaatcgcttgacaaagatgacgtgtgcgtgtgcatgcgccgctggggatacttatatccatggctacaagttcacaacgcatccacgacatattcatcagtactccactttactgttttaccgtctcaactgtgcatctacacaatgctacggtgtatatttgctccctctaagagatgatgccgggctattaataatatctgcacagcactacggcgttgttgtgttatcttggataagcagcttgatggagaacgagatcagcttgttgctgaagactcgccgatagaggtgccatcagtgcatgcatcttgttgctgatctgcgatcacgcaccctgtgtcatgcgcatgcatcttctttctgatctctctgtgaatatatgtgggtgcgggtgtgtacctatagggcatattgctacttaatggcgcagcgcttgcgccctgtgtttctctccttctccttcacgagggacggagtcggtgccttttataggcagagctaacgatggatggatcaggctgagactctcaaccgcgtccgcaaatcttgggctaatcacgcttaaatatttgatctcctccggataatggacatgcttaacaaacatggtacttaattagcaagcaaataatacgctgatgacagtggccctggacatcatttgcacgccttgggtgtgcttgccgataatctaaatataatcgtcattaatctgacgtgattatcaaaagcaaccaaccaaccatatggctagcactagtcaattttctcccccatataatctttgatagctcatacttttcatatgatatatcctattcaaaatccgtttgtacttatggtctctactcaaaatatagaacaaaacgagtccaatattgattatatttggatgtagcgtgatatttgaatttttctggacccatacatcatagagacacgcctcacatgtattcagtaaaattgggctgcgaataatattctcatataaaattaatgcccaataatttattatttcttctatgaatttttagcacaaaaattcatcaaacacctggccccatctcccaccaaatggtaaccagctgagtcacttaaaataaaaactagagaaactcggcaagaaaattctatagaaataactactagaaaaataatttttaccgacgttggttttttacttttccggatggaaaaaaaatcctcttataaccgtttgcaaaaatagctaaagagcctctagatttagccccgcctgcgaaaatcatgcagcttctattcccatcaacccggagcttatttcggtatctatggagtcacttatcatagaataaatatgcagctgaagaagatccctggtcgtccagctttttcagcctcatgcattgctgtatttgatctcgtcctctctgtgtgactgtgtgcatgtgctgtctgtgggtacttggtttaatcctctatggtttccactgtctggacttggattgccatgtacttgtgtgtttgattgtgtgtactgctccagttatgcatgccattgggtggtgttggatgtagggtgtgttcagtattcgcctgcgtgagcatgaacaccactagtgctttgtattatacttttactttgtgctcttctcagtctgacatatatttgtcgatcacagaaaggcatttgatagtataaaaccaatctccccaacaaagatggatatccatttgatattgaagtagtgagtttaaaaaatgaatttattttgggataaataggagaggaaaaacaaacttattctcacacataggaagaactcatgaatacatgatagtaaacctagttatattttggattcatttttcttattcttgtgggcctggtcttataagtctcatcttctaattgaccatttggaattgttggaatttatacgcagacgatgcagcggtcttcatgaacacgaccaagagcgatgtaagggctttcattgaccttctgactcgcttcggcaaggtatcgggtctttgcacaaatctgcaaaaatcgcaggtagcgccaatcaggtgtgatggcctggaccttgatgacatcttggacggaatactagctactagagcctcctttccagtaaagtacctaggactccctctttccaccggaaggttgcgtaaatgtgacttccagccgctcttcgacaaatctatgaactatatagaaggatggcgagggaggcatgttggtctcgcaggtcgatcaaccttggtaaaagtcgtccttacgtcccaaccaatcttcctgctgacgggcttgaaagcatctaaggaatcccttgaaattctggacaaacaacgaaggcaatttctgtgggttgggaatgaaaccgtcactgggggaagtgcaaggtaaattggacgcgtacctgcctacctactgcctcgagagggcttggcatcctaaatctcaagaaatttgcaagggccctccgtctgaaatggctctagcacgaatggaagtcaccagaaaaggcttgggtggggttagaaacgccttgcgatgaaacagacatgctgttgtttgctgctgcaacaacaatacaagttggcgacggagcaaaagcaagtttctgggacttggcttggctataggggagaagactaaaggatgtcgcaccactagtctacgtagcctccagaaaaaagagcaggactctccaacaggccgctcagatggaccaatggctgcttgaccttgctctaccaacaaccgaagggtggacaacggagctaatcgaccaagtcattgccgtttggagcgccattcgaagtgtgcaatttacggatcaagaagactagatcacttggaagctaaacaaccacggtgaatacacagcctcctcagcctataaggcacaaatccttggtacaacatcgtcaaattttgacaacctgatttggagaccttgggcgccgcgcaagtgcaaaacctttgcctggttgattctccaaaacatagtgtggacttcggatagattagcaaccagaggctggccaaacggatccacatgcccgctatgtcgtcagacccaagagacggctcatcacctgctagtggattgcagatacactcggagaatttggaatgaaatagcacattggactgtcaatggacacctaagtcctcaactctggtgagcaacgtctacgttacatgagtggtgggaggccatcgtgagtacaagagaagcaccaaagaaggcactacgcacgttaactttgctaatggcctaggggatctagaacaaaagaaaccgaaggactttccaacacaaggagttgccggcatcaaatctattatccaagataaaagaggaagcaaaaacgtggagccttgcgggtgcgagaagcctcgctgcctggctggcactgtaattagccttttcggcagggttgcagccctgcttttgcttttgtaaagtttccttttgtacagtttccttcttctcttttcaatgaaattggcggcctcgatgattcgttcaaaaaaaaatctttcttaatatcaacttcttttgccaatctttttcagcctcttctggctgtagtggcaacagatcttcgctcgatgtacttattgtcaaggtctgatttttcaacttgaagctgtatacttttattgtgctctatccttttgatgtaattttgtagttcactcgtcctttgattcaccgtgtatcacaaaatatctccgtcttttatcattgttatactcagcttgcttcctttttttagtatagtttcatcagtacaatcttccagttgaggatctgttgttgtttaccaggtgtgcttgcttttatctcaccaagttttcttgacaatctttttcctctctttttggctgatatagttccatgcattgctattttctaattgagcatcaacttgtttttttagaaacgcttgctttttttctcaccaagatttctagtcaactttttccctatccttttgcatataatcatctattataacagcagataaaatagaaatacatataatcatccaatatttatagtgt

SEQ ID NO: 51606 - DNA, 7583 bp, Oryza sativa
agggtacacaaacgacaaagttgacatacagatccacgtcttacaaacattataaaagtcttacataaatgcagtggaaatataaaagataactagagctaagtctggacttggatagcagcgggaacaccactccacaggcatcctcgacggcacggacaaagcctactcctcggagaaaccaccattggacgcatactcgaactctgagggttgggagatagagcaagactgaatacttcctactgtactcagcaagtcataccggaacggagggtatgatgcaatatataaccaaaggaaggctaaaaggggatcatttgcacaaagctagcatttataaacagtagttgaaagcagtaaaacagttctaataattaatcaatattaaccatccactgtccaatgctacaccatgttgcaacaggcccaaccatccacctgaactaatcaattccattagactaaactagggtgagactaatcacagtgaatctggttgaccgcccataaccgcgggcacggctattcgaatagttttactctgatcagaggtgtacaactgtacccacaagacatagccccacaacacgtttccgtccgccggcatgccaccacgacataccggaaagagaccgtgacaggaccctttgcataacctcctctaaccaaacacaccacacctcaggtttcacccccactactcgcaaggcagcgggcagtcccctctcgtgcctaggtgaatccggaagcgacaaaggccgtcgcagggcccatcccgctccatcacgcccacccttgcctggatgcgtcagctagaggaaagctacactacaagcccaaccgttgcccaagctggcttgtggtaagtacgataagttcttctagggcatcccgcgaaccggtacttaactgccatgggcgcgaccatcaaaaccatacacccacagccaatcatttagcatattttagttaaccaacaccggagcggtggcactaaaccaacatcaatactagaataggaagtctaagtgttaatgtaaatcccccattgtgtgctagttgagctaagcatggctaagcaatccctagtccaacagctactcatgttataaccccaagctaacaaaggaacaaggtaacaaatagtatggctgagacaataggtaatcatcccatggtatcattataaaacaatgcaatatttaaaggagaacaataaagcatttgcaatgtgggatcaccatgttcaagtgacaagcatgacttgccttgctctgcggctggaggaatctcggcgactatctctaagtacatcggagcgtcgggagagccgaaatctatgcgacatacaaggcaaacaatacaaacaggctataagactactgaaacagagaacaaatatttttaatggattctttgcatttttcttgatttactgagacttgaatgggcttaaacgaagcacggatgaattttctatgaattttagaagattcactgtgtttttactataaaagaaaaaaccttaattggattattgcgcattaaataaccccgacatgcgggccccacatgtcatcggcacaagacgccggtccacggtggaccgagtccacgggatcggggaaaaggaccaccacgtggcgccgacgtggcaccgatgtggcggccacatgggccgccacgcgggcagcggaatggatggccccgatctacaagggggtagatcggacggcggaggcggcgcacgcgcgggtggcttaagccggcccggcggcctggcgtgcggcggcatggcatgcggtggcgcggcggcaagcggcggcggcgcaagctggcccgacgactgcaaacgggcgatggcggcgagcgacagcggggcggcactagcggctaggcggcggctaggaagagagagagggggaaaaagagggactcaccgaagacgacgagcgacggcgagcggcggaaaacggcgggcgacggcgggacgggctccggagcgacctggggaacgaaatgggagcgattagagagagagagagcaacggacggagacgccggccgaaggcggctgcaatggcgagctcacctgcgtgcggtgaaaggcggattccggcgacgggatcggacggcggaggggtggacggcgtggccctcgggctcgcgaacccgacggaggcaacggcgaggctcggcgacggctctaacggcggcgagcggtggccggaggcgcttagagcggtggcggcgggtggtgcacggcgctagggcagagagctcgggtgcgagtggttgcaaagcggaaaagagagaggaggggccaggggtgctttatataggctcgaggggatcgatcgtggccgggaggtgcgggaatcggccggcgacgtggggaaggtggagaggagagagacgggattagaaaatcgaatcccagccatctcgagcgcgggtgcgggcgggagagtggggcggcggttgcaggatgtgtggggcgtgcgcggggagggcgacgtgggcgtgggcacgctcggagagggcgggagcggcgattgcgggcgcggcggcgccggccggacgtgagagacgggcccgataggtgggcctcacctgtcggtgacctaaagaggaggtgggggcgcgggcgaggtggctggccgaggcccagctggcgcgtgggagaaggagggggagtgggccggcgggggagaggagggaatgggctggtggcccaaaaggaaaaaaggagggaaaaagaaaaagaaaaaggaaaaaggatttttccagggatttaaataatgcttgtgctcgattttaattggttaaaattatttctagggctctgaaaattccactaaaaatccggttagcatattttgacatgtagaactcttgaaaaatcccacatgccatttccgattattatttgcatttaattccattagggtttctctcttactttaacacatgaaatttcttaagaccacttattaatttaatttaggcttgggagaagaacttcagggtgtgacaaaaaccttctctttttttctcttctctaaaaataaagtgatgaattcatgacttgaacctatgatctcatagttctcctaatcaattcaccctgtgacgctatgtgattggagattattgtttgcttgctacgtatgattgttcaaattttatgatactgtaggaatctaaccttgttactatgattcagtaatattatcatagatgggtagtaacatgctatgttactttaaaatttataggtcgttactgcacttttggtaatagcacataataaatattgcaataacagagaaaatgtaataataccagtgatgctataatagtaatgcttgtgcagatatagaaactttaaagtcccaatcttcaaagagcaatatttcttacataatatcttatttttctaatccatttgcaccataatgttcataaaaaaatatttaatgaaactagatctatcgtgactatattttgacgtcattactacgaaaagcacatgtgttactgcatactgaccgtcacgttactacgtaatttctacatgatgagggcaacaaagaggttaaattgggttgagccagtaagttcgagctctgcaatctatttttcctatatagttggttcccactacaagaataactcctataaagctgtctccaggttaagccacgttatcatcaccttacagccgttggatcaagtgccatctttgttcgattcatagacctgatagaaactcaaccagtccaaagtccacccagacacgatgaggaattgctagcgttggatcagcttgcagtgagttagaaaaatggagcgttttctgtgcgtcaaatttaggaaactgattaaggtgactgaggagcccatcttaatgaccgtcatcatgctttaatcgacgcccgttcagaggttcagcaactcagcgtcgctcacagtccctggagttcaggaatcaagatcatccttttggtttgccattggttgaaatcaatcacatgctctctcactcggatggattcaactctgttcaatagctggaattactttgcctcatatcaactcatcatcgataattgggacaatcattccagtgaatcggcgtcgtcgctcgatggcagaaacatagtcactgtcatatctcagactctcggcataggtaaccaatttgtcatcctgcagttctttttgggataatttcatcctttagtttttatttcgtagctggctcagattaagcttctttattttttcaacatagcaatacaacatgccatcacaaatattcagcaatttactacagtacgtgtctatacatacacagaactactcgaagcaaccttctaactgccagtggatttgcaaggaactatctcttcaccctaatgccagtggatttttttctacctttaaaatttcgaccatttttagcaattatgagttcatttgtccagtccctaataaaatggtgatttgagatcatctgaaaactgatgcactccattttccccccttttcaccgcaatacatttcttttcattccaatgatgcaaacactgaaacgcatcttatttgattattagcttctttataacttttgttgaagaaacttttgtcgtccgaatgttctcaaaattggcctgacaaaattgacctcaccagtccattcatatgtctcaaagttgaccttctatcttcatatcacttataatttgttacaagagttaaacatattttgttttgttgaacataacattttacaacgcaacttttacaggtcaatatgatgtatatagcatatggaaaacagcaacttgagctggagaaaaatacatgccaatgacaaggtttgcaattattcctgtgtctttttgggcattaaattactactgtctatatattaactggtttatcactaacccatctggcctaacatattgatagttgatttttcttataattgtattatgacacctttgtatcatcattaaacttgaaacgtcaaccttctagtgaccccattttataagaattggtcacttttcattcgtacaaaccatcgtaataagcaattttcagttcatcacttaaaatccccgccgcaacgcgcggggtatcacctagttgtacatatacatgtagccaaggccagctctgggcctagctaggccggttgtgcgaccatcatcaccacccccacccccacctacaggcctcagcccatagcctcagtagaggcggaactgcgcgcgggcggccttggagagcgatgcggcgatccagtctctagggcacgccgcgccagttcgtcttcgatctgcggcggtgcggccggcggccccgcgcggctagcgctttctctccgacgctccttgaccacgacacagcagctatcaacgaacgacgcgtcgatgccctctcccgtgattggtgatcccttctagcagtggctgggtcgtaggaagccaaccaggcaagcagcgcacgcacagccagcggcacagcaggtttgccttctaaacttcttccttgattccttctaggaaaattaggttatgtacttcggacctctcttgtttgcatgcttaattttcttccttcttgctatttaatttactttgcaattttacttaaaaatttaatttactttgcaagtttactttttgaagtgttacagaacgtattacctatttgtcggttctcagaaaagaaacagaagaaaatgggaagaataatttatcgattcgcaaaaaggtgctatatataaattttttatagcttcaaaatcaaatagtgttgttaccggtaatgatcctcacacatgtcaatgtggatgttgtggtgcaacaaaataatacccaagatcaagaacaaggatttgatcataatgtaaatgcagaggttaaagttaatgaagatcaatctgatcatatttatggtctgctaataaggtatttataatattttatttaattatactatcagtattatatatatatatagttatttacaaccgttttatttattatttaccatgttagaaatgtttatttgtgtttcttcagaccatatgtgctttgtaaattatatagtataaataaaaaatagtattaagggcctatattacagagttcgcctatggccctaaaggccttgcatgacgcgctcggggtcagcctggagccgagcggagcgcactgtcgaatccatgattgtctctgggcctttgtttgcatgttgtacgcatgccgcaggaactgcatgcaaaagcaaaacgtgggatgacatggacgcacgcaagcgacgtacgaaatcagagcgaggaggatgttgcagatgaaaattggaagcacttgatcgccgatcggaaccgagatagatagggaacgatagatgaagaaaaaaacttgaaaacaaattttattttttaagtaggtaaggaaaaatcatgtattcccccgtttcaggttataagatgttttgactggtcaaagtcaatctgcttcaagtttcaccaagtttatagaaaaaaatagtaatattttttatccaagataaatttataatgaaaatatatttaatataatatttaaaattattataatattttcaacacaatgctcgtcacactagggttgactttccagttgcaattgaggctagggaggaaagccgtcaactgagaaagtatacgatgatatgatggacaaaaggattagagatagctgaagaggccaagctaaaagatttgaagattgggctacattcatcgaagcaaccatctatcgtattatgaaagaaatgttgtcggacatttctacgtccaacaatgacatggatggcaagcacgctaatatttaaatttattataatattttcaacacaatgctcgtcacactagggttgacttcccggttgcaattgaggctagggaggtgaaccgtcaatgtgagaaagtgtatgattatatgatggacaaaaggattagagatagccgtagaggccaagttgaaagatttgaacattgagctagattcattgaagcaaccatctatcgttatatgaaagaaatgttgtcaggcgtttctacctccgacaatgacatgggtggcatcgttatgaggcgtgccgaggcactagccagctggccagagtatcaagagcttgttgagcaagaactgtggcaggcacgctaagcgcgtgcgtgctaagcgagcagaacacaagcgaggagaattcattgcacgagcaaactccatgtgcagtagaattcaagtggcatttatgtccttatcaagcaatggttacagggtgtacgaggaggtgttaacgtcacctaaaccgaggaaaacaacagcagcaacaacaacattgtcttgttggctagtccggaagatagcgtcaagtggtgcatttgaggttctttcttcaatgctggtggggatcacgaaagcggatgatagcaccagtgatgcatcatcttcttttgtacacttcgaaagaaagaatgcccgaaaaattgttgtaccgggtcaccatcatgt

SEQ ID NO: 51607 - DNA, 16446 bp, Oryza sativa
  unsure (1)..(16446): unsure at all n locations
agaccggccaacgagacaatgttgttgttgctgttattttcatcggtgtgcatgacattgacctctccttgtccaccagctgactattacttgatgaggacatagatgccccttgaattcggctgcacgcggagtttgctcatgcagtcaattctcctcccttgtgttcttcttgcttagcacaccacgagcttagcatgcttgccacccatgtcattgtcggacgtagaacatttcctttatagtacggcaaatggttgcttcgatgaatgtagcccaatcttcaaatcttttagcttggcctcttcggctatctcttatccttttgtccatcatatcatcgtatactttctcacgttgacggcttgcctccctagcctcaattgcaaccaggaagtaaacccatgtgtgacaagcattacgtcgctgacgtcagttctttgatgacgaaaatgatccttgcatagaaggacgttgaacaagagtgatagatgatacagtgttagaaggaaccatggttggatggacatgataattacaggaagcagtatcactcgactagacagtcggagagaatattcgagtcaaattatatggagattttgaaaaatccccatccaattctgatgtaccaacataatgatcgacaaaaggcacagattacaacatccttcccacccctattacaccaaattatgtggaggcttcatgatcgtcgtcctcaggatgtgtacattcagtaaacgcctgggctagatattggccgctaattgtggtgggagggatatgtgtaatcatggaatcataaccctcagatgcatctggtaaactgaagctttctcttggctgacggatctcccttgtcacttgaagaaatgcctttggaagacttccgcttcctactgctctcaggttgcgtgagggcatggttatctaccaaattttcacatgctggtgtgttgttaaccaaaataggttgtgacgaagagcctagagtaggatctacagaaaaaatgttctcctgctggaaccaaaaaaaaatacataagacggatggactaagtcactaagggtaaaaaaaaattatacaatatattacagtacgaaaggagggtacccggtgtggttgagctatactccgtatagctagtctccatgttcaagaagtcatataatattttcctccaggggccaccagcttcctctgctgcaaccttgccaaatgtgatgttggcatggtcattgggagatatgcgcaagatccatacgatgatagtggcctagaagaactcatgcaagacgaagatgccttggaaaaatcggtaaagaattttctggaatgttttaagagtaaaaagtttagatgaatgcttaaattatgtgttgcttttgtgccggattggtggttatgaatgatggcctaacatagcacttagacttttggtattgtgtaattatggtagtacatgagatcatgtggttataattagtagcctgaccaagtatgtgaaagtaggtaaacttttggtattgtatatggaagcatgtgtaattatggtattacatgagtgcttatgaatggtatcctgcagaattattgtaaaatatgatggtttattgtgctcaatgaaattaatattgttcctaacattacgaacaatatgacgatgatggatgcaatgcttatcttacattgccatatatatataatctgaagtttagctagaaactcaaacatgataaactttccacatgacatgatttactcctaatactgatattacattgtcatatatacaacctgaaatctggccaaaatatgaaaccatgataaatttcccacattacatatttcaaaagctgaaaccatcataaaacttcccacattacatggtttgttgcatttacttgctcaacactgatcttaacttatcacatatacatcctgacatttaaccaaaagctgaaaccatgatattgctttcccatattgcatgatttactgcacttggttggctaatgctgttgttaccttatcatatagctcaaaatcacaactaagggtattggggagaatgtctagacgctctagactctctttacccatatgagggatcttgtatccatttcctccatcagctttcataacctctaacaagcaagattgcaatgttaggaacaccctatttagcttgttgtcatcataggcctgaaattcctgctcaacattatctattaggtcatccatattcttggatatccttctatatgttaatgattgtagagacgcaaaaaaacccaagatctagcgcattcatatctggggaatgaggaggcttatgcatgagtcggatgtcaaaccctgtttgggaaactgcataggcaaattgaggatcatccactaggacatgagagggagcattatcctgctgaatccatatagtgttgtgtgcttcttctggagaccaacttgctataatagctggtaggactttagcaatcagaaatgaccttacggtatctcgatcaaccttgattgtcttgttgactagagtcccccttggtctattatgacttgtcctttgcgctggttcctaagtagcacaataatcaagttagattaacaattaattttcagatcaaatcacaaagtaaaaatgcatatataaagaggttatggtacctttctggtgaaaggccacaagcctatcttgccgtcaaaagtgcagataccttcttcattgtatctgggcctagcaactgctgccaagaacatcactgtatcgatagaatttttgttttggacaggtcggtatggatcatcctcccaatggaccatgtaaatggttcttgtccttttagttgtattgaactatttttcatctatgtgcacaatgtttcgcatatcaatgaacttgggttgatttggcaaagtatgccaatctaacatggaaagacaccaccgcagccttgattatttattctcttccttcaacaatggctttagtgtatttgagtgacgtcttagcagcccttctttcaacatcctatgcagtgtgctctttggtatacctgaggctgatgcaaataaccgtaaagtgcctctttgttgcaagggaacattagcaacatctgttaggttgatttctttctttttgcgaccacaattcttttttttcctagaaattacatcaattggtattccctgggcacggcattgcttcactcttcgccaaatagcttgcactctagcccttttcacattaaacattgctgcaacttcagttgtagcattttttctcatttttctcaggattccattgttagtttttccagtcaatgctgcatatatctgttgcctttgaattttggtcagatttttgttttgatgttcatcttcctcatctgaatcaaccaactcctcttgttcgaaaacaacatccacatcacccgcatacacgccgtactcttgcatgtctacaacagcaattataaggttagtcatatgtaccaattcagaattgtaatattttattgtcattgatcaacatgcttgcaaaattatggcataactttttaggttcaccacatggttttatttgtaatatgatttaaccgtacatatcacatctaagagggacagagacattgacacaatttagtttatgtgctttcttttagattactgtggtagtgtaccgattgacatgacaattgtatgtaaatacaagatatcaatgcatttattggtaaatctcattattctttgtgatttactatgtgctgaaatgtctaatttataatcctgaattgttattgcaactaatacaaccaaatgacacggttggactattgtaggtagttggcatgatataatattactaacttctaattaaaaacatgatttcagataaataatattattctacaacctttgggtaaaaccacattttatctttttttttgtaaatctgatagtcatgtcggttaaagggcttacctagatggtattgtaggtcttcctcattggcatcaaagttgagatcaaaaggaaaggcattatggttgtgacctccatttacttgcagaacttgatccatggcatcagcatcgtctacaataacaaatatcatgtgagtaccatgtacaaaaacaatactttttgccatgcagattattctatattgatccatggttccatatttgatgtcctgttgaattatgtgtccttttatatgacaaaggtttaattggtcaaagacatatccatctcagtagtagttatactgatggaagtgctcatgattatttttccccaaatgtgttacacatttcttatcaaatcttccgattgtgattttatcttattttgctggtatactgatatttgggtcatacatgaatgagttgtttgtttctgtacaaactttcgtgctgaagtttagagctctgtgtacaacattggaggtacaacctaactttcttttatagtactagctgaaattatgacattagaaaggaatatatataaattgtttgcttattattccagttcatgattttacacatagatgaaaacagtgctcatgctttctgaattctcatgtttattcctactttatattaagatgatgttgcttgagctacagacaatttaggtcaataccagtactataaaggaaactatccatgcagaatctagcatatctagaatctagtataacctctgatattatggaagggaatgaatttcattatgctcaactcttgacagaattgagttggtaaatatcaaagaaaaaaaatcaagtcctaattgttttctcaaacttatcaaagaccaattttgttccaagaagatagcaattgcatcaatgcacatgttatagatcatttttacagagaaatggcaaagattttagagtgatttatgcaagccatatctacaaagatcaattgttttctattcatgtttacaaggttacctagatgtatttctccttggtggtcagatgcatacaagttgagatcaaaaggaagcacatggttggcacctccctggaaatcacctccaggaagctcatggttggcacctccctggagatcacctccaacctggtcatcctcctgatcagccactgcttcattgaggttaggtacagcatgttcatctccatcatctaatgctatatttagatctaaagccatggatgtgtttttgcagagatatgaagggataaagtgggaaggaaagttgtgtttttgcagagttatgaagtgataaagtgggagggaaacttctgatttgaaacttgtagggtttgttgtggtggggtgtgctaaatttgtattacatcccgccaatgaagtggcacttaattcttcattcaaattatttggcaccttggcgccctatgtctgcctgtgtgtttgagtatggagtactactcctgttttattaatgtgtggcagtagtaatactttatttgtacctaatgattgggtgtactagtactgagggtagtttagccttttgctctttgtcctaaaactaccttgggcttccaggaatcccttctttctgggacggagggagtacttgtatgatacaaaaatctcgacgggaaagcccatgggcaataatgactctgtccaccgccagattttttctatgctcaagaggcactccaccacatacattaccatgaatgagttgattaaaaactcaagtgaatggctcaacaaatttcttatacaaccagagccaatgcaccatacaactctcgacatgggtcttgttaggaatgagaggtagaaccaattctgccgagcataaaaggatgcatccaataggtgcaaggaaccccaaatctctctccattgtacaaactcgctgctggtggatatggagtgacttgatcaagtctgaactgctaagccacccgatctgggtgatagggttcagcgaggcataggtcaacatgcttaataggaagcaaaccacactgaacagataagcaaaacatgcttatttaaaggttggtttgtagggataccaatggatgttggcatctttgcataaaaatttgaaggcttcgtcaggactgaaacgcttgggggttctaaacattgtgttcaccatcatggatttccgagaaccatgaataaaagaaggggcatgtggcttattcactttatcaccaaagatacttttcaaataaactcccatccaaccaataataaaatgaacaggccaacacctcttataagaaggaccaataggatttgtgctgagcaacctcaatagcataatgaacatagagcaggttgagttaaagcatatcggcgcccaccgccacctcccatcgggagcctgccgccagccacggaagccctccgtctcccctccagccagatctggcagatgatgaggacatcaacaccatcgatacatccacgtctctgcaagtacgacttgatggtcctattacccgcgctcgtgcacgtcaactcaactatcaggtgagttctttcttgagtttatgttcctcttctttataccccggagacgcgtgcactcttcttttactcagtaacgatggagaggatccaaaggggagaggattcgcgcggggtggattcggactacaggacaacgccaacttctgacggccgccacgacttcatgcgaactccgatttgagcgtgcaagtacttcatggaaagcttatcaagtctactttcaaatggatctagccatatgtccatatctgttctggagcggccacaattatcgttttactcccgactattttctgtccatagtgttgcgtcacctcttttggcccaatgggctgtgtatcaggttgggcccattaggggcgcatcctagggttggagcacgaccctgtagtcattcttcccctcttcttatacctctaatcaccgccaagaacgctcggtttttgatgatagagttagctacttgctacctgctcgcagcgcgcgtgttggctaaaccgcccgtctgcctgtaatcagaaccccgccatattgtgtttttcatagtgaagctttcatcttcatctagcaattcagtgcttgttctacttgttcttgcttgttcttcgattgcttgcaggatgagtgccctcgtggccgggttgacacacaccacaaattcgcagcaaccattagagacggtatatcggttgctaaggcgcagcgtctttggacggttgtagtcgtgccatgaacgtcatcttcatccaatcgagttatcccacacctctcatcgaaagatcgggcacaaaccctagcgggttcacatcagcagaggggagggtgccaccacccgtgaggagctcgccgccggctgcaggaacccgccgcgtcccctcccgccaaatctggcggaggagagcctaccgccgcccacaggagcccgccaccggctgcaggagcctgccgcctcccctcctgccggatctggcagagaggagggcgtggccaccaccgccgccagtgccgcctccgctaggcaatcaccgcaagagtaaggggagggggagagacgcgagagaggggaggcagagagacgagagaagagagagcgttggatgggtgggtagggcgctgagcggagtagagataaggacgacgttagatggatgggtggggcattgggcagagtagagatatggacacagttgatcagctcaccggctcagctttgtttagtataggcgccacttttttaaaaaaaaaaacagtacctataatatactataggtaccggttattttaaaaaaccggcacctattagtataagtgtcggtttttcctctattaccggcacctatagtgttcaaaggtgccggttctatatttttccatgacagggaggtgggaaaaggcccataggctgttccctatgaggtatgttgtagtagcgatttgagcctaccgaattgagatttgaatcatggatttgagtatccaaaagatttcaaatgaaaaagctataacctataaaattgtagatctcattgagagttatagttttcatatatttttttcccgaacagtgtccatatgaaaaaactaagttaaattataagatggcaattttttattgtgacgaatttattgatcgtggcaacagaaaatagtgaaaaataacttacgacaaccatgtacttaacaaatttccacaaaaattaaaactatgacgatagaacatgtattttttgcaacaataatatttctttgtgatagtttatttcctattgcaactaaaatatcaaataaaacaacaattataaatcattgcaagaatatacagttatttgccgcagaaaagttatcattgcaatagtacaatatcttacaatgaattatttttagttgtaataattgatacttcgacgactttggttatcggagataagacccgatcagagcatgttctctcttagatcgggttcttatttaccgtagaataaaatatgataaaaaccacgtaattaacttcaaaattaagcactaaaatttaaaatttaacttataagcaaaactctaaccgaaaatgatggggatgaacgtgttttagtgcccgcctgctctctgtgattaaaagagaagtgggcttgctacccagcgcagctttgtcgttggcaccgtagcccgtgggtctacctacattcacctaacagggctcagcccatgcgatgcaactgaacgtacggtacgtactgattcctgaatattgtaggagtaggagcctaggaggcctcgttcgatgtgttcgaatgattctattttctgttaacacgttactaaatgatgtattcgatgtgaaaattttttttatataaattcctttaaaatatcaaacaaatctattatttagatttataattgttaaaactcaattgatcatgtgctaattgatttttcattttccgttttctggctacatcttcatcttcgtagagaaacgaagaacaccactccactcgttgatatacgataggatggtattttgtgtaatttcggcttatggtggaattataatgcccaaacaacgcgctccatttctccatttctttttagccgatcgctgcacctgacagctagcagggggcatgatgtaagatggacgaacggacggacggacggacgggtgaaactgatggaccctgtattaaccctgtgtagtagtatccctcgtcacgtagcttcccagggatccagcaggagacgtctacacatcccgtcaccatcgccatcctctccgtcacataaaatactcctcctactagtactcctactcagcgcacgtacggtgtatagagaggaggaggaggagagggcatatggtgacagggagggcatggggccatgggcagtagcatggagaagtgacggttggaatcgacgggcggatggacgcatgcatgcaaaagccgggcaagggaatcatgccgtgccagccgagctgccgcagggggagaggccccctccccggtagacttttttaactcctccgcctaccaaatgctacaactccattctcctatggagtagtactaccctcaacagccggcaggttcatgtcatccatgatacatccatagaccatacaaaacccatccaccggataaacgtgccctctcttttgtttccaaggatctctcttgtcaattcgtcgatcttcgccgattcaatcattaacacatgcgccgcggccttggtttagggcccaattcgaacagcaggattgaaaaaacagggaactgaaaaaaaaaacacaggattctgacagtaatacaggtgtaaatataatgtagatggttgcaaaacacataaaaacacataaaataattgtttatatggaccgcatgaaaaatgaaaaacgcaggatcaaatgagagagaattaaaaaaaaattccaagagatagaaactcttgctaagttaggacttgggtgttatgacaagctaacgccactctagcctgggttggaaacccatgtcccccgcacagaaaacggaacacggttcattagcacgtaattaattaagtattaactatttgttttcaaaaatggttcaatatgattttttaagcaactttcgtatataatttttttaaaaaaaacacaccgtttagcaatttaaaaagcacgtgcgcggaaaacgggatggaggagttgggaaccgggggcaacaaacaaagccaaattgtggccacaagcaggtgaatatcatgcataggttgtgtttagatccaaagtttggatccaaacttcagtctttttctatcacatcaacctgtcacacacataacttttcagtcacatcatctccaattttaactaaaatctaaactttgcgctgaactaaacacagccatatttgttctaaacttttttttaaaaaaaaaaacaggaatacgcattgcttattccatttgatcgcatttttttcctaacttgaggagcattggcgtttatatgtggtgactatattggacgttggtttatcgtcatttcatggcggcgaaaaatgacaagaattatgttgatctggaccggtctacatattaagggcttatttggttgtatatgccattatagcattaacaaatttttatttttttaatgatctacgcaaatattgttggcaatggtaagatctggccatttgtaaaactttgggggtgacgttggagcttgttcgctttgttgccaatctcaacattttggtaccgtttttataagtacatggaaagttttggagctataccaaattttggtaggatggtgttaggctgtgtttagttccacatcaaaattagaagtttgaagaaattggaacgatgtgacggaaaagttgaaaatttatgtgtatagtaaaattcgatgtgacaaaaaagttaaaagtttaaagaaaaagttgaaatctaaatagggtcttagtataccaaattttggtatggttaaaagtgacggtaagaacatacgcttgatattttgttgttagccaaattttgtttgtgagattggctaggcttaaatttatagagccagtatagcgacaccaaatactaattggtagtcatttttttccgaacaatatgtactcctaactgatagctttttcgcattattaatttgcatagttgagttgaaccataaatatatcgtcagggaaagtattgatttctttttaagaaaaagacaatttttatagaaagtactcctgaaattataaaacgttagctaggccataactgaacaggtggtcggcctggaccaagttttgaaacagctattttcttgcacagaaatgcacaaaggtgtaagtactataagtacctactagtatattgtatttcccgtccacatgtgtccccgtaggggctcccaagacaagaattgatacatttctctaaatattaagctattaagcggtatgttcgatgcaaaagtgttttaaaccaaagtttctttagaaaagcatattaatttattttttacttttataataattaatctcaattaatcatatgctaatggacatatggcacaagtgcacaacgagtcccagccaagcactgggtttcgagctcagccaaagggccaactgaatgacttacgaactatcaacgctttaacaccatcggtaacagggtggtggatagtatatgttcattgtatgccaattaatcttagccgtgcactttggcgatagcaagattttttttattttattttgcacaagattgttgtttcgaacgttgctacattttctggcaagattatctattctttgatttgtattgtagagaactattaatacttccaaagagatgccgatcgaataatttgacaacgtcacttttgttattcaagccaaatgaatgacaatggctgtgtttagatttgaagtttggatccaaactttagtcatttttcatcacatcagcatgtcatacatacacaacttttcagtcacatcatctttaaaatttaaactttgcgtgttaggcagttagtaggatgaacaaattggatttggatcctgaatagctagcgtgctgtcatgaatatccctagatcttctgcgatgaaatctatcttacagttgcaactccctacagttgcaataatgaatcttcacattattaacaaactggtataaaaagaaatgcagcacgaaaatatacctaaagatggtggtttggagctgaaacaaccatgcatctgtctcatagattgtgaacagatacgctccgatacacatacattaattagaccggttatattggttcgtacattactaaatctataaaaattgtgtaatcactgatcagtcacctcaggggaaatcctgctactgcagtgagatgacacaacgatcacaacatgctagccatagtccagagttcactctactttaaccatacacctactaggaacttaaaacctgagctaagaacagatcagaggctaattaatacagtactactagtagtaattaatgagctagtaagtagtaattagcatacactttgaagggcatacttgccggccccatgcgcgtcatgacgtcgatctgcggctagaagccccatgcaaaggcgccgtcgagctggccggggccaacggccatctgcggcggcgcgcggccgacggcgccctcgaccttgacgtccatgccggactgccagtggaaggccccgccgccgctgagcggctgcgacgacacgcccgcctgcatgccgccggagaggaacagcggcagctgcaggttctcctgcagcgagcggaggctcgggaagaaggccggcggcggcggcggcggctcgacggccagcggggccgggttgtactgcccggtgccgaacgaggcatccatgtgggctgtggtggagaagcagggcacgagctcaaggccggtgaccaagttggcggtggcggtggcgctgccggcgccgccgcccccgccgtagttgctgctgtcggcgccgtcaacggctggcgccgcggcggcggcgaacagcgaggcctcagccagcggcgcgcgcagcgccgacgaggcggaggtgccgcccccgccgccgacggaggcggaggtggagtccgagaagcacgaggtgtcgccgccgccgccacttatgccgaggcggcccttgcggacgacggggaacacgccgggcttggtgaagatcctggctatcacccactcatcctgcacgacacatcaacacagagaaattaagaatcaaggttgtgtagcaacacgaatttaactgtgtatatatatcatgaactaaaaaaagggtagtacaaggttgtgtagcagcagtacagtactacgatttcgcgtgcacgttgcacaaggcgaactttgttcctctttggtttactcgctcaaatgacaaacgcagatgtatgcccaaggcatctatttttgctaaatgcaaattgcaaatacgtaaggagtacagtatgcatttacaccttgtgctctcatgtatccacgcattcatgcgttggattgcatataagcttccatgaggccaaaaaaagattcgtatcctgctaagctgcagcctctgatctttcactgcgctaagctgaccgattaccatatctacgtacagtatgcagcaatctgcgtcgcagcacccctgcgctgctacaggaagtagcatagcagcgcagggagggagctcgctgctgatgacttcacaccagaaaagcaagctcagagctagcgattgtgccctagacccctcgtgacttattcctaccatatgttgcacacatcatccgcagcaagaacaacaacagaaagtttccaaaggatgaagtgaacaacacaatgggcaaaaggtgaagaaaataaatggggaaagtgctgacccgggtggaggaggagagcaagtggtaggcgtaggtgccgtcgaggcggtactcgtgcatgacccactgggtcttctggcccttgggggcgcggccgcggtagaagacgagggtcttcttcatgccgacgagggcgccggtgcgggcgctgcggatctcgcggtccttgccggtggccttccagtagccggcgcccgtggcgcggttggtgcggagtcccgtggggtacttgcggtcgcggaggctgtagaagtaccactccttctcccccatcttggccttctccggcagctcccacggctcgcacttgttcaggtcgatctccgcgatggcgcgcccgttgaagctcccgtccaccaccttccgcagcaggtagtaggtgatcagctcctcgtccgtcgggtggaaccggaaccccggcggcagctcgccgtccagccgcccgcccccgcccccgccaccgcccagccccagcacgctgcaccgctccatccagctgctgcaacaagtaactaccagtcaagcacacaggagaagaaacaaacaaacaaagtactactactccataatcaaacaaacgccattaatgagcagcagcgatggatcgagctgcacaagagccaaaggaatggattgaaaggagcagcggtacgaacgctcgactaattcccccacctgtcgagagaggcgacgatcgatggctgcctcgctcttcttgaggggatcagaggatcggtccgtgttttatactagtancgccggtggtgctgaagnagnagaaggaaggtgggtgccgaggagtaaatgtgtgggattcgacgaatcgggggggagggggggggtgtctgtctgtcagcgacagtggggactggggcccggctcggtgggtggcgagaagagaaaaaaaaagtaagagtggagtgtggacgtgggggaactcagatgagacgagtggagatgatcaggcagtgcagagctgatcgctgatcgatcgattgcttcctgcaatccatcatgcccccccttctcatgcgtctccctcgcaggccgccgcacttggcacgacgtggctctggcccacgggatcctttgcgcatgcatggatggtaatggtactatgggcctgttcactcggtgaaataaaaatttttaggtgttacattgtacgtttgatcggatgtcagaaagggtttttgacacgaatgaaaaactaatttcataactcgcctggaaaccgaaagacgaattttttaagcctaattaagccgtcattagtacatgtgggttactgtagcacttatgactaatcatggactaattaggctcaaaagatttatctcgctatttacatgtaaactgtgtaattagtttttctttttatctatatttaatgttctatacatgtgtccaaagatttaatgtgatgattttacgaaaagtttttaggaactaaacaaagtccctctgtagggacttattttttggagagaggggctaaagttcctctctcctaaacacccctaaacagggcctatagtaatacaactcacatttttttgggctgtgattgagcttttcaatctaacaaatttcatccgtgtagttttaactccatcatcatctttcagtctacccgacatataaacgtgtgtataatgtaaagcaaaaggcttaggtggtgtttagatccagagacttaactttattctctgtatttagatactaatttagaatattaaatataaactacttacaaaactaattacataaatgaaagctaattcacaagacaaatttttaaaggcaaattaatccataattagagaatatttactgtagcatcatataggttaatcatgaattaattaggctcaatagattcgtctcgtgaattagtccaagattatggatgggttttattaatagtctacatttaatatttataattagtgtccaagcatccgatgtgatagggaagttttagttccatctaaggctgtgtttagttcctgaaattgggaagaagtttagaaaaagttggtagtttgaaaaaaagttgagagtttatgtgtgtaggaaagttttagatctgatgtgatgtgatggaaagttgagagttgaagagaagtttgatgtgaactaagacatgcctaaacagggtctactccgtactcagtaaaaggtgcaacttcaaagcagatctgctgcattgctgcaacccaaaatattcacgtacgtggccaaattttaccaagaaaaacaagcaaaacttaagcactagttaaaaaaatgccataatcaaaccaaacctccagacaaccaccaccctggcacaataaaaaaatggtatgttctttttatggagtagcacccatgcgaaaatatatttatttttaggttacaacttttttttcgctctgaagagaaaaaaatgaaacatgttcaatgctaatctaaatagctgaaaaagctgatggatatactagcgaaacgcatactgttatatgcaattc

SEQ ID NO: 51608 - DNA, 6668 bp, Oryza sativa
taataaaagagaaagagaccgaaggcacaaaggtgcataaaaagaaaaataaaagccgcacaaaaaagaaaataaagaaaaacaataacaacaaaagttttctcctcgagtggcgaaaaaactgtagatccgaacggaaaaaaaatatgattcatataaaagtcaaaaaaaaaagtggtgacaaaaaaaacgctagattcgatttcttaaaaaactgaaaaaaagtataattcctataaaagtgaaaaaaaatctgaaaaaatatttaaaaaagtttgtccgatacccttagaaagtagcaaaaaaattgttcgtaaaaaataaaaagctggttcgtataaaataaaaaatgcaagagagaaaaatttggaaagggcgaaacaaaatctgatttctaaccagtatatatctcttctctatctctaatctaactatttaaaaagagaaaatacgtgagaaaataaaaacggtcaaaataacgcgtgaggcaaaagtcagaaaaaaagcgcaaaaaaacacgctaaaaaggttttccatcgttaataaaaaaaatacgcgcgagaaaaattatttccatcgtcggtaaaatatttttaaaaaaacatgcgaggaaaaaactatcgacaaaacgcgccatttctaaaaaaatggttttaaaaaaccttgcaagaaaaaaacaccgtctattaaaaaataaatcgctctgaaaaaagtgtaaaaaaaaagctaaattgatggacgcttgagtcagataggatccatcgatttttttgctatctactacatggctttatttcgtcatatattctcctgtattggaaaaaaacaaaaaagaaccttcgaaaaaaacaagcaaaaaacgtgcgagaaaacaagaaaaaaacacacgagaaaagaaaaacaaaaaggagaaaaatatggttttcttcgccagtaaaaaaaacaaaaaacatggttggaaaaaacgaaacgcgccatttctgaaaaatggtttgagaaaatcgcgcaagaaaaaaaaacactgtttataaaaaaacaagcggctcgttaaaatagaatcattgtcattgacatgattatgcatgaaaaacgtatattattattagaatttttttacccattgcaacgcacggacatttttgtagttcaattctatatctatctatctatacctatattaattgggcttttttttaggctctcatgttaaccagaaatatccgaccgttaattaaatagattgtgctataactaccgtagatcataaaacataacctacggtttgtgaatccgtgggcccgattaaaggccacacgatagaacagatgcatctaaaaatatgaggatctcaaattctatctgcaaaacgagatagtgataatatcgagctcgacaaagctacgtactggaaatgctccaggatgccctttttctctgaactccaagttgtctttcatcctgttctagaactatatatttggtctttcagtgctgtcatggttatcaataagacatatcttctatcctacgccttataaaaaatacgaatacgctgtacctttatatatacggtatgttcccatatgtgataagggaatctacaagatattatggaaaatattcttctaggctgggtgattaacagtcttactcggagaggattgagtttattctatatagtgcaaggttcgttgtctccgagttttatttggagactaaggcaatccacggtataaaaggcataccccataggggttcaaaggattgaatcatagcaccaacatacccaccatagtttacgaagccggaggacacgaagcccactcgccgggagaactcgtcgaaccatctcgacaaggatctcgccggtaacgccgaattcatctattctctgtgtattctgtggtttctacatatcaatctcatataaactggattagggccattaccttacgagggacctgaaccagtataatctttgtctccttcttccccggtccattgctcgggtatgctacaaatacttcttgaagttgtaggatgcgggtcatcgatcttcctatcggttcagaggttatgcgctagcttgggaaagaaaaagtaagatttgtttatcatatcatgatcggaacttagatgtaactcttcttgagtactcctatcacgtggtcatgccttgaacacagtaaataaattaataagctttcgaataatagctacactagtctctccaatatgttttgatgtcatattcttataccaacttacgttgtgtttagttccaaaataatttttgaaacttccaacttttccatcacatcaaaacttttctatgcacataaacttttaacttttccatcacatcattccaatttcaaccaaactttcaattttgatgtaaactaaacacagccttaccttaatatcatatttatccgatctacggtacccgtcgacaaagtacataattgaaaaaggaaaaaaaatatcaatcaatcttgattcctgacgccatcatctaatgtttccatgcgtccaggtacatgttacgaagaaggcaaggagatactccctccgtaaaaaaaaaaaaaaagacaaaccctggttttccgtgcccaacgtttgaccgtccgtcttatttaaaaaaattatgaaaaaaactaaaaagacaagtcatacataaaatattaatcatgttttatcatctaagtaacaccaatgaaaatccgaattataaaaaaatttcatataagacggatagtcaaagttagacacggaaactcgtgtttgccctttttttttttttttggacggagggagcatgtacttagcgacaactgatgttggatcgtcttaatcattgaaggatttattaagcagtagaaccatgtgaaccgcagcgtctgcatgacaacttctatggctttattcaggatcaaacttgctaagaagattcatctgtggttgccatatatatctaaatctgcaatttattacaaaggaaatctgtataatttatatgatttattcgagaaatcctcaattcttatgttgatgcattttctgtcaaacttgcatgttctatgtgacctattcaagacatctttaatttttttactgataagttgtgttgcagatctttttccgactgaaagatctctgttttatcataaatgccctgttctgattgtaatcaggttaatttagcaaaaattcaatgctcacttaaaaattgagtttaattatttaatattagttttcaaaatcaaagagcatatattgatctatattttcatgaatacaaattagaaactaacaagttattatactttccatatgtcttgcctgtatatatccatatactgtatgtaggttcacgtcaaaaacatatactgtctgcaggtcaaagctaattttgttgtgattttcatcgtcatgccatttttttcacataaacattaactaggtcgaaaataaaacaaacgcatcacaattcggatattacctttttatttttatcaataatggtatatgtcaatgtgatatatttcaagttatttacagggagaaatgatatgtcaaggtcagagtaactagaatttgcgataccatggatcccaacagtaatcaacttattagccttgacacgatacttatggatgaagaggtcacataatattttttttccaaaaactgtgctgatgtcctatttatataagatttatcacttatattatttactgctgggcacaatgatgcatggtgctttaaaaattttcaagttcagaccattaatatcataggatcaaaagaataaattgaaactccaacaggagaacaaatatgagtactgactaacttctaattttaaattattaattaactaatgtaaatgttaaaattgacactcaaaatcaaaccgattacaactcaatacttattgattgttctatttaaaaaaactaactaattatcaattttaaaaatattacagtaatactccaccataaatattaacaagtacaactatatacttatatttgttccaaaatttgcaaattattacactaagaaaacagatagcagcacaagaaatattacctaggatgtatactatataatgttgtaaaagctaatttttatttttggaactatgaattttaaaattagtgttataataatggtttcaatattttgaaattttatagccaacgtattgttaaaatttgatatttataagctatatctccgtactgactagcactatgagtgagcccctacatttaaaaaagaatgggccaccgattagaatcattttcataaaattcatgttatattgagaattcattttaaataaaacatctgatatgagataccattgactccttagaattagattttataaaattcacaattaataagtgtaaagttgtatatatttggacttacttagaagtttattaattaaatattgaaatgatgatggcaaattgtaactaacatgaactatttacctttccaaatgaaattggaattcataaatatggagtcatacaaatctagcttggactctcaatttatctctccatcaattcaatttaattcttatatttattccatgccgctataaactaccaacatatttgacatgcacttctttatgtaatacaaataataataacccgtgcaacccacgggttgacgactagtttagtttaacacttagtaacactactcgttcgagatgacttcaattgctgtgttccggctaataatgaaatgcaaaaaacttctgttttgtttctactagtagtagctagcttggaaagcgatcgagttcaccgcacatatccattaagtatatatcttcgcataaacagaggaagcttctatctatatgattaaatttgaaagaattccattctatttgggacaccgtattgttgaactgatgaagatttcttgatactatgtgtgggtcccaaaaattggttatgtccaggtttacattctcgatacattttgacccaaactcccaaagtcttgagatcctgacatttcaagctgacacgaaacgggatctcaaagatatattttaatgaattttcaaaaatagaaatcaaatttgacttaaaaggtactgaaaaaaaattatatagatgctatgacatctgtagtacgaagtagcataagaaattttcaaaaaccgttcatattgaccatatcttccacactttacttcatattcctataatttttcctccattttcaaaatttcttagtatcatttgttctgaatttttcacacgttcctacatatctattatatattttatatactaaaaatgaaacattacataaagactcctaagctgttacatggaagttctacaaacacttctaaccagataagagcactctaataaatttaaaaacactactaaaaaactattttttaccaacattggctttcgttttcctaggcgaaccaaaaggataccctcttataaccatttgcgaaaatagcttaagaacttctagatttagctccgcttacaaaaatcaatttttacaagcggatctcgtgaaaatacctttattaatttcacaggcaaatctcataagggtctacctatgaaaatcggttcacagtactaacaattgatcaacaccctcagatccggcctccctctcctcctcctctactcaaatttcttctcctccttccctcctcctctccctccctctcctacggatatgataccggtgaatattcaaagccggacggggaaggtcagcggcagccacagtagttggcccgcgtggccctcccctccctcccagatccgaccgcaggtaggggtggaaaaaaagcttgggctcgtgagctcagcttgtgcttggctcgagctcgcttagctcggctcggctcgaatgccaaacgagcaaagcccaagcctcatttttagctcgttccagaaataagcggagcccaagctggcttgcgagccgcttatttggcttgtgagcctaggccatcatgcacttatatggatgattttattttctagtggagttattgtttgtcaatatgcaatttatcatctagattttgatgaattggacatataaagttaatttaattttgcatgtcgaagatttgttcttacttttcttaatgattacaaattatatacaaagaggtgctccaacggaaggctcgcaagccagctcgatctggctcgagccaagaaatgagatgagctgagctcatgttttagcttgtttccctaaccgagccgagccaagccaagccaagcctagcttcttgcgagccattgcaagctaagttgagccaggcttggctcggctcgtttccacccctaaccgcaggggagggcagcggcagcgcgactgctcccctccatccctccctcccaaatccgaccgagggggaagggcgctggcagcggtggaggcggcacggcctccctcccagattcggcggagggagggcactggcaacggcaaaggcctccctccctccctcccagatctagtgaagaggggaggccagtagcggtggaggcggcgcgacccatcccctccctccctccctcccagatccggcgaagaggggaggctggtagcagtggaggcagcgcgac

SEQ ID NO: 51609 - DNA, 1607 bp, Oryza sativa
gaaatatcctaaaaattttgagaaaagagaaaaacatccatgcctcaatttttacctaaatcaattatccaatattttaaccatcaaatctattaaaaataaaaacaaatccctatttcccatccatccgcaaaaccaagtgcacggcccccgcacttactacagacacacatctgaactttccttctcacttttttttctactgtacttaaaaagcttatctaatgctaagtgtttgtatttattaatgatttgcaagcacacagatacaattgtaacttttacctaagaatattcgaggtatcgtatccacagggaacgtgtgtatataatctcaaaacaacattctgaaggataacaaccaaatgataagctaagggatagagaagactcctataggttaattatcttaatttaagttcaagataaaactctatcaatttgtttcggacaccaacttacccttggtctgctaaaagactccggcctcccactctatgatgtatctgaacgtggaggattacaaaggacggacagggttgtcaccacctgccgcctatctctacaatccgtagagcacacaacaaacaaatgtaacctccagtatatataccacatctatgctattaattactaccctaatcttgacgtcacgcttatagagtattaaagtactctacctagatagagcgatgaacccgcaatgagcagaatatatcttatttaaaaaaataaataccaaaggaaatcacgaatacttacttatataaaagaagcatcaattgaggtacaagatccgaaagagtttcgacatctccagaactcccctggagagaactccaccatttggggcactccttttggagcttccccacagtcttttcctactctactagaccaatatgcctaaggccctgtttcttttagtttgggattattataatctagattattgagttagattactataagctagattgttataatctgtagtagaataagaagttagttgtttctttccagattattagagcctagattattgggtttgcaagtctaaagagggcgtggggtggcatggtgggtaatttttcacccaataatctagaaaaagctcacctaaatgagcttatcagattataataagctgggctccagattataataagctacttcaataagttgtttgtttctttcagcttactcctaataatctggattataataatcccaagctgaaagaaacagggcctaagtatgaaagtgacttgtactacactttgttatgcgttgagagtgagagcttctccttttatagccatcttatgtgggctctatgtgagcttctcctttattgtccgcgcataggggtggaaatgagccgagcgaaagcggcttggcttgcagtggctcacaacaagctaggcttggcttggcttagctcagttagggaaacaagctaaaacttgagctcggctcgactcgtttcctggctcgagccagctcgagctggcttgcaagccttcctgttgaaacacctcttcatatatattctgtaattattaaaaaaaaccaagaacaaatcatcacacatgtaaaatttaaat

SEQ ID NO: 51610 - DNA, 2820 bp, Oryza sativa
agtggattatttttttcctatgtttttccttcaaaaatggaggaatggaaaactttcctatagttttcctatggtgcattcctatgaaacgaatggtagtttaaaacccattcctattcctatgcttttcttttgcaattcctttgaaatgaataagcccttaggcttattcgtttcaaaggatttgtaaaggagaagtacaggaatatccaatcctttggaatgagcattatactatcattcatttcaaaggaatgcatgaaaagaaaaattcatatcccttcacttttagggggaaaacaatggaaaaaaataatccactccaacccaatgttttcaatcatttggattgtttgcaacccaaccataggaaaatttctatgttttccaagcacatgcattcctatattgttcctatgttttccctgttcctacggtttgaaaattctacaaaccgaataagcccttagggggaaatcaaaggaaaaaaaacaatccactccaacccaatgttttcaatcctttggattgtttgcaacctaaccataggaaaatttccaatgtttttcaatccataggtttacacatgtattcccatattatttctatattttttctattcctacggtttgaaaatcctacaaaccgaataagcccttatactttaggatgaagggtttaacgtcggtttctgttatcacatttttcatactaataaatagtgcattttgtacgaaatctctctatataaaagttgtttcaaaatattagataaatttattgttaggtttaaaataattaaaacttaattaattatacatggatggttttatcattttaggtactcgtacctaatcatctccccctaaagaaacttgaatcttcattccagcaagttatacgatgcaatatgagtatacgagtatcttgtactactaggagtatccctacagtacacatgttcgttcttgtagaaaatccaccagatactaccgcacggaagaactgagagttaatgatggcggtgggctgggggcctatcgtaagcttgtggtgacatgggagagcagagcaggacagagaggcagccagtcgctcagaacgcgagagcgtgcgtgagaagttgtgcactgcagattactcctgtcttcctctctgcccctctctactacagggaacagatagtggtttgcaagaaaggagaagagagagatctgggctctggaggaagaagcgatcatcactgtgaggcgatcttctgctactcctacccaggatgaaaattgaaaaggcctgcccatatctccactagtcagatactagtactatcccagccactaatctaatcatgcgccagattccatcacaatatcacatcatacgcagagatggtactcatgcaagtgtttcttctctctctccatctctgtgatccaaacagccccttaacatccttcctttttttttttctttacgtccatctctcttggtctgtagtacgttctctctctttttctgtggtttaatttagccctttgcctttggcctctagctggagagtgtacttctgaggagtagcaatggagatcgagagagaagcagcaggcgcgcgcgcgcatgccatggggtggatcactgtagcaactctgcccacaagaaaaggcttgttgaattgttttgttgccttcttcccagaactctagccacacgctgcatcattgcatatgacacgcttgcgttgcgttgcatgcatgcgcatcctgcagcagcgttgcaaatatacgagagtatatgcgatagtataatactactactccactactcatggtactagtactagtactagtactagtagtaaattacgagtatactctcagtgaaggtggatttttcagtgccctgattgcaccattgaatggagacgaacgaagaacagagggaggcacaaggctccagcaaaaaggcgcttccagaacacggaggcgcatttcctgaggcttctcctctctctctctctcggtcctatcggagtactggtatgaaggagtacgtggggatgggtcttttttactcgctcgttccactcccatagtagcagcagactggggtgcactgttgggtccttgggatatactccctccgtccaaaaaaccgtaccaacgtttgattgttcgtcttatataaaaattttttataattagtatttttattgttgttagatgataaaatatgattaatactttatgcgtgacttatctttttaattattttcatatttttttaaataagacggacggtcaaacattgaacacgaaaaccagggtttgtctttttttttttcggaggggtatgggctgagcctgagcggatcttgttgctacagtgcccagatcgtgtgccgcattcattgtctacctgaagttggtgagctggcctgtgtgtgttgtttcatgccctgtccctgcaagcctcctgcaagccagtgtcctaccatgctagctatattgtgaaatatatactgcggtttacagtcactactaaaaaatgatttttagcgacattggtcttttattttttcaggcaagtataaccctcagagctaaatatctgcctacaaaaatataaaccgggatgaatttttatcatccgcttgcgaaaatcaatttttcaaagcggaccacttaataggttcgcatgcgaaaatcatacctaccctaaaaaaatatatcttaagtctttcttatcttctcctccacccctccccaccagccaccactcatttccctctcaacacacactctctctctctcactggcccgt

SEQ ID NO: 51611 - DNA, 2036 bp, Oryza sativa
cctccctctcccagatccggcccctacgaggagagggcaggacggtgtcggtagcagacaccaccctccctcccagatccgacccgaggtgggaggggggcggcggtggccaccgcatgcaaaggagttcgccggcgacaacggcgttgtttttttctaaaaaaagttaacatgttcattgatgttaacttgcaagttgaagctgtgaatttgaatccaatgctttgtgttgatgtatggatgtttgtgattggattttgttttctggatgagatttatgagaatttgtgatttgtgatttgaaacctagggaggggtggggctagcgggaatttttttggcgctatgagtattttcgcaggtggggctactgtccgcttgtaaaaattagggatttttactgtagtttagatgcagacggaaggtttgtctgcctacaaaaacgtgttttgaccgtctggaaaaacttttttttttctagtagtgagtatgtactccggggtgatgtttggtgcaccattgccaaattactgattttagatttaaaagtttaattaagtatcaatggtaggggcctctacactttgttactgaactttttttatgattggctaaattaatcttaaaaaattaattgttttgagggctttttgaaaaataaatttaacactaattaaaaagtaaatttcacctactccaagtattatggcctaaattacacaaaatcacaggagttttgatacataatacataaccctagattttatggctataaaatttcacaaaactaaactagtaatcattttgattttgattaccatacttttgagttctacaatcacatatcaaatttatgagttatttattcatcatatgaatgaacatttatgtatgtaaagctttattaattttattataggagtaggcatgtcaatttggttaatgacgtggtttgtaaaacttcaataccataatacataggatggtagggttaggtgtcacgtgccaagatcctggtggtctgtgcaacttggaaaataataggtgaagttttataaaatttactcaaactaaaattagctttagtttttatgagaaagatgggacggacagatttttgaatttctaataatcatttcagaagatcgagataagtcgcccttcttgccagaaagaggagagagatgacatattttggtggcaaaccacatggacaaccatgtcaactgaggcaatatgtgacactttatgatattatggaatgctatttgacaagtttttcttgggagcgcctaaatatatattttcagtgtttaaggagctatacaccatttgacacttttaaattaaatgaccaccgttaaattaaatgaccacagtatataattatattgaagcatttctacgacaaatctacttttaatttttattttttctataaaaacttaacatttgtttatatgtattagagtttaaagaattgaatatttgattacactcaccttaaagcatactgtttgatgagcaatcgatgtcagattgggaggttgggactgataccatagcatccaagagagtgagagacgtcgcttctggttggtatcacttccacaaatcctttctcccgagctcctgtttgctgttagcaaattgaccttcataacttcattattctggtcatatatgatttttttgctctagatccaacgttgcacttatttaacactacttaaaaaaagccagtcacggagaaaaaaagttttctctgggtggcgccgtcggcggcatgcgagatccattcttcacatgcagctaggcttacgatggccgttagtgaaaaagaccttcacatgcgacgatattaagctgaccactaggtataaggattttttttttgggagggggaggggggaggggaatgaaataaaaaaagccatttgcaaaaatccccaaataaaccaaaacaaattcactggtcacaatcacaaattcatagcatcataaaaaatgaccaaaaagctgtgcgcatattagac

SEQ ID NO: 51612 - DNA, 4554 bp, Oryza sativa
atttcacggtgaaggaaccgggatgacaggtggtggggcggcccgtgcggagacggcgccaggggggggggcatccctgtttcggcgatggcgtcaggtggcggcgggcggaggggcggcccgcgcggagatggcactaggcggcgaggcgtcctaagtcgggacggtgctgggcggcagggcgccacgagcgccaacggagccgggcgggggggacggcctgagcaacgacagtgccgggcggtggggcgtcccgaggggtgatggcaccgggcggcggggaggcgtcgggcgttccccgtggcgctcactggcagcccccgcatccgcggcgtgcccctcggccggaaggatgccatgacggcgagcatggagcgcgtcgacgccacgctcctggagagcttcctcggcattgacaccgctgtccctttcttttctcctctgttggacgtccccttcttttctcctctgttgtccagatccagatcgaagcagctcggcggcctctcctctctcccctccggctcccatgacagtcactcccctctcccatccggcgcccgcggtggcctctcccctctcccttccggctcccacggcggtctctcctctccggcgcggcgtccctctctggcatagatagggggaggcgggccgacgagttcggtggcgcgttgaggaggagaacgacgagctcgcagccaacccatttccaatgccagggtgtgggtggaggcgtcgcaagccacgtgcgcgaggccacaacctcacagtgcggctgcgccattctccctgctccgcacggcttcttttctcacgaagaacgcatgcccaatctgggctacacgaacttggtttggtcacgctgcaagctgagttggcgggaaatctcctagctatcatgggttgactaaatgccacatgtgtgcattggaatggccttacaatacaacccggtttcgatttcaggtatgcacgatttaaatgatacgtgggaaaagacgtccatcgtgcacatccacgaaaaagatggaagttgatgccgccggcctcatacatatactagccagtgtatatatacactcgcgcgcgtgcagtgcatatatatgaatctctccttgcttccgtggatttaccatcaaagttgagacgcggcatgcagcgcttggacggcgcgacgacgcaggggcccgggccgcgaccttgcacgccgcgcgcacggcaacgaaacaccaagcgtgcaagcaataatcgcgcgcgcttacgttggacgcaccggccggcgcgcagccaggcacacacgcactgcagcgccgtcgccgtccctccgtgcatgcatgcatggcctgacgaacgggccaggtagatctagagattctagaggcacctgagacgagcaggggccgggtggcacggcacggcatggcagaacgcaggcggccggcgagataaaacggcatgggcgcgcggtacgacagggcactgcgcaggcgcgcgcgggcacgtaagaccaaccgggctctagcgcagcgtgtgtatcagtatcgcgcatatgcgtgcaaggagcggatgaaccgatgaaattgcaggggcacgtactgtggcatgcagttcgtctggtgtccccgtaatcgtgtctaccgtctacggtgcgttttgtaatatatggctgttagggttagctagttagctgcacataaaacaacgtaagtcattagcttattattaattaactattatatctgatttttttaagagaaacttctccatgtaaattattaacaccaatcaaaccttgtttagcagtttgagaagcatgtcaactcatggtaaataagatattagcttagcccaaattaccttgttttcacagtatatgcgataaccgcgcggttttcacggtaaccacgcggttaccacgataatcgtcaaaccgtggggcgatgataacctcacctaaaatgatttggtaaaccatgaacgtcaatctgtcttattaatcctaaacgtcgatatgtgaaaaggtaatgttagtaaagatggcataagaaactatcatttgaagcagtggcggatccacggaggggtgaagggaggcctggcctcccccaaagagattaatttctttcagtaccagctaacaccggtgggaaagtgtttttagtcccagttcgtaacccccctctttagtcccggttggtgtgggagtaacaccaaccgggactaaagatattttttcttttttttctgtttttaatattgaatattgatttcacaccatcccctcccatatccaaattatcacatatcactgaacatctctaaatcctcaaatcctcaaataaatcatctcaaaatacatcacaaactcttaaaaaatagatcatctccaaatacatcacaaatgtcacgaccggaaataacccaacagacgttccttacgtgcgtgtattattccttgtcccaggaggcaaggtacacccaaaagttgatacatttcagagtttatcaagcggaagcgtaattaattaatctattacatgggcggcgaagacccagcacacaagaagacaaacgaaaaacagcggaagactagggcgacgaccacaggcgcttgacggcaggcacgagctagacaccaaagccttcatcttccaggaactcctcttctgagtttgggaaaaattgagcaagactgagtacaaccaccatactcaacaagacacacccacaagtgcagaataaatgcaagggagtacaaggggggttatagtataaagggttagggtttgcagtaaacagcattaaaagacacttagttgctcaaagctattttgtaaatacgatcctagagctatacaaggttattaatcaaggccgtgaatccacacgaacctgccttaacccaaggcctacgatgattcagaccgaactggcaatccgaccctgggtcccagctcatcccaagccaacccaggccaaccattccacattttagttgttaagcaggttttaagaattaaaacactaacttgggtacattgctcggcttgcccataaccgagggcgcgactattcgaatagattatactctgatcagaggtgtacatctttacccacaagacacatcttcctcacgtgtaaccacgtgccacataccatcacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagcctttatttgccctagagatgtccatcgacccctgactttgtccatctccatccgtgtacttttgtttataagcagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatggagggggaggtgtgaatccaattccacaataatccaaccattccgtagtgtccaggtgatatgaatattcccaaagtctagagttgtaaaaccacctaatgttgcctaattaaccagcgaagcatctacctaaaatcatactagtggtaccatgagtagagtgtccactagttggggttttgtttattctagggtaaacaaggaaataataacaataacaataataaggtcataacaaaggtacataggcatggctagataaaacagtgataacgcaggaatttaaataaagcgataatgcaataatttaaatcaaaataattttataaactgggatttaatatgttcaaggatgatgtgacttgccttgctcgctttcccaaacgtcggcttcaacctccacgaagagcggatcttccgaagctgcagcgtctacacgaccaatggaaaagaaaaggcttttactctaataaactctatataaccagcaagaacaaagcacaaaaatgggttcctgacttcttaaggaaaaattagagacttgaacggtccaattccgagttcaaatggccaagttatggccatttgaagtttatatgctatttaaatgaatatttacgaatttcttcatttaaattttaatttaaaaagggtttattgcgtcagccgaggggagagggcgcgcggaccgggtccacgggagtggggcccacgcggcagcctcacggtccacggtggaccgggtgcacccgggctcacaccggccggcgtcgtgggccccacgcgtcagccgcacccaagggcgcgggcggctgacggccgggccccacgcggcagacactcggcgcacccgagggcggtcactccggcgcggtcagtggaggcggcgcgcccgcgccccgatggtcgctgccggcgaccaccggcgcggcggagcggtggccgagagaggggaggtaagggtgaaaggaggcgacgg

SEQ ID NO: 51613 - DNA, 2367 bp, Oryza sativa
  unsure (1)..(2367): unsure at all n locations
caccgccacggtggatggccaccgccgcccgatctggccgcgtaggtgccggttgccgtcgaccctcgccgccatgcccgcttgccgccgtcgcctcaccgcgcccgcccggtcatcgcctcaccgcgcccgccatggtcgccgctgcgcccgcttttcgccgcctcgcaccgtcgccgccgtcccgcgaaagtagggagaggagagccgccgccgctcccgtctcgtcgtcgtcgtcgtcgtcgccctcgagcggggaagggcgagagagggatccccccgccggatccgggcggcggagggcggatccgggcgccggccacctcgctccgcgccacccacgacgatccctgcacccgcctccaccgtgtcccgcgcccggcccctgacgccgacagcgcatctcaccgccgccaatgcgctcagcacggcgccgctgctgccgggggcttccccgacgaagcccgcgcgccggtcgtcgagccgcacccgtgcgcctgccggcgcgcgcgtgagaagagagtaagggggggagagagagagagagttgagaggataaggatgagaggtggtgagaagaggataaggatgatgtggtaggggaggagagagagagttgagaggatgaattttttttgaaattttgggagggacaggtcgcgtgcgggtgagttaacccgcccgcacgggataatgtattttcccatgtgggcgatggcagttccctatttttccatgcggttccacttacggaccgcatggaaacaaaatagtgtggcgtccaggaaaatctattatgtagtagtgagatcattcgtcgaattattatcgcagattatccacttgattacatggttaaattaatgttttgataaataaacataacaactttacaataagtgatctaaacaatgcaataaaactatttttaagaaaacataattttaaagatgcaaaatggtgcagcaaataatccggtgaaataattgaaaagaacatgnccgttcatacattttcatacatttttaagtgttcggacgggatgataaaagttcaatctttaaaaatcactacgccagaaccctacatctgtgacggcatatcattgacaggcctatgaattggtcaaagatgaccgtcacctttgacgggtcgctatgtttgccgtcatcggtggggcatccggccgtggcccgtcacaggtatcccctcacctgtgacgggccggaaggaaaagctgtcacaggtgagaaagtgacgtgttttcctcccaacccgttactgttatcccctcacctgtgacgggccgtggcattatgagccatcacaggtggtggtccgccacctatgatggatttttttttacggcccgtcataggtaggtcaatacctttgacgggcaactcaattgaagcccatcaaaggtatgaccaacatctttgacgggcttttttaatctaacccgtttgaggtgtattgggtctataaataccccccaaaccgccaactgttttccatcccgaccagttcactgttcacaaatcggttgggaaggcaaggggggcgatttttttgctaaaattcaaggtaaaaaacatattattctccattccttctcaatatatcgatcatcatatatttttcttcgtatgttgttgatttcagatggatcgtagatggatgtactatgcgcatcgttcgtctaccgagtatagagaggggtcattgaatttgtcacatttgtggataatgacagaaaaagtaggatgagcatgcacatgttgtgtccatgtagggactgtaagaatgaacagatgatcgaagatagcgatgaagtgcatgctcatttgataatgaatagattcatgaagaaatatacctgctggaccaagcatggagagcaagagacgcctgatgtcgcagctgaagaagtgttggaccaggatgtagagaacaccgccggcgccgcagctcgagaaagcatgttcgtaccttctccttaaggtggagagaccatagatttggacactcaatatctatctacaatgttgcatgacattgaagacgcagaggacaacgacagagattttgagaagtttagtaagttggtggatgattgtcagatgcccttgtatgatggatgcaagtcgaagcacatcaagttgtcatgcgtgttggaactcatggagcttaaggctagtaatggctgccggacaagagttttacagaacttcttgagctgttaaaggacctgttgctagaggggaacaatttaccgcaaacgacatatgaagcgaagcaagtattatgtccgttggggttggaggtaagaagaattcatgcatgtctgaacgattgcattttgta

SEQ ID NO: 51614 - DNA, 716 bp, Oryza sativa
atgaaacagggcccaaaatgagtagttttagcctttttctttaatttcttgaatacatatacgaggtatagagtacatatacttattttttttgtctaaaaatcttgggtatacgtctgaatacccttgaatcaatagtgggcccgcccctgttatgatccaattgccagggcatcatcttcaacctcaggattaggggaagcatcttcaacctcgggatgagggggaagggagagagggtagctcaccggagggacgtcgacttattattccaccggcggggaactctccctcctctttggcgccggtgacgacagccatagatttaccgaaccaaaacaaaaacctagatttgggttcgggggcggcgaggcggcggtggacggagccgcggggttggaggagggaggtgagagggttctgcggcgtaggttcctagaggagtgagtagaaggcggcgatgccggtggcgtctccggtggcaggaggaagcccagaaagccgcgagcaaagcttcgatggcggatgccgcgacgcgaggaagaaagaagacgactaatggtttgcctgcacgaatcaaagaccctactggtatttggttgatttgtatacgcctagaaacttatagtcacattaaatttacacctctgtgctataaaaatattatatcctaactgcgaatcttgatgcatgcatgtcgaggttcatacccagaa

SEQ ID NO: 51615 - DNA, 804 bp, Oryza sativa
aatatatatcaccagagatcgtcgggactgcaaatatttcttccaaatatatatagctggagttcgccgatggaatgcaaatatttcttgcaaatatatagtggcggagatcgctggcaattccgctgataatggcggcgagccggcataatatagcagtatcttatctcagacgccgccgacattatcgtgcgaaggcgtggaactatcgagcagttagatcaccgaatcgcgtgcaaaaaaaatgcatctatggaatctccgaacccccatttgaacctttttctttttcttttagtttccttttctcatcaggttggatcgaacgtgaggtgattttagacccagcagtgtgcaacgtccaaaatccactcggtgctatcaggccgtatccacagtggaaccgaccaggcctagaaattaggctagattaaaagcctataatttacgcggacacggaagttttggcccatgttaatgagtaaggtggaatcgaacccttttgaattatttttcttggttttgaaattaggagggtttggagattatggggctgtttggatgctatactaagtttgtcaccattcaccatacatttataccacacttgcctaagttgtggctttaaaaaagaaatccacactttgttgagttgatgacgtgtagggtcataatatatgagaaggagttttgccacaagtatggctatgaaccaaataatagactaactttgtcaaacttgcctaatataaagtgtggcaacctatggcaaactttgggagcaaaccaaacaacccctaaaac

SEQ ID NO: 51616 - DNA, 704 bp, Oryza sativa
agagtagtactaggtctatctaatagatgtgatcataatccatattggttaaaaaatgattttaagtattgtgactcatacatctgcataccagaaaatattgtggagcagagtacaaataagttaaatgatgtgccagcgcttgttacacatgccctatactatatgcctcttattaagtgccaatgggcaataccattctgttatttgagggctgttgaatgacacttgagaatgtccaacagttacatactcgacacaattgagattaagctaggcttcacgaaatcattcagtggataaacagaagagcacctaattcgaagcctcaaagaacaaaccttgttctggatggagaaattgatgaagtttgtatccacaataacccggtatggcggcccgagcgctgtgttgtagctgaagaacagcgccgaagagacctgaggcctaaaataataaaccaacaagacttgattaatccaatcatcccaataatcgttaaacactttaaacaaatggatcccaaaacgcggtaggcactcacacattccgcccgagcttctccttctcgttatccttcttcttggggttcaacacatcctccttgtacctagaggagacaaaatttagggtcgcaacaaaaagaaccgaatcaccaagaaaccaataggagagggagatggtttgcctacttctggatggtc

SEQ ID NO: 51617 - DNA, 729 bp, Oryza sativa
gatcgacgccatcgacaacgaccggtgcccgtacaccgccgccgagctctccgacaagatccgcgagctccgggaggacagggtgaccgtcatcctccccgcgcaggctgtcatcaagacgatgatcgactcggtgcgagcagctacgcccgccgccggcggcgatggtggtactcgtcgtcgtggcgccgacgacaactccggtgccattggctgtggcccaactcaccagtcgcggacgatcagccggtagagtatgtaattaggatatatgtaacccatcgctgtcgatttaatttagccaggagtagtttcttttttcaattacatactctaccatgcaatgaagggtgtgtttagttcacaccaatatcgaaattttggttgaaattgaaatgatgtgatggaaagctgaaagtttacgtgtgtaagaaagttttgatgtgatgggaaagttggaagtttgaagaaaaagtttggaactaaacaagaccgaaatgtggcattgttgattattgatcgtgctcgatatatcaattaaacgtacggtccatgttggaatataaagtaaattgcccgtctttactcatcagcttaagcttttgggttaaactggtcgatgcatgcaacttaatatagtatcagagctaaatgtctcgagttcgaattctggctggcgtgcaattaaataaaaatttcagcatacttttattccacgctagagacttg

SEQ ID NO: 51618 - DNA, 712 bp, Oryza sativa
tgcttcttttattttcatgtccagaccatctgtcagctccttttcagtctaagaaatagtgttagattaagggcagtcttacatgcattgcacatactttaaatataaatagttcacttgtactgctgtattgtatcatacaaataaacaatagacaactccattgccattaaatcatgacaacggcttcagtatgctggtttctagatgagttatccctgttgattttagataatttatgaatattgaacggcttgtgagttgtagtgcctgtaattaacttgtctttaatttcttgtttgatcattgcaaattcagctgctgatggtctgacgagatagaagtcacagaactacaatagcagaacctctgacatcatctcttcagtaattttcgtatcttcagatcaaatgacagagattggatgtcttcttgttgttcttttttgttgatataggcttagaaagggaaaccataaactcttctttgctctgaagtttacagaactgttgtaaacaccaagtactagaatgtatgcatgaacaactgtgcgttctggcatttgctgtagtttcctactttccttggatatctgtatataatatgattgatcataaatttgcggtgtggaatgttatgctctatttttgacaactgaaatgttatgatcaagtctgaatacaaggcaactctttcataacctgttcctgta

SEQ ID NO: 51619 - DNA, 741 bp, Oryza sativa
aatttatatatatgatgatagtatgaggctatatatgagctgttgttaggaatttagagaatttagagagggtgttttcttcgatgaactatataaaaacaagaagcaagatgagcaacaatctacatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccatatgctataatattatacaattagtaatgtgtaatattataccaattaattattggacttctagaagtaaaaagaattttgttttacccctacctatttcgaatacccaacctctaaatcctgggcccgccactggatcataatccaacggccaggtccaggtgactgaaatgtgcctagcgaatcctaacatattcgttctttggccccggcgatgagtagcaagtttattactctctccgtttcaggttataaaacattttgactttggtcaaagacaaactgtttcaagtttaactaagttagtttcatcaaatcaataattgaatatatttttataataaatttatcttgggttgaaaatgttactaccttt

SEQ ID NO: 51620 - DNA, 1009 bp, Oryza sativa
ttcttgtgtcaccgtgagatcgctggggaaatgcaaatagttcttgcaaatgtatatcatcggagattgccgggaatgcaaatatatatcgccgggggaatgcaaatatttcttgcaaatatataacggcagagatcgtcggcaatgccgccgatgattgcggcgagccggcgtaatatagtagtatcttatctcagacgtcaccgacactatcgtgtaaagacatggaagtatcgagcagttagatacttagatcgtcggatctcatgcaaaaaaaagcatctgcggggttcggagataaaaactccgacccccgtttggacccctttttttcttttaatttcctttttctcatcaggttggatcggcagtgcggtgattttagtcccagtgtgcaacgtccaaaatccactcggtgctatcaggccgtatccatagtggaaccgaccaagcctagaaattgggctagattaaaagcccatagtttacacagacacgaaagttttggcccatgttgatgactaaggtggaatcgaaccctttcgaattatttttcttggttttcaaattaggagggttcggagattaaaacatcgatgctcttcagtatttttttctaccttttgccatcacggcctaataactttgggacaactttggttaatcggctcgaatattacggacgcaacaatcgttttaatatatcagcaggcttatacttgaaaaaaatcagcaattgcaagcacatacgtaattaagctcgtattaattggcttgtaatttacaaattttcccttgttttcctcaagttttgcccttttttgctgtcatcgtaatttacaagtattacgccttggcaatgcacatgaacgaatgaatgggtcgacgaattttacaagttattaattgatgattgttgtttgattaaattcaccacgcttctttgtagtggcgacaatagcggcgacggaggctgtgacgaccgacgacgcgacgatgatggtagtgt

SEQ ID NO: 51621 - DNA, 1258 bp, Oryza sativa
atctagtcatacttagttgctgaaaccagaatatgacaggaaagcacatcttctggaaaagagatgttgtaaatagtatgaaagtctcagtagtcagtagtacataaagaggtttgatattcaaaccttcaactaagaataaaatcatgtttattgtatatcctactaatacacagtactacggtaccgagacttgaattgcagattttgagcattatgaaacagactacagaagtatagagtacttgcctttatgtatgaatataacagagacttgaactgcaattcttttcaatgcttttccttttgagaaaaacactactacttccaatcttggggacaaatgctgcaaatccataccagcaatcggaaaacttcagaaccattttgatttctgaatatcaaacagaacaggacaagtactaggataaccgaaatattcagttcagatcatcagaataacttcagaaacattctgaacatcacatcatccagtcaaaggcaatctgttcacaggatcaagatggacacagaaatttggggataaaacagattacttcgattgcaatttcagaataaccagcagttacattgcaaccatggaaactaagaatcaaagactacgacatgacaaagcgacgatctaataataacaccaactggtagaacatgacaagtccctatgaatcaagcaagaaccaaaggagggcggatcgcctaagcgcgctcaccgcggatccggcgcgcgagctggatgtccttgggcatgatggtgacgcgcttggcgtggatggcacacaggttggtgtcctcgaacagcccgacgaggtacgcctcggcggcctcctgcagcgcggcgacggcggagctctggaaccggaggtcggtcttgaagtcctgggcgatctcgcggacgaggcgctggaaggggagcttgcggatgagcagctccgtgctcttctggtacttgcggatctcacggagcgcgacggtgccgggcctgaagcggtggggcttcttcacgccgccggtggccggggccgacttgcgcgccgccttggtcgccagctgcttcctcggcgccttcccgccggtggacttgcgcgccgtctgcttcgtgcgggccatcgaggaggaggagaggagagcttggcgcggcggagaaggcgaggcggcggcggcgagtgatttctttggatttgagacttggcggtggtggattgagagggggggaattcgcggtgtttaaataggcgtg

SEQ ID NO: 51622 - DNA, 718 bp, Oryza sativa
aagatgcacacggcaatatggacttccatgatagttaagtaggtatagtttttttttttaaatcgaagccaggcaaagttggagttatattaaggaaaatagaaagtatttacaatatcaccaggaaaggtgaaagagacagaacaggggaaataaagaagaaaagcaacaaggaaaacctaaaagggagacctaagtggatattctcgtgatgttttttttgccccacacatactccaaagtttgatttcgtcttgtattttggcgagtagttgcggcatggttttctcttgattttgaaaaaccctcctgttccgttcacaccatacttcccataccaccaacatgtggattgatttgagtgctttggccttgcttttgcctccttctgatccaccattccaacagtacttcgttttcatcgtattggtgttctatatcgttgcagttcagtatactcaggaccctctcccagatatggcacacaaaagcgcaatctttaaaaagatgttgggcggtttcaaggttcctatagcatagttggcagaaatagttgtttggccattgtctgatttgtagcctatctattgtccaaactctattttgcaatagaagccatgtaaagtgtttgcatttggaaggtgcccattgcttccaaatcagttttacagctgcagagcttattctaccattaaactgcgctatgtagaatgacttt

SEQ ID NO: 51623 - DNA, 839 bp, Oryza sativa
aatgtacctctttattccatcataaattgttgttttttgggggccatatttcaaaccgtctaggtaagttgtcatagcatcttcataattgtgcatcaagaactgaacttcacctttacaaaaatatcccttccaaaaagtaggatctacctcaatgcatttatctgcatcttcaagcccttcagccaatgcatttagctcgatgcggcatttagctctgtcgctaaaattctgggtgatcaatcataaaagggcataaaaaatgaatgccaaaacttaaaaaggagtagctcgagacatatctttcaccaaagaacaaaatatctttcgactcacaaccagtagcggtatcaatacttactctgggattcaatggattcctttttatggctttagtaaactggattgctgcttccttgtactttttcttactgagaagttctttgcctgcaatatgtgtacatactcagcagcggcatttgtacatctcaatgagatggcaattatcattttactagtactagttaggagctggttatatcatgcttaaagaaaggatgtagacaaatagtcctacaatacaagccccatccagatattcagcttactttgagttactctacttccactgtaacaaccagaacacttgttgcaaagtacaagttctagaggaagtacacggccttaacctctatccccaggatgccacagatgccatatgatgaggtggaggaaagaagggagtagagaaaggaggagcctgtgagccacccttatgcaagaggtaacatgtacacaaacttccagagaaagaaaagataaagagtaaatcgagagca

SEQ ID NO: 51624 - DNA, 2037 bp, Oryza sativa
agtacaacgaatctagacatgcttcctgtccagattcgttgtactattaagtgttccatccggtcctaagtttctatactatgagacggaaggagtagcatttcccctttagagccatagcgggaaaaacgacactccattgccctgcctcttttcttcgatggctacacgctctaaccctccctcatctattccccacccccaaagccatcgatatattccgcgaggctgtccgctgtcctcactcaggtgaatcctctgccacctctgttggtggtttcattgtggtcatccacgtcttcagcgaggttaccgctctcaggtgagtcctctgccgcttccaccaatcatgagtcatctcatcatcaggtatcgtctcccatcttgcgtgttgctatccacgacattctcgttggtgtgttgagccaccttaatcctcaattttttttgcatctccatatatattaattttttcgcgaacgcgtaaaagcattacacatcaatatattagatctatatatatacaataaacttgtcatttttttattttctagtagggagtgtgtcatcaaccgtcaacaagaacgagaactcatcgcgtttagacttttggaccgagggagtagttcactacagtctactagactactacggatcagaagaactctgggaaaaaaaagacactgaatgaaatagacttgccggcagtttgacaccatgagttcgcaggccgtgtttagttgcaaagtttgaaaaaaaatcacatcgaacttttctacacacacaaactttcaacttttccgtcatattattttaattttctttaaacttttaattttaacgtggaactaaacacacctgcagtttcagacttcttcaggtccggatagaaatatcacggaaaatgctggctcattatcattggaccgttgggtccatgcaacgtcaagcagatactcctgtaaaaaaaataacttttgggtcactcgtgtaatactagcacaaatcaaagtttgcaatgtgaaatgaattagacgaggatttggattttggcacgcttaattaagcttagctgctttttatttttagttagcacgcttttcaagcagttaaacgatatatttcttataaagacataaaaagatgcttttaaataaacaaatttattttcatttttttataatttataattaattaatcgtacgctaataatgtttgtggttgtgcttgcagctaatcatccaacacttattgaccgaaaagaacacgccagaaattgtattgtcatgcagagagcagagaggacctcaagattatctgcattcttctttttttttcactttttttttagatgtccacgacgactaaatggttggaatgattggtatcttggtcgttttcatgtttccattggccttattcaaagccattgtggggttgagtatttgtttcttgcttttcttgtcactttctttaggtttcttatatattacttttcgagaaatacgtaggaatcaatcgttcttggtcgcctttaatggatttctttttgcacgatgaaatgacgtgtaaatctccatcataaatattctcagacagggaaggattcaggcctagggcagccctaggtctaggttcttgacttcatgtaaatttcatttgaatttctaaattttgtatgaatgagtggaacatcagaacaagtaatgcaaatgagactgtgttcggaactctgttttccaaactctcccctctcgtttttcgcgcacacgctttttaaattggtaaacggtacattttttaaaaaaagtttatatacaaaaattgcttcaaaaaaatcatattgatctatttttttaaaaaaatagctcatacttaattaatcacgtactaatgaatcgctctgttttctgtgcatggaagatgggttcccaacacacacctccgaacacagtcttacttgttcttagaaagaaagaaagaaagagacttcgcacattcaagcctcctttgaaacacggcaatttttactgatcc

SEQ ID NO: 51625 - DNA, 2261 bp, Oryza sativa
ctaaaaaagacagaatgtcaaataccttatattgcgcgacggactgatgtacagatgtagtatttgtttctatcttgcggtcgatccgttgatggctcatgaatcatttctctctctttttcgaaggacgggaatctgggttggtcactcacaaagatgaaggattgataccttaatgagatgcctggacgtctaggtatggagcactggaggctcttctctatgccattaggccatattgcccttacagcaggttaatgagataacaaggggtaggtgatcacggcatcacgccaaggataattggataaagcaacttgatttgattacaaggggtggaaaaatgtgctgcatatgcgagtgcctgtgcctgctaacacaaggcacacctgactgatgccgcatgcttccaaacactactccctccattttacaatataaatcattctagcattttccatagaatgacttacattgtgaaacgaaggaagtatttagtcttcaccttgtgatttccaagatctcttttgacacttgacatcgcagtagctacagcttccaaacactatttagtcttcaccttaagactcaacaatacagttacctaatggactaaaatttatcttcacacaaatataagaacagcacaggcgacaaagtattaagcaaaaaagggtacaactgtaattgatgggagctaaatcctattgattccaagactcacatttcgatgcattgagaggttgcttgcgtggtatcagccacatgtgaaaccgcttcaagcatcctcatcttattcttcactactcacaagtgccattcatctgaacctgactctgcatatggtcactggaaccatattggccaagtagcaggcctacaagggtaaccttgagtgatcgtttgcaactttgcataactggttccctttccatgtagtgtacaaagttttcattccgctcatgaaagacaggaagattgagggtcctcggagaaattcgctgcttccttcaaatccatttacatgacatatggttgatccatgaaggcccattcgaagatctgttcatactgtgaggcggcatggtcccatgtaaagtcgcttgacatgcctcgcttcattagaccctcccaagaggacttgtgttccctgtatgtcgaaattgccatccgcaatgcctgcaagaaacgatgcaaatttttagtacatactccaaaagttcatatggtgtaatgcttgtgccctgaaaataccattttcaatgaggcttttattactgattctacaatgttttctcaacaaagtttgtagctttccctaattattatcttgactacttgagtacaaggcaaaacaaaactgactagtactcacattaaattgtagacaagcaatgcaaatctttccttgtcaaatccatttttttatcagtttcatttgaagtgttcaatgacacaaaatgggccctgtttccctgtttccacattcgaagtatgtaccaaacatgcaattcaaatcatggactggtcagtcgagcaatttagcaacctaagcacatatatgcttcagggttctattccccactaattccagtttcccattaacccaccaagtgctgagccgctttcttctttggatttcaatcacgtgtgttccttttctttagtttgcttgtcaactctttcttataatatttacttaaatctgaaaactaacaagtactaggagttcaatcctactggaataccagacaataaccagaactggctggaacatacgtcatgagcctcaccttgttttatcctttttacttctggcaagaatcaaactacattatgattaccggcaagaaaaatagcagtatacgatacaaccaaaatgcatagttgaaatcatcatgctattgatgttaagagggccaatagtattgatgttgtatggcatatataatgggattaaggaatggatagaagaactaaaactaggtgcaggttcaacataaacttacccacagcattttttcaatggttagtggcgagaatgcccacctgcaatatgtcccaagtagcaacagttaaattaattggttataaattgaataatatacaaaaaaaaattgaatttaattaattccactaaaataaaataaatctgcaattttactttaatgaagcattccttaccctgtaccctgctctcctttctcagcaaacgggttaaaattctccactgtatcctgttgaataaataaaaaaaagtg

SEQ ID NO: 51626 - DNA, 1191 bp, Oryza sativa
tctagtctcacgcagaaaaagaaaacagaacttacgaattgaatattgtcccgcatgagatctggaatggcaagtttaattagatcaatgcctttttgatagtccaatcttccaataaagccaatctgtaaataaagctaataaatccaactgcccataaaagaatactaaaataaataatttcataaatatttgtatctaaccagaggcacatcgggccttataggtaaacccagctccttctgcaattcagctttacacttggcctaaacatgaattcgaggtttcataaattagtctgtgaaagaaacgacgaggtgcaaagaaaaaaatgaaacgagatgacaatctgtatatacatggtactatacttcacctttccggacaggtcatcaacagaataatgataagggagaaacttgtctgtggatgggttccaatcattaatgtcaattccatttacaattcctacatatccagggaatagattgaattaatttgtatcatccaccctattacaatgatcagtccaagaacaaaatataaaaacccaaatataggtaccattcaatacactcttccgggagcttaagagctcattgaggccttgcccaccttcagcagttgtgacctcccatgaatacccctggtaatgaaacataaatgattccttaattgagtgcaagacaaaatgaacgaagaatttgcggtttaaaagccaaggcataaaaatagactaggatgggaaaaaaaaatcaactctaaggttaagttcaaatttcaaattttgactgtggccgtaagccaactagtagacgaaaaggaaggaatctcacctggctgacagtcacaattcgatctgctgtcacaactgcgccttttaaaaaattgactgcctcacccttgtcaagggcatgccgccttgcccactctggaaacacccattctaatgctccataccattcaggtggcaatcccaggtcaggatatgtactggcaggctccacaccctatcacattgaaacacaatgaaatactaacatactgcacttacaaagtgccattacaaaactacttaaaagatatgcaaaatgataggctcaaacctgatgtgctagattatgtatgacaagaacactgcgggcatccctgtaaacaccatatggtctatattttgcagcaagaaggctg

SEQ ID NO: 51627 - DNA, 749 bp, Oryza sativa
tttctatataagatgtactccctccatataaaaagtctaagacatatttcattctttgtttttttaaaagtctaagtcttatttgtagtcactatgtggtaattaaattgttgattggaaccgaagtcattttatattagtacttattggtttcatgctcattggttttatcacatggtgaataaattaattggtcattggtcttgataaaaaagaaatatgccttagacttttcaatgatggagtatttggtcaaaaattttcctaaatgggttattatatctttttaaaagatttgtttcccataatgggacataatttgatttaatttgtgcgggcccatctattttatgtgcatttagctgaatatcttcgaattcgtacgagatatgttacatcgtgtatgtcttctcagactcatgacgttttccgccctacttctacaattactcgtgcttgtctatttgtccactcgtgacggacctatgtttttttttcttttgtcctgggtgtgctcacatagtcccaatcagagttattcatatacacgaaacacactaaaagatcttaatttatcaaaagtacattaattacaaatagtgcaaataaagtcttacacacataacgtataaacaatgaaaacaaaatatatttgtgtatgctttttatagcaaatatggcttgattacatcatgattagtgattcatttctaatcttaggaaaagctatatgaaggtgctaatcttta

SEQ ID NO: 51628 - DNA, 1255 bp, Oryza sativa
aattttgacgatttgagtatgccaatcaaactaatactcaccaacgagcttgattcccaattccacgtaaagttctttaggtgattatatatgtatatagatcgaccgagttcatgattagtactagtgtttagtaaataaatttactaagggcatgttcaaattgttttcaaaataaaccttattaaattttagcaagttgacatattactaaaataggatttttttcatgcatttaccaaaattggcaacaagctaaacgtagacatttttttaacaacttttttaaaaaatggtataattaaaaatggtatcattctgaacaacccctaacgttacttcataaatagaactctcttgatcaaccaccactactccataagtagaactctcttgatcaaccaccacatgtcataccatatactccctccgtcccataaaaaacgaatatatagaactgaatatgatatatcatagtacaataaatctggacatatatatgtctaaattcgtagtattggttttttataggacctaaaaagagtagccactggtgcgactgcagagcagagaggcagagtggtcaccggcgcaacgccgtgcattcatcagcgccactagtgcgagtgtgcgactgcaaagagccagagcgatgatgatggtgattggccttcaatagtcccaagatgagaccgttttaaagtttccggatccatctcaagatcctagtatttagtgtatgaattaaatgaatcgtaatagcacatgacctcactgctgccttcacccaaattatttgtttgcaattactcctacttgcaaggagtggtggaacgtatacatctatgtttctattcggaacaaatacgaattactccctccgtttcaaaatggttggtatcgttgacgttttagcacatgtttgactgttcgtcttaataaaaaaaatttgcgaaatatgtaaaactatatgtgtacataaaagtatatttaacaatgaatcaaatgatataaaaagaataaatagttacttaatttttttaataagacgaatggttaaacacgtactaaaaagtcaacggtgtcaaatattttgaaacggatggagtacctctctaaactatcacggttgctcgatttacccccctcccctaactataaaaccagacattttacaccctcaattgtttatattggacaaataacccccctaaacactgttttgagcggttttaactggagcgtgcacatgtga

SEQ ID NO: 51629 - DNA, 1457 bp, Oryza sativa
  unsure (1)..(1457): unsure at all n locations
tagacatacctttatcaaaatacatagttagtaataattatatttgaggatgaaggggatatagtttatttaacgctttttagacaagtatagtttatttagctattcagccatattagtataaaacaaaaggagccatttacaatactatcttcgttttttaatatataatattattaacttttaataaatgttggatcatttatcttatttcaaatttcttgtatacattgaaaagtcttacttaaagaacatttgataataaataaagtcacaataaaataaatgatatttttttaataaaacaaatggttaaacatatctcataaaatcaacggcacatatgttaaaacacggaaagagtatatatactataagatactctgatcgatgagtataaatttatataccttgttcgttcgtttcgagtgattcactgacaaaattttacttgtttttccatgtcggcattgtgcctctcattacaaagtccaaacatttttttttattttcagttcataaaactgctaaaaatataactttgatatgaaaactcgtgccaactcagcaaaatattgtaatgatagttaaccgagaagaaatttcatggcacccaagtctcaaccataatataatcttcaattcaaacaacacccggaagactgaccttccttccaaaaccccaatttaacacgcaaaccctctataatcctctacctaatcactcaacccaaaattaatttgaatttaatttggaaaaaccaaaccaaaacccacgtaaacaaatatcgaaaaaagaaaagaaaaaaaaacaaaccaaaaccaatcgctttaaaatctcccccttttcgttccccaccatccacgcggccgtccatcccttcacactgctccacagccatccatccctccgccgccgccgccgccgccgccgccgccgccgccgaaaccctaccggcgtcgatcgaatcccctcgcctccgcctcgcgcgcacgcggggggttgggcccgaatcggaggcagaccggccaggagcggcgggatccctcgctccgtcggcgcgaatcttggtccggccatggcggtggtgggggtgctggattctttggccgccgaggagcggtggctgtacccggggttcctggccatgtacgccgccatctactgcgtcggccaactcgccctgctccggcggtgggcgtggccgctccgcctcgacggcgccagctgcctcatctccctcgcgcacggcacgcccgccgcgctcgccgcggngggcgccatcctcgcgctgccgccggaggcgagggggttcgccgcgcccaacacccgcctccaggaccacgtcctcgactacagcgtcgcctacttcaccatggacctgctccactacctcgccttcctccccggggacaccctcttcatcgcccaccacgtcgccacgctcttcgtgttc

SEQ ID NO: 51630 - DNA, 3942 bp, Oryza sativa
  unsure (1)..(3942): unsure at all n locations
ttcctgcagcccgtttgcgtgcttgtgttatctacacaaattaaattttctgaaggaatgttatgtcctcagaaagtcagcttgcaaaccacaaaaaatatcctgaacagcttctaagtcctacctctcacataataagataacaagggttttttttcttttttttttgcatatgtggttagaataagacnnaaaatcccgaagaatgctatacaatggagtgataatctatataatcgactaggaaaccacatcaataacaatctcaagaaacgctttcacagacaataatttggcatgttttcaactaggaaaactcgtcttgctcgatcccccaacaaaaaaggcataagcatctgccaccgatttacacactcagaaacctcacctgacgcctaataacatgtaaacggtgtccatcgttaaatttatttaaacgcaacagcatccgaaagcacctaatatgtccatagttccccactgcttatcatcatcatctagtcttagccaccaccagaaccgtacttcttaccaaagacgaccacctgcagcttgtcatatccagcaagcacaccagcaccagcaacagcacgcagaatgttagcaccagcgcccttgaagagtgacttcgcaccctccttcgcaacaatctgcttgaacgcatccaaggagctgttgtacttgacagcctcacagatgtcatcatcatccgacgacgaacagtgtcgattgggtatgaagcaaggccagcaccaatggtaatgccccaaccaagtaagaagctggcaaggaagttatcctgaaaataacatatatcacatattatcagaagtaaatataacaaccagcaggagtatagagacattgagtagattcaactaaaccaaaacaaatgaagcaatgagaaaggcaaaatatttgagcgcgaggtattttagtggagcaaccttatggaataaataaaaaattgccagaagatgaacaaagattgcattcacttcactaacctgaaggttgccaacaagaacgactggcttgagagaatcatacattccaaagtacagcccacgatagacaatgataccaacacaggagatgttgaatccacggtacagaccagcaataccatcagacgcaagggtcttgcggtaaacatcaacaagtccattgaattgcctcccaccacccttctttgcagccttggcatcattagccagacgagtacgagcataatccagagaatacacaaagaagagagagcaagcaccagcagctcctccagaagccaggtttccagcaaaccacttccagtaaccatccttgtccttcttaaagttgaacatgcgcttgaaatggtctttgaaggcaaagttcaaggcctaagcaaatgtacaatataagtcaacatccaaggggagaataaataaaaaacagacagtaggatgcagtacctgggtaggaaagtaacggatgacattagcagtgttccctctccacagtgcaatcacaccttcatccttaattgtgcggccaaagcagtccgcaatacctttgtatgggtgagagagcctaccactcttgatcatttcatcctggttttgaatgagaagcttgattcgctcaatgggagcagcagcagtcttggagacagcagctgaaactccacccatcatgaagtcaatcataaacccagaaagacctttctcctttggggcagaagcaaagactggggatacagatgtgacagatgagaacccattgttcccatccatcccattgtatgacttcagaggcacactgtaagaagtgttggcattgtagagtgcgggattcttcatcaaagaataaggtgagatcttgctgaacatcatggactgcccatgtatcttctggagcacagtgggagggcccaaatcgtcagccatcttcagaaaacaacctatgaaaaagcaatttcaggacatggatttcagttaggtggaaaactggatacgataatgacatgcaaaaatttgccaagctgtaaaacgttagaatgctctactgacaaatagttagaacgaacaagtagaatattcaaaataagtacaaaggtagttaattactacttcctccgtttcataatgtaagttattctagcattgcccacattcacatagatgctatgtctagatttattaacatctatatgaatgtggacaatgctagaataacttacattatgaaacggagggagtataatactcaattaaaataatctgaacaaacaatgaatatcaattaccacaagaccacaatgacaacgtaaaatctaaataaatctggaaccctctttcacacaacgtcttgtcatataaaaggaaacagatatagctacatcacctaaaaagataaaatatacaacaaagagatgtaaccaacaaatcaacgaaattacagaaaccaaacatattcttccatttcaggtagaacctttcatccaactcgtgtgaattatgcatcatccagatgaacaaacagttcacacacgacccaatataagatgtatgtcataaccatcccacagttcaaacattactgcaagttatttgtaactccaaggaacataaccacaatatataccggttttgcaaaaaccagtcatatttgtcactcctataatgcattctttgtccaacacgtgaactatccacaaaatcaccaacattcagacaccttggcaattcacagcgggagggccataaccagttcaaacagcacaactaaccatgatatctcagcaatccaagaacgtgaataattgtaaaaaccctctactacacggcaatatatgagcgaagtcgaccaaatcatagtctatgagaataaataagaatgaacttatactacagtgaattgaagattccagaaccccacgtggaagcagaaagaagtcacacgaagagacaggagattggaatatccgttcccaactagttcagagagtaaagatagtaccaaatccaggtggaaaaaatacagtaagcacgcttcacctcaatccaaccagttgggaaagagggagaagccattccaacaatttggaatccaaccagttgggaaagagggagaagccattccaacaatttgggagaaaaaaataataaaaaatatatactagaacaatccaaccaatttattgggacaaaaaaaaagaccgtgttctcccaattcttcggatttctcacgctaggagcgaagaaatccaacaagaatcatattagctcgcagcatttgcaagtcgacgactatggatctagcgtctccgagagcaaacagcacacagatctgaagcgccaaaccagcgagcacagcacgaagcactaacccgactaagagcagcatcacaaggcaaactaagtagaacgcgcacagcgcaccgacgtacgcgcgcgcagcaacaaagttggtggcgacgaggaagagcgcgtcgtgtgaggcgtagagcacgagagcgaagcagatccgaggaagcaacagagggagactaggaaagatggtgtggggaggagaggagatgaggaggggtggagatggagctcacctgcactaggttgccgatgaggggtgaagccgacgatggcgagggcggcggcggcgggtgctccgcctccgggcgctggtcgagtcggctggcggctagggctcgcgtgccttgcctaccttgctctttggcgaatgggtggtgtatttatccatgttctgtgttgggctaaacgggccctggcccatgccaagttgtgcttaattaactgggcctccggcctcccatcgtagcttaaaggaaaacgtacaccgaaggtccctcaacttgaaatcgggatacaagaacgtcctcgaaccgtaaaaccagataccgaaggtcccttaactatacaaaaccggtcaaaataggtctcttgg

SEQ ID NO: 51631 - DNA, 2467 bp, Oryza sativa
actgggtgtccggcacacccgccgcttcgccccggtgacgccggtcccgcctcgccccgccggcctcctcacatacactcgccttcctgccaccgtcgcagtgcccgggtctacgccagccatggcgaattgggcagagacggcgcggccgtcgacgacgacgacgtcgtcgcggcccacctcacggagcacgtggcgggcggtggcgcgggaccgcgccccactggcctcctccccctaacgtcggctagtctacgccaccctcgccagtggcctccgctccttcccccgccgccctgagaagagagagtgagagagatgagaagaggggaaaatagagagtaggctgatgtggcacgatgacatgtggggcccacgtgggtcccacgctgactcagcagccacgtaggacaaaaccgagatcaaaaccactgagggacctattgtgaccggtttgtatatttaagggatccgtggtatctggttttgcggttcgaggatgttttttatcccgatgttaagttgagggaccttcggtgtactttttcctagcttaaatcattgtgatttcgattttgctatatctcactcaaaagatttttttcttatctctcactcgattttctcactcaaatttacagtgcattttcttgtaagttgcagtgtaatttatgaaacttacattgtaactttgttactgtgtaatttttgaatcttcacatgtaagtttcgaaatttgtattggatttggactttttcttgaagataggataatttagtgtccattatggtgtttcttagttgctttttaccttttactgtgtctatcagattttaatccaaatattaaaaatctgtgtgatacgatcataaaaatctttcgaaagatgcataggtactccctaatgatttttagagtattttgaaactaaattgcacgtgtggttacttaaaaaaattgtaactttcagtttgtcacatcaattttttgtccgtaacatcaattttttgtccataagtcagatcgaaatccaatcagacaatccaaagaaagagaaaaagaactagaaaaaataataaaaaccgcacaatcttatctcaatcttcgtcaccgccggatccacccacgggaagccaccgtcgccgccagatctgcccgtgggaaaatggggagggtgcccccatcgcctcctgatccgcttgtgggaagccgcgggaggacgctaacgccgccgtcgtagccggatctgctcggtggggaagggcgctaccgttgccgcccgctggaatcatcacagccgtcgccgttgcttttcgagagagagagcaagggtatgggggaaatgattttaaggttagggtttaagctgttggatattcatttaggtcaggatcaatcgggaccgtccatcagatcggacgaccctggcttctgccgtgttgggtcgggcgtcattcctaggccaagtcgccattgggccgcctcatggaccgcacatacgtagcacagaagagggacatatatttgggcaaggctaaaatcattttttctctctcagtgattttaagtatttttgtattttcagaaatagcattagtattattttaatcgtttatgactgcttattaatttaattctagctaaattgaaccaataagaaatttggctatacgtttttcatgatatcgatttatttacattacttctaattgtatttctatacaaactctaaactctcatttcaatattatttttttatttgaatttgaagtctttttctaaattggttcctatatgcactctaacctctttgggagaatattctagaatcctcatcaaatataatttattttataatttttgttattttataaattttatttctatatgaactactcatatttcaatatttcttttcttaattccaaatttcatttctttttctaaattttattcaacaaaaattaaaaaatagcaatactttgtattaatttgtatagagagattaatctatccagcttaggttttttttccttgcaaaagatttgttttatgcagctgtccgattggacactacacatatataacgtatttgttttttttagaaaaaaagaaaatgaaagagtccttgtctacaatgaattctccttatttttttattttactccaattaatatgataataatttctaaaccataagaatgctcatttttctattactttactaagttaatagatagattattatcataacatatattattatcataacattagttttcccattgcaatgcactactccgtagacaatgttttcaggttttgactataaaagtctttaagttggaccggtggctcacattgagagctaatctcttcctatggtgtcctgattattgccatgacgtgacttgtcctctaacatatggcctttgcatttttgtggagtgctgttgatcaagctta

SEQ ID NO: 51632 - DNA, 2124 bp, Oryza sativa
accctataacggtacctgtctgttctaaaaatttatatctttcttatcttcgatatgtaaatcgttgagctttgttctatcaataccccttaccaacctcaattatccattcactaatactacttttcggtatatgtgattcttttgttacctcgttttgtatatctaagattaaaaataaagttattttgggacgaagaaagtaaaacttttacttattgtgattgttattgtgattgccaggacttgcgttacttttaatatagaaaatcatgaccaatgtgttcattatagatggtgtgataatatgtgcttcatgattgacaacttgaagcactattagagcgagtacgatagagagggattagctagcaacaaggtaagacacgtaggttcgaaagctagactggagcatagaggcgaggagagagatggcgagccggcgactaaattgtcactcgctgcacgcgtgctccaagagcgttgaagctttcctgtcgccggcccgcagccgatgccagcagcaccccaggcggtttgtgggcccgttcaactgtcgatgcggcgcgacccctagagaagtggcggcgtgaccatctcaaaacgggaacatcgagccagaatcagaacgtcgagtttaataagtatagccaattactcgctcaaatcatctgtagtcgatctggtagctaattcatacaatagataactacaaatataaatatatgctatatcattaataattggtcccacctgtcatacacacacaacgttttggagtccgtgtgatacagccgttacatatctgtagtctgtttctcttctctttcctttcttatctcctttatataagcttatagctgacttatagtctattattgtacctgctctaaagataaaaataaaccaggaggaaataggaaccgatgctctttagcttggacagtggcgatggtgcgtcggccgcgcaacgacgcaaggtcgcctcgtctcctcacaacggtgcagcgcttcgccacagctacggcccagaacaagcttcgccgtaagggtggccgctgtccacaactttcgcagccactacaagcaaatcaatggtcgattggagatttggagtactagtgtgttcactgttcaagcgatctcctgagagaaacggattgatggtttcgtctttagaaaaataggaaaactgcatagccatgtaaggttgaaagttgtaaataattgttgtatgaataggctattttgtgctggctgtaatagctgacgtatgcaattttagcgccagtagcaagctatattattgaccttactctcagttatatcttcaatattttaattcatcatctgttaatataacataatgacatcgatgatctcctcgataagactacatacttgctgacttcacaatcgaacaccatacccaatggtgtacctatggtttttaccctggttgtgcccatgcaaatctaaagaggaaaactaaattcttcatgtagggatatatgatgtttttatctataaatggagtacaaaacaacaccaattacgactaatttctactccctttagtactcttgtttgataatgttcctttttatttttctaaaaccagttttgttctggaatgtatcttcttttttaagataatggaagctttattaatctcagtaaattttatcaagtgatacaattattccgagagcatctctggcttctgaaacgtatctagcaccatacagaatgtgaatcccataattgtttggtgccatgcatttttattttattttattttattttttggtgccatgcatgttaaagacaaaaataagatccatgttcatcctaatactaatagttgattgattcaatttaatatcattcagagaaaagagatcgcatatttgaaggaagtagaattgtaaagaggtgaaaactagtcttttagcaaactccaaaatctctcgttgctagtcctggctggtcgttgctgctgccaatgactcaatggccggcatgcctccgttctggctaggggcaggcaggctgcaggggctcagcttctctgggctagtgggcaatgacagacttgccggccgccgtcgcacttgctgcttt

SEQ ID NO: 51633 - DNA, 1643 bp, Oryza sativa
tttgggacggagggagtagtattttgctagttttcataattgaatagttattattattattctaaaataaaaatgtataaatattggtatttaatttattttttggacttgtttaggctttggaataggtttttgggtgaaaatataggccaaagctagcctatcaggctccgtttggctaataggttatacccattggaaatggatataatatcctggtaggatgtggtggtagtttagagcaagtataataacaaaatttcagtcagctataagcctgtacagctcagcttcgtctgacgtggtggagagaggcaagatgagagagaggggatcgggcgcttatgcaatcgccagccttggcacaggcgcctagaaaacttagccgattatcttcatcagccatttactctcatgcatgcattggatgatggtgggccctcctccatataataaaatgaatgattagtattggagtatgtgttatgcagctggttgatacaaagatctatctatttgattgcttttagatgacgtgtcattggcttatagctaactgatgactctcttattaaacttgctcttatatgaagggaaattttatcccatgtttggttggatggattggaaaaggaagtttctagaagaatgaccaaaatgccccttcaaactatgctaaatgagtaaacaaacagcacagctattatctataagttcaaatggtgagggtaattcagtaatttttcctagcagtcaatccaccctcaatcaagcaggattctatatcccactcccatccacacccaaacggtggaaatatgaaaaatggaaataacatccatttcccacactcctcacccatttgccaaacagagcctcaaatgcaggctgcccataaacaggtctaggcaatggtatttctgtaaacattatatttagctaccgctctttacggcatgagctcatctctatctacatcaatcaatgcacttcctctataaaaatatctcttgaaataaatctagaaaaaaaatcagcatataatcttttacaactaaatttgtcccggcatttactaaacgccatatttacaccaaccaacacacaactcaagtgacacttgtaccactacctaagtgacgctggattccacccttgaatccacatatcaacagatcatattctcccatctaaatccctctttgatttaagtttactaggattctctttccttccacgagcgcaggggtggtgatggcaaacctcaacacaaaacacagcacaactattaagaacgtttacaacttaggtgatccgtagttgacaaggaggtagatgttcttgctaaaacgacatggggtaacttcgtcttgccgtgctgaagcccaggaggcatgaggagtcgaggaattgaaccaacggtgataaatcgttaaaaactagtgaaaggggaagtaaaagagaaattgaacttgtaggggtccttttacgaaagtgagttgtagggggaagggcagaaagactagtgaacttataacggtattttcccctatattgagccctgatccctagataaagacagggtttgtaactcttgcttgccattctgatcttcatggagtccatatatatcattggaattt

SEQ ID NO: 51634 - DNA, 1876 bp, Oryza sativa
gtcaatggtattctcgtaaacattatatttagttaccacccattacgtcatgagctcatccatatcacatcaatcagtgcacttccttctgtaaaaatatatcttgaaataaatattgaaaaaaatgaatatataatccttttgtgttaagatatgtctcagcatttactagatgccaaatttacaccaactagcacacaactcaagtgacacttataccaccacataagcgatgtttgtttccaccattaaatccacatatttatggaccatattctcgcatctaaatacgtcttgatttaagtttagcaagatatttaatgcacgtccctccacgcctgtggctcccggtgcccgactttggtgttaaatcagccgttcgatttgtagttggttccgatcctgtttgaaatatttcctaaaacccatagcacacatttgtgaaaaactgaaatgattccataccatcatttgagcatagtaaatatctcaaattgtgatctacatatgaaatgaatgtaatccccacttttttttttttgaaaactaatggaatccccacttgaagttctctatcccttccacagatttgggcaatgtgtcatctttgcccatagtctgccaagggtagacatgtcaaagcaggttatgctgggtcatgaaaaagctgagagaaaactacaagcccgagtttggcccagcctataacctaaaatacttatcagtttccatatttgaatggagtagttattattattgttactctaaaataaaaaaaagtatgagtattaatatttaatttacttttttggtttgttcaggctttggaataggtttttaggatgaaaatagaggcccaacctaggccggtcaaggcgggatgcccataaacagatctagtgaattgcattttcataaacattatatttagctaccaccagttatgacatgagtatcacacctatatctacatcaatcaatgcacttcctcctatataaaaaatatctctcgaaataaatctagaaaacaaatataacattataatattttgcaaccagatttgtttggtatttactagacgtcagatttacgtcaacaacaacctagctcaaatgacacttgtaccaccacctaaggtctggtgttggtttctaccattaaatccacatattaatcatcctcacatccaaatttgtaataatataactttagtaggatatcaatacgcgtcctccctccatgccgcggccgcctataaaaccaccccatagcccttcccccctcccccatcggccatccatctaccatcacattcacaaactcacaatttttcacatcaccatgttctttagttccttaggcttgagagcaaaccctacccagggtagcccaagctggatctgaactttgtgttcttcacataatcaatcacacacacatcccgaccgggtccgaatagaagtatagaacacaaagagggggctgacgctgaccggtggggcccaccggcccggcccgaccacaactcctagtgggggtcccccgtggtgcagcgcacgtgcgaggtcgttacccctctccgactccctcccccgtaaaaccaagccgcggacttctcttttttcttttcttttctctatggagatagcttccgcggccgcccaccaaatctcgcccatggtttcctcccgcgaccccggcgaggaggccagcgcgccgccgcccccgcccccgcgccgcggcgagaagcggcgaatgcgcggccgcaccccgtcgccggagccggcctccgcgccgcaggtactgcttacgaggccggatttgcatgtggtgttagtagggtagatcaggggggaacacgccgccttcttcgtc

SEQ ID NO: 51635 - DNA, 4897 bp, Oryza sativa
atagaaatttctctgtcctataagaacatccaatctgtggcactttcctgatgaatgaaatattcaaggtacaagctaattttgtaagactactccttttcaggatctctgcccatcaggagcttgcggggacaatgttgctggagctacaactgtaattccttgaaaagttttgattttattagctgaatgttgtcatttctattcctctacagctttattattattggctaattaatttttcatgctattttatcttacttttatgaacagacaaatggaaagtggcatccacatgaatcgtacagacctgaaattgatgatgcccctgttttcactccaacggaagaggtttgtgtacatttatcttacataactattccatgagatatgctgatagcatagtaatagttagctaatcgttctttcccttcaggagtttaaagatccaattagatatattacgagcattcgtccccaagcagaaaagtatggaatttgtcgtattgttccaccatcttcttggcgaccgccttgttctctgaaggagaagaacttctgggaatgtacagagttcaatacccgtgttcaacaagttgacaagcttcaaaaccgggaacccacaaagaaaaaatcacaacctcgagttcagaagaagaggaagaggagaaagagactgagatttgggatgactcacaggcgtcctagtgcaaatacatcagaagactgcgcagatgcagacgagaagtttggctttcaatctggctcagatttcacactagatgagtttcagaaatatgcagatgagtttaagcagcagtattttggaataaagggaagtgacgaaatccctctttctgaaattaaaaagaagaaaaaaaattggcaaccatcggtcgatgaaatagagggagaatattggcggatagttgtatgccccactgacgaagttgaggtatttagttgctatctgtgcatcatcttcctatttaactattaatacatactgataagcatcggactctctttgactaggtggattatggtgctgatttggacacttcaatgttcagtagtggattctctaaattatcttcagattcaaatagacgagatccatatggtttatcttgttggaattgaacaatcttccacgtattcctgggtctgtactgtcatttgaaactgaggatatatctggcgtcgtagtcccttggctttatgtagggatgtgcttctcatcattctgttgggtaagcttttattttctcattgacccatttttacaatgttatcattctgttggtaatagtataatagccgtttgcctaggtaaaagtaatctaattaacttccttgcttgttgaagaatgaacatattattgctctatgggattggaaaatgctactagcctagtgatattctaacctggcagtgctattcaatcttcttagtggattaacataagatgaatgtttacatagtaggaaaatatgtgatttttaattgattatgataattattcttggctgatatctctctcttgaactttgtagcacgtggaagatcatttcctttattctatgaattacatgcattttggtgaaccaaaagtatggtatggtgttcctggtgctgatgcagtgaagctggaagaagctatgagaaagaacttaccaagattgtttgaagaacagcctgatctcctacatgagctggtaaccatttgaaattgcatgtttgttatgtaatagaattgaccctgtgattctaacaacatgaattcactgattgcaaaataaactttttggatatattgcgaactggaaacaacttagcatccatgtactgaaattcaaaggaaaacattattttctgttccattttagtactctatttattatcattgcctagtgcctactaccagtcacaaattcttgctgacactacacagtggttcatctgagaataattatcttcctgtattgtacaaataaatatgctgcatcttcattcattttcatcctaaattttcatggtgcaggttacgcaattatctccttctgttcttaaatcagaaggagttcctgtttatcgtgttgttcagaatccaggcgagtttgttctaacgctaccgcgagcttaccattctgggttcaactgtggcttcaactgtgcggaggcagtaaatgtcgcacctgtggattggctgcctcacggacaatgtgctgttgagctctacagggagcagcggcgcaagacatccatatcacatgacaaattattactaaaaactgcaaatgaagctgtcagacagctttggatgaaccttagcgactgcaaaagtgaacaaggagtatacagatggcaggatacttgcggaaaggacggaatgctgacaagtgcattaaggtactcactagtttaggccgttgttatttatcactgattattaatcagctgtgactcaaaggattaactctttctttttcatcaaaaagactaattactcatattttggttgtactatattgcagacaagggttaaaatggagaaggcagcacggggagggaatatggcactgcgatataagaaaatggatggggattatgattcagctgaccgggaatgcttttcatgtttttatgatctccatttgtcagctgtcagctgccaatgctccccaaatcgttttgcttgcttaaaccatgcaaacattctatgttcatgtgaaatggacagaaaaaccgcgttgttgcggtataccatagaggagctccatactcttgttgcagctctagagggtgatccaactgcggtctaccagtggggacagaatgatttaggtttagtctgcccatctggttctactcagtacaagaagatggacttgggtgaaaacacggaatttccggattcagcaaccaacgtcaatcatggctgcagcttaggaagtcaagatcaatatcactatgaccccgcaaagccagcaggataccagcaagagaagggaatccagattgcttcagaaaaacatgataagaacaagatggttgtcaatcttgagtctccagcaacagctagtaatccaagcaggtcaaagtctgactgcagtggctcactgtccttgaatcattcatctgagttaccatcttcaagaattcaaacaggaaattctacgctagcttccattaccacagagaaactgtttggtgttgacattaaatccaatttagcacagtcttctgatggccaagttagtcaattggccaagccttcctcgagccaaactgatgaagtctctaagccagcaatagctaagtatacggttgagctgctagacagtggaacaatgatgattggtaaaaagtggtgcaatcagcaagctatattccccaaaggtatatacactgaacaatgcaatgattatttttgtcttctggtaatatgtacatcctccagaaatatcactaatagaaattcatctatgcaggatttaagagtcgagttacatttcatagtgtactagatccaacaaggacatgctgctacatctccgaagttcttgatgctgggcttcttggaccattgtttagggtacgcttttattataaacgcttcttgtttttctaaatttcaggatttgtctgctttccttcattgtgctcacataagctactgaattaataacaggtgactgtcgaaggtcttccagaagtttcgtttactcacacatcaccaatgcaatgttgggacagtgtaagagacagagtaaatgaagaaatagcaaaacaaataagttttggaaaatctggccttcctgattttctatcctgcaattctttgaatggacttgaaatgtttgggttcttatcctcccctataattaaggtagatttttacgatatccacagtatttatttttgtgaaacctggtcacttcaagtaactagttgaatattacacaaaaattctttgttgttcaacaggaaatcgaggctctagatccctgtcaccaatgcttggactattggttgtcaagggtttcttctgttggaactgaactcccctcggaatctgtgatggcagcaatggttaatgactccactaaccccccaataaagttgctcgggattgagattaaccggagggaatcagaacaatcaagtagcttcaataattcctgtgtgaggaggtcacacttggcaggttgctgaagaaggctagctaagctcccagaagaaccagagctaatggcgatgaaaagaagtattcagtagcagtctagtggatcagatagcagtggtatcatctggagtggcaattgccactctccaggatgagatgaacaataatgtagatacatagtgccatgaatagatcagaaatttcagataactcatcctagacagcttccctagggaaccattagaattgaaatagagccaccattggtttgcattcttctagaattgcatttcttgatattcatttcagcttgatcccaattcatttctaacttgatggcaacaagttattgtattctctaattgtttctggattagccagtttattgtgaccaatgtaacaagttgatgtttcctgtcgacataaagcttacatgtacaaaccttggcagctaccaattggaaatgaaaggaagaaaatgttttcggacttatggctatttcttctacttcaatttaaatgaattgtcttttcttaccatataaatgcgatgaatctgtcctcattcagggctaatgttgcaaggggttactttaattgattgttttgtccttaatagtgatgccaattaaatcatactcccaccgatttttaaatatgcgctgtttttggcttttagatataacacttaactaatttttatctaa

SEQ ID NO: 51636 - DNA, 7278 bp, Oryza sativa
cagcatccgctccaccatggtccatgggcattcccaacctcctaggtttagacattgcctatagcagaatgcatatgtgctgttcaatagtccattgaaatatatgattcagccaataactaattaggaaagcaattttgtcctcaaagcatcatttgaatgaatgcagatgtgtagataaatttattcaggcacctcttgcggcaacctgataactcagttatcagtaacaatacccttcattattgcactccacataattggctttcagttgctcaccttgcttatgttggccatttaccttcattaggtttcaattaatgttatattgcgttcatatctggaaataaagaaaacaatataatgagaaagtaatcttagggcatgttcaaagctagagcccagtgcaggctctctacactccatgtcagcgaaaaaactcctatatacaaaggatggtctctttagctgactctccattaatacaggctaataaatggctaataaattcatcatgtatactagatcaaatgtaaattttagccttccataaattgtgcaaacaacaagctattatttaagcaaacagtaagctatcatataaaaaaagacaatgagcataccagcacacacatactattattttaagcaaacagtaagctaaattacattatttcgttatatagagtagttctacttttttccaagcgctgccatatatgtgcaactaaatctttcttgagttgcatatgagttggacgatcacgaatagatgaattccttcgtagtactgcagcaaagcatgggttggggttggaggagttgctcacttccggtggcagaacgattgatgctcctgggttctcattcaaatccaaaggaatttcagtcatttccttttcatcttcaactatcatattgtgaagaataatacaagcttacattatgttgatagcatcacccctctgtcacatccgggctggacgacatacgatgttaaagtgagactgcaacacaccaaaggctcgctcaacatccttcctctcttcctcttgacgggctgcatataatatatcttcatctgtctgagaaagttgtattgtcttcacgaatgttttccactcaggataaattccatcagcaaggtagtaccccgtgttatattggttcccatttacagtaaactgcacacgaggagcttcccctatcaatgcatcaatgaacaacggtgacttgtttaacacattgatgtcgttattggatcctgtagtaccaaaaaaaagcatgctatatgcgaaggtctttcgatgctaccgcttagaggatcatggtaggaactcccttgtcaccacgagtaaattggccgcgccgagagaccgggcaattttttcatgcccaatgcatgcagtctatacttcctaacatgccaggaaaaccacgcgacttagcaacctgtagcaatctttcaacctcatcattccttggagctcgtaagtactcttcactaaatatttcaatgactcctttagcaaatttgcccaaacactccaaagctatactaggaccaatctttaatacctcgtcaagttggtccaccggagttccatatgctagcatatgaatggcggctgtacacttctgaagtggtgaatgtcctgctctaccagtggcatccactctattagtaaaataaggagaccattcactaagggcctcctcatccgaaacctcctatggaacatctcatcggtgtagataggggactcggagaagtagttggccacaagatcctcattgccatcttcttggtttcttggtatatacggtcttgtaccactttgacgttgacaatgagatggctcagctgttatcttgtccttcatcctgataataatctgctcactatattcatctaaaaacaccaactcagcaagaaaatcatccatgttatatatatccataggatcaaagttgtcgaggttgatggcggcatcgtcgtcaaggtcgatggcagcatcatcgatgttgagttcggcgccgacgacgtcaaggtcgatgccggtatcgtcatcgagatcggtgtcatggtcgaggtcgacggcaccatcgttgtcgaggttggcgtcagagtcaatgttgatggcaccatcgtcgccgaggttggagctagcaccagtgtcgagatcagaatcgtcggcgagaccatcttctaactggttgatttcatcggaagacaccatgtgatctgacatacattcatagatacatatatctcagattgagattctgaagataaacatgcccatcaatcatatcttggaatcaatccccgcataaaaaaaaaagaacaggtagtatagtttcagtaaccttcaataaacagtcatccagaaacaaccattcagcatgcacttagtaataatatggaaatgagttgaaagtgtaaacttgcatatatggttattacatgaacgaaagaataatcttattcaccacacaccgccaagagcgtcgtcgttcacaaagcgtttcgatggcctctttctacgtttctcttccaatgccaacttacacggtaacaaagtcataaataaaaataaataaaatttataaaactacatgtactttgatgaaaactatcgcaaaagaatgcgcatcacaaaattatagattttgtgttaaatttatccgatttaaggtatcatataaaaatatagatgtagcataattttatcacaaaaccacaattgttataacttataataaataatagtgctagggatctaaactctacaatttgtagtacaaattttgtaatttagtgaaatttgtagttctttgataacttcactaaatctatagttttgtgataaatatatagttttgtgatgcaatgactaaatctgtagctttgtgattcatgtagtagttctgtgatagtttgatccacgtatatatagttttgtaaaatttactttttttaaaaaagatattttggtcaattgtgataaagtgttaagtggctcataaaacgacttgcaagtaaagtggtgctagttagatagccgttcagctccacgaagaagtgcaattttctcacaaatataaaacaagactgccatataaatggtaggagtaaattcagttaattttagaatctgccattgtaggacacaatactgcactactagcaaatagagataatagggagaccatctcttgcaacaatattctaagttatctcttattcagataaaaaacaaaatggataaaaaaggatgccagcactaatattagtcagagcacaacatcgattgtagtggggcattagatgcgtgacattttgatctgtgagggatcatttggagttgcactttcccattgctgcctttatttgcattgccattggcatcaccgacatgtggcactacctccacacctgtaaacacggcaattggttcattcccaaagtcactgttactgcggaagaacctagcgatgcagaacctgcctgagccaaggttgacaagttgtggatccttgcactccctccattcctctggcaggttgagttccttccaagggcccactagctgtggctgggagtccatggcagagaggtcagccgcagccaagcgccgggcctcagcagagaggccaaaccagaggttgaactcaggcacataatcaatcctgccatggaatggcagtgtccactttgccaacttggctccatgagtggcttgctgtctccaggcagtaggtgccgatgccattgacagataagcaaatgtgtgagccaccgccaagcacagcgtaggagctgatctctgggtctgggctgctgcagcagctgtgacagtgcttgggttcacagacaaaaggcggaggtggaagttaatggcagtgccaggcctttctgtaggaagataatgtagacttgcggtatacgaaggcctcaaactgatcgctgttgaagcccaactccggtttgggaatcctctccatgacaaagaggctgctgccatagccatcatgggaacgaactacgaagacagacaagggcatcgacttgggcttgtgaagactgggcatggttcctacctcgcacgtatctgcgttgacgaggaatgcgcggccagactgatccgtgcaaatcacctcgcggctagcaagcgggaaacagtccatcttcgattggttgttgacgttgagagctgaagctcggaagttgatgctggagaagggaagccccatactatccatcatcgtgccagctgcctgtttaaacttttgccagaattcgccaaccttctgtgtcggtggaggtgttgccggatagaataactgctggtgcatcatgtcgaagtaccatagcgatttgacatcagggttgcggttgcccacgatcagattaagaaaccgccgcgagaaatcaatcgtatcccttaaccagtggcttaacctgattcgtatccctcaccacgatactgcatatcttgaccccccccctcatttattaaaaccggtgcaatatgactccctcagcggttttggagggtggcttcgctgacatgtcatctacgcggcggtgttgacctagtctttatgccacacggtattgacgtgacgtttatatgacattagaattaaaaaaaatatgtgagactcatttgtcatttacaaaaaatgatttgtgggacccacatgtcatgatctctctttttccctctcacccctttctcttcacatgagcactgctctaaggcatgttatttatcttctctaccgaatgtcaaactacacatgcaatgcatgattatttcagctctctttgttggggggaaatagcaccaaaagtccaaaacagagatcaaatatggggaggcgaaatatcccgcaaaaaattgaccacgagacaagactaatttacctctagaacgcacgaaattgggggagaaaaactggaaacaaccgaacacgcacagcacaaaacaaccagacgctgctcgcaacaagacccaaaaaaaatgtggaaacacataggcgaatccatctacttcaccgcaaatcagcatcaaattacaaggggaatagtaaccaatcgaaaggcaaggcagaatgagcactcgcacgcgcgaacacacacatgcacacgaggacgagccaagcaatgcagtgcggcatacgagacagggggaggagaggatgaagagtgaggatgaattctaatctctcgggtggatgcccacccgtttcttgcatgtcaattaaataattatgaaaaaatttcaaaaaaattacaagatagattaatatgtaatatatcacttcacaaacatgcaagttcaaattcaaattttacaagttgtaacgaaaataacaaattaaacttttagtatacgtatatttacagtcaaatttgttatttttgttacaacttgtagaagttaaatttgaacttgcatgtttgtgaagtaatatattcatattatcctatcatgtcaattttttttaaaactttccataaccatttagatgacatgcaagaaacaggtggacattcacccgaatgcttaaaacagtttcccgatgaagagttcctcggaagcttcattcgccactccagcatttgcccgcccgccggccaccgtgcccatcgcccaccgccgccgtcgccgccactcaagccctcgcctgccgccatcggatgaaggtgaagagaaagagagaaataagggagagagaggggcatgacatgtgggcctcacaaaatattttgcataaatgccaaatgggtcacatataattttttaatctaatgtcacataagcgtcatgtcaacgccacgtggcataaagacctggtcaacattgtcacgtagacgccacgtcagcgaaaccgccctttcaaaccgctgaggaagtcaaattgcaccggttttaatagttagagggtcaaaatatctgatattgtggttgagggatatggatcagattaggacgctacttaacggagccaaagtgaacttattcccatcccgtgaaacctcctcaacccggccgttcccctagaatttgatcggcaattaagggtgtgtttggttggctgcaccgggggtggctcgcatcccgcatgcaaccagcaacgcgtttggttgcctgcatgggtgagcgagccaagatcatctgatgcaaaaacggccgctgagccaggctgcgaggaaacgcggaaatcggccgtaggtcctcagccaggccagctcacgccgacgcggggatgagcggatgcaagtgtgggatggacgagaaaatgaacatttagccacgttcgaaacacagttttcctagaatgccatctcgaaaacgcgtttcactaaaattccaatataaagcgcgtgctcatcaccactttgccattttggcccttttgtgcattttcaaaatcatcttcgcttcttcagtggataatgagacgaaattgccctccatccttccccttccatggtggcagccttggcagcgccatcggatgagcccaccaccgctgccgacgacggcgggatggccaacagcgccgtcggatgagtccacgcccgctgccaacgagggtatctgggtgcgtggagcgacaaaaccaccggcagctgcccctgcctgccgcatccggacggcaccgacgaggcggaagcagaggtgaggtcgtcgaggaggcccccccttcgcctccgtcgccgacgaggccatggggccacctcgaaaccctagccgccatcgtcgaccacggcgaagcgacctccgggatgtcgtcgtcgaccgcggcgaggtagtcggcggaggtggcaaggtcgagggaagagaatatgtcggaggactcgccggccacctcgttgtctgggctccccatatagcactgcttcagatgccatccatggaggaggaggaggaagacggtgagctgctcatggtggacatggagatggccgacgaggacgagctcctctccctcaatgatggcggcaaaggacatgaaaggcaattttatctcatcatccggtggaggagcgaaattgatttcgaaaatgtacaaaagggccaaaattttgcaaagtggcggtaagcacgcacttcatattagcattttagcaaaaacacgttttcggaatggcattagagtgaaaccgtgttttggaagtggctaaatgtccattttctcgggatggacaggtgcagcggcgcgcaggggtcgatgcatccagaagggagggcccgaggggca

SEQ ID NO: 51637 - DNA, 7761 bp, Oryza sativa
acaagcttcgacacgctagatccgggagtcttcagcttcgacggcaccggatccgcagccatgaactctgctggcggcggcaaacagcgggactcaaagggagagtggcgagcgtcatgtaggcgagcggcgacggcagttgcgagatggcgatgcatttctctctccttttttttttcatttttttcttttctttttctatccggttgaccggataatcccgacgattaatttataatagtgtaatttaatgtttggcacaattttttgggacttcctagtttggcgaattttttcgtcattgaaatttgtgcatctccaagaagtcagtagcactgcatgtaatatgttgttatcctctccaatacgaagaaactatactcaatattccgaaaacttcatcttggacttagttaaaactcaatttaatacccatggaggtaaactcaccctccaatccagaatgtatttttgatccaaccaaccaaacatctttcgcatacagtatctttaatacaactaaccaaacaatatctaaccatatgcaggtttattcaatacaaacaaccaaacaatgcatatgtatatctttaaccaggccaatcttagtctggataaaggagatgaaccaggctagaagtatacgagcaaccaaacgcacctaaattggggagtgtttcctgcgccgctcatctccctctgaaagtctggatcaaactagctggctacccaaatagcctctcacgatcacaggctcacaacctcacagatatagtgacaaatcgcacgagctggagctatcatagattgaaggaaagtaaaaaaccaaggaaaaattaataaacagataagggaaagaaataaaaatactactccttccgtattaataaatagatggtgttattgatttttctttatctaacatttcatactcgtcttaggaaaaatataagtaatgattaaaatatctttaatgataataaattatatttatatgtttttcttaaaaaaaatatccaaacatcatatctaaaagtcaacaacgtcatatattaaaaaaactagtgaacgtgcacgtgcaaagcacattgatatatacaattgaagaaaaatgcattcattgctaatgtacatctacatatactcacaaattaaagctcataatcattgataaaaataaaagtattgtaaacattgtcttggtaattcattgaataaaactaatttgttattgtattatatagcgtaacagatgtttttcagtgagaatcttattttcattactttatgccttggactacatgcaatagataatggttaagcctgtaagagttaaactattatgagaacaaacgacgatagataactcaagaaaaagtgagatagcagccatgtattatcaaaagctagtaaatgtacaaatgcagcttaaaatagatcagtgaatcagcaatggatgtttcccaattttcctctttcacggtctgctgagcattaaatagtttgatttggatatataaacatgtacatgagattttaatgagataattttccacacatttagcagggtaaactcaggccaaaataatgattgaaacaaaacttctctaaattattttctttgggcaaaaaacaaaattcggtttcaacatctcataaagctcacagaaaactgaactgcaaaatcagtactgcaaagtttaggcgcatatattgtgctgcatttgaagttactttattatgtatagatagacattattctttcatttgtaacaacatgattgggcatcattaaaatccccgtccaggaccggccggggtacacaaacgacaatgttgacattcagatccacgtcttacaaacatcataaaagtcttacataaatgcagcggaaaaacgaaagataacaggaactaagccttgacttgatctgcagcgggaacaccactccacagacatcctcgacggcacggacgaagcctactcctcggagaaaccaccatctgacacatacttgtactctggggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgtaataattaatcatattattcatccactgtccaacgctataccacgttgcgacaggcccaaccatccacctatagtatccaatttcattagactaaactagggtgagactaatcacggtgaatctggttgaccgcccataaccgcaggcacgactattcgaatagttttactctgatcagaggtgtacaactgtacccacaagacacagccccacgacacgtttccgtgcgccgacatgccaccacgacataccggaaagagaccgtaacaggacccttcgcataaccccctctaaccaagcacaccacacctcaggtttcactcccactcctcacaaggcagcgggcagtcccctctcgtgcctaggtgaatccggaagctgcataggccgtagcagggcccatccaaactccatcacgcccacccttgcctggatgcgtcggctaaagaaaagctacactacaagtccagccgttgcccacgctggcttgtggtaagtacgataagttcttccagggcatcccgcgaaccggtccttaactgccatgggtgcgaccaacaaaaccagcacccacagcccaccatgtgatttattttaattaaccaacactgaagcggtgtcactaatccaacattaccattagaacctacagtctaaacattaataggatttttccccaatgtgtgctagttgaactaagcatggctaagcaattcctagtccaaagtctattcatgttataacgcaagctaacaaaggagcatggtatcaaaatagcatggctgtaacaataggtaaacatcccatagtaacattataaaacaatgcagtatttgaagaaaaacaatagaccatttgcaatataggatcaacatgttcaagtgacaggcataacttgccttgctctgcagttggaggaacctcggcgactatctcgaagtacaccggagcatcagaagaaccggaatctaagcgacatacaaagcaaacaatgcaaacaggctataagactactgaaacagagaacaaaaccatttttaatggattctacacatttttcttgatttactgagacttgaatgggcttaaacggagcacggatgaattagttatgaattttagaagattcactgtgtttattactataataaaaagtccttaaatcatttattgcgcaatatgtcccagggctgacgtcatcaaagggggggtggtgccgacaggcggggcccgcatgtcagcggctcaaggggagagaggggcgccggcaagtggggcccccgggtcagcggctcaaggctgccggtccaccggaccgacggcccagatcgcccccgaggccgatcggacgggcggcggcgacggcgtggtgcggcggcgagcctagcggcggctagcggcagccggagtagcggaagcggcggcggcgggtggaagcacggcgcgggagcgatgggaagcacgagggagttcggcgagatggggaaaaagagagagggagtggcggtggagcttaaataggggaggggaatcccggacatggccggtaggggcgggattccgccggccaacgcggggaggtggaggtggagagagaggtgggattcggaattcgaatcctggccatctcgggcgcgggcgcgagcgggagagagggggagtgggtgcgggaggcgcggcgcatgcgcgggcgtggccgacatgacccggaggaggcggggacgttggcacagcggcggtttcggcggtggtggcgacgtggggcgggcagccggaggaaggggacgaccccgacaggtggggcccacctgtcggcgtcccggggagagagggaggggcggcttgggccggcccacaaggaggagggcgcgcgcggcggcggggtggactgggccgacggcccaagaagaggaaaaggagggaaaagaaaaagaaaaggaggaaaagattttccctgggatttaaaattgcatgtgctcaattttaattggttaaaattatttcgagagctctgaaaattccactaaaaatcttgttagcgtatttcgacatgtagaactcaagaaaaattccacatgccaattccgattattatttgcattaatttattaaggttttctcttgatttgcaccggcattttcttaggatgatttataaattcaattttaggcttaggaggagaactttagggtgtgacattgatgctcataggatgctgaggtgactaccacacaagatgaagaccatgtgtgtagttgttcttgatcacttaaagtcgtggtacgtggactgctacgtcactggtcgaagaccagttgtagttgtaccttgtcacgcccaaaaatttagcccaaatttccagactattttgtgcattaaatctctgtccaagaatcacccagggtaaacaaaacgacaagtaatatacggtttcaaacgtaaataaagcgtaaaatacttacagaagaggcacttagtcctcacacccgaaacgaaagcagcagcagcggaaaaaggcaatcctagcagggcttcagctccactccacaggcaaaactcaactggggtctgagccttggtcctctaactccgtctttagctcagaagcactacacttctgaaaagggggaataatagcaaggctgagtacaaccaccgtactcagcaagccacaccaatgatgcaggcgtgcaaggggatacaaggatggcttgaggctatttgcataaaggcaattgtaaaacatttattgagcaaaacagtaaaatagttgattaattaaggtaatattaaatctccactgatcaacgctacaccacgttgaataggcccaaccaacccacctgaactacagtgcattgagtcgatttaataagtgtgtgactaatcacgatgaatctggtcgatcgcccataaccgcgggcatggctattcgaatagttttactctggccagaggtgcacaactgtacccaaaagacacaatccaccggcatgtcaccgcgcctgtccggacacgtcaccatgtcgagtgattgtgacaagacccttcatataaccctctctgaccaagcacaccacacctcaggtttcacccccactcctcaacaggcagcgggcagtcccctctcgtgcctaggcaaatcaaaaaggcgcatagactgtcgcagggcccatccgaactccatcacgctcacccttgcctggatgcgtcagagaggaaagctatacttcaagtcagacagttacccattcccgcttgtggtaagcgcggtaagtcttccagtgcatcctgtgaaccggtccttaactgccatgggtgggactagcaaaaccatgcacccacaacccaccattaagtcgcattttagttggataattatgaccaataaaacatggtcggatgtctcgagcacgcagctcgtcatgatactaaaagttctacaagatcagccagtcgtccatcccatgatgaggacaagcggccatatattcctgaagtcgttcccacgcctcaggaatggactcatccctcgtctgctggaaacttgagatccttccagaagggcgttggttttgcccatcgggaagaattttgacaggaatgacgtagagcatttatcccaggtgttgatcgtggcacggttggcataaaaccattgtttcgctttcccaaggagggaaaacggaaacaattgcagcctgacggcgtcaggactgacacccttcattgtgaacgtgttgcagatctccaggaactgttgcagatgagcattggcatcctcattaggcttgccgcaaaacgggctagcctgcgccattgtgataaggctggacttcagatcgaaatccacgtctcccatgttgatttgcggcccagtggccacgttgttagcagagggagcagcaaattcgcggagggtcttgtcagccatagtcttgaaagttggtagcgctggtatggctggtttctatgtcggaagagtttactgcagagcgacgactcgtggcttacgctccgaaagaaagcctctggattttccttagagttttccggcaagttgaaaccagtcatgtactaccctgtttccacaataaaagtgaaaacaaccatggttagcctgcaaagtacaatgattatatagaggtaaatataaagtattagtaatggtaatctcttttataaatcttccctggcaatggtgccagaaatgcttgttggtatttcttaacgacattactagaaatttaattcccagtaatggcgcaaaaatacttctggtatattatggttacagagttcatccgcaagcgcatgaatataccattgtagcatttcacctgagagtattccaaaggtatcgtatttgtttaatcccgtgggaagattataatagagagaacagtactaataatttatatattactgtacgaataatttataaccaaagtctaagcaggggttaatataattcatagggtacaataacactaagtagaagcattcatcctcttactcgtgattatctaagctaagtggaaagaatatagaaagatcctattcctatacttctaatttacatacatattatatatacatcctagttatagtattacttagctaataccctccatccgatgccctgctggtgcttcgagaagccacccctgattgtcgagttccttacgacaatccgtcatgactatacaaccgggactaaatacggtggagtaccctccccaggaaagtatcttaggactatatacattcgtggaggaatacccatactgagctgtcaccatcagcggcccacctcgcttccacagcatataaccccaaataatgatatctagtaatctaaacactacgcttaaattaccaaatactatctaatatcatcgtcatgacatagagttatcataaatacgattattatacccacaccattgcatctcccagataagctagcatcataataaatataactcgaacatatagtaaagttggtattcatatactcggaaagtaatacaataccaaagtagtataaagaagagtattctaaataaagtacaagtcataaaaaaaagaaaaaaggaaaagctactagagccatacacgaattcttccgaagactctgaggactgaagattttattctatttctattccattatactctagaaactatgctaaacttgagagatgaaatgaacttcttgcttgaggtgtgtcttgaaatggaggatgagagggctttatatagcttgagaatgacggttatgacggttggaaaggtcagtaataccctccaaccgccataggggagcaatcctgaccgcccatccaaaccctgcatcgaacggagccacggtgggttcggctgaacccaatgattcggccaaaccatgggctgggccggcctggtccaaattcggcaggtggcctcctctctcgatcccttctgcagacttatgaattttggcccaattggtcgtgttatttctgagttcttggcccattcgttgataagtctgattctcaacatcgtccgattgattggggctgcaggaa

SEQ ID NO: 51638 - DNA, 1783 bp, Oryza sativa
ccgtgttgtcagcccatctatccacaagtctgattctcgacagcatccaattgattgatcatttattttgctgtcgattctcctccatttatatgtgcttctcctggatacatgttagtagcatagtatatagtggaaggagatattttatttggaaattatgcattgtaagcatagttagtctttatatattgggtaatattaacggtcgaaactggtcaataatgaccgtcaacaataacatcgaaaaaaacgtgtaattagctataggacaccacaaagacgtgaattggctctatgacactctaaaaaaacatatgcttgaggacactgaagacattattttattcttttcaaacaaaacagagaaagagacaaaaagaaaagaccatattgccctttggctctctcggcttggctttctcctggcgccgccgccttcctcgatggtgttgtcgatggccggcagctcggcacggcacatccagagccacggtaccagtgcgtgcaggggagacgcaccacgggtgtccgctaccgcgatttcctccgtgcacaccgtcccagccacgcccaccgtcgcgcacaccaccggtggctttgacaccacagcttacctcccgccgcacgaagggggagggtcctcgacggggaaggactgctcgttgcagctgccctgtgcccgccaggccggagcagctccctcgcagtcggtgtggcccgtaaattatccgcaagagttagtatagaacaagaatatggggaaaaaatctcaatgcatgatagtgtacaacataacattatctcaatgcgagggttcgcatcaattacacaaattttatttcaaaatttccaatcacaaatctgtacactttgaatttgcaatgtgctgaaattctaaacaattgaacaatatgtaccactgtgtgatgccaagaccttccccttcctctccctctttttattcctttttagtttggcaaattttgctacagaacactactaatgtgtggttttagccctaggacactgcacaaactcacttttgggggaaaacactccataaacatgataatttgtcagtggaaaccacgccgattgaaataataattttcggttgaagaggagagagaaatcatgtgaaatgtcaaaaatgcccttgggcccacatgttagctctcttatctctcttctctctctatcacctccttccagcagctggcgagagcggccgtcgcctcttccccctctcccgccggtgcagccgtatcctcccccctctcccgccggcctcatctccccctatccggccggcctcctccccccttctcctgccgccgctccgctctactccgccagccacgacctgcccgctccgctccgccccgccccgcccgccgccgctccgctggtcatcgtgcgatcgcccgccgccaccagcgctccaccccgcctgccacgcgctcgctcgacgttgccgccactccgctcgcccgacgctgccgctccgccggccgcacgctcgtccaccgccgccgccgccccgctccactccgccagccaccgtgtgctcgcccgcctgcttcggcctctagctccgctccgccgcagccgacgctgtgctccactccgccgaccgcgtcctcgccatctcctccgccgcaacaagctcgagccccagcgaccgacgccgccccgttcccctctgggagagaagatagagagagatgagaagagagataggagatagagctgacatgtgggcccaaggacatttttgaca

SEQ ID NO: 51639 - DNA, 2536 bp, Oryza sativa
taaccgtgcgagtatttgttcactttaatatttgatactttttatcaacatattgtcagaaatttttatatatttatgttttaaccttgtcattttttttaggcttatgaacctacaacacgcatgcattaatattatattttttactgcactttatatatgatgcagggatatatattgcttcgattaaacatatgggtgcagtgaattcatgttacttttgattattttaatttttactctgcctgtattatcaaacatatgggtgccgccggagtcgctgccgccagatcgagcaccggccgagcaccaccgccacccattggatctgggagaggggagggggttagaggaagccgctggaaccttcgaggcccggccgtcgtcgtcgtgtggcagccgctgctggatccaccgcgaccgccactcttcgccgccgcccgcacccctccccgccatgggacccaccacgccgctccccgccgccagatccacctctccaccacaaccgcccctctccttcaccgcccaccgcctcctgcgactccccgggccgccagatccgccgcccatggcccgagtcgccgcagctcacgttgtcgccgcaccacgagcttcgtcgctgcacctcgttgccggatcagcttccgtgccgccgtcgccgttaccactgcaggcaccctttcaccgcctctgagaagactagagaggagaggagagggagacggccgtgtatgggaggagaggagagggaggcgactgggagaggagaccgccactcttcgccgccgcccgcacccctccccaccacggctccaccgaccacgccgctccccgccgccagatccacctctccaccacgaccgcccctctccttcaccacccaccgccgcctgcgactccccgggccgccagatccaccgcccgtggcctgagtcgccgcagctcgcgttgtcggcgcaccacgagcttcgtcgctgctccccatcgttggatccgcctccgcaccacgagcttcgcctatgctcctccccatcgccggatccacctccacgcgccgtcgttgttaccactgcaggctcccttcacctctgagaataccggagaggagagggagacggccgtgtatgggagaagaggagagggaggcgactgggagaggagagggatgcggtgggtggtgggttgtgggctgtgggggtttttaataacgcggttgatttttttttgcaagcgctgctctctatgagtatgtactttttgctgtcggaggtccttagtaaccgccagcgaaaatcacttaagaggtccgcttataaaaagtcccctatttttacaagcggtactcttaacccagccgccagcgaagatccattttcgctgacggtccttaacgcctcatccctcgttaaaatttcgctaacggtttccacttatggccgctagagaaaacaaaaagtcaacgccatgaaaaatcgattttgtagtagtgtatgcaaatttcatgtttgtatccgtgatttgtatccattcgtaggggaccgaacctgagagcgagaatctcgtctaggcttgtatccactaacgagaccaaatcagagggtatggtaggataacatgaaaaaaaacgtgcatagaagccactcctagacccatactcatctggccgaaccatagaaaaaagtgtgaaattatgttaaaagccatcaaataaaacgaactttcttgtctcatatgcattggttgagacgaaggacataacaaaagacgaaaaattcctttggcttgtactcatggtggtcaagcctaagaatatggcaagaagatgacttcctggttcgtactcattagccgaaccgaacaacatagcaaaagaatacatcaacgtgagcagaagaacgagaaccgagagattctttgactcgcacacaatgaacgagcctaataacgaaggaggagcatgattcccaccttaaacacctctgatcttccagcacagtggagcgaggaagcagaggctgacgagatggcataggagcaaagcggaacggcagcagtattgcctagcaacaagcagcgcttctgcaaagcctacgaacagcacctagcctctacgctaatctcccctggaacttcctttgccgctagggggttaaccagcttttcgtggtttagaacagagtcccgcgcgcatccgtgggcagatcgtgggaaatggactcaacagcatacacctttctttggcttacatgtgggtcccttcattttgactggatgaatgtggcaacgtgcgtgcaggtagtggggtgaacatgagcagaccggtcatgcccctggtcgttacatgctttcccatttattgttatcattctaatctttattactccagttagccttttaattgcctggttattgagtgagagagagcgcgtgtatcctctcactgacatctggccctctcttatttggcgcgtgcgtgtttatatatccgcatcattatagcggtctgcacgtgacatgcatttttatttcacgt

SEQ ID NO: 51640 - DNA, 2803 bp, Oryza sativa
tttccaagatgctaatttatttttatatggcacgcgcatacgcatttctatttgcgccggaaatcatttcactctgaccgagcggattttatttttatattgcggccatatatttttggtcgccattttattttatttattcatttgactgttttgactgtttattcctatttttgtttatttatttttttacattatgtttgagattatatattagtttataatttaatacatcttatttaagatacgagccaaaatcagtgtcaacaaatgcccccttgccaaaattttggttttgcatccggagctcgaaacataattttggattcgtagggacatgatgcatgtgaagtttatcctcacaactatcgatgtgcccgttgtttgaaagattgttgagaaaattaaggagcatctctccgattatttggccacgttccctatggctaggggcagtgaggcacttgttcgttgaactcatctactactccagtcttctccctctttctcctcttctgtgcaaggatttgaggagagacttcatcaatgacagcatcaaaggtaagaccttgatttgatcttgcatactgaactggcgatctttttttttgtttcctttttactattattgttggctttcattcctccattaattaattccatttgggtttcttccctatgcacacatgcccgaaacctaccaagtcttaatttcagcgggtgattggtgatttaggtgtggcaagaggaaggtacagagagattttcttcaccctctttcagtcattcattttttttacaggttgatagatacatataactttctttaaccacatttgtatagaatgagttgctcgtataatcggggttcccggaaattttgtgatatgttacgcagccaatccgggttgttaattagatttgcatgtcaaacttgtctaacaataccttttcttcctcattgtatatttaggctgcacctatatacatattccgatatatttttttcatttgtagatgacagatgctggctcttctcgagcaacacataacttgccgctttttagaatggcgcaacttcagccctatgaacctgaaacaagtgacttggggaaccctactattgtggataaagaattgatcggtggtgaattttcgcgtaacactcgtggcaggacttctggtcacgctttcaagggccgctgttttcaccctctcacccctttgccttgagatgataaggcttccaccttagggaataggatagtatctgagggattgggttgggaaaaccataaggtggaatttgttctagctccttcaggatatgcggaatggggtaaagcagtcctgcgtcatcattcccttcatttgcgtggtagcgaagagggggtagattacatttatgggtctatctattgctcccttggtttgtactgtacatcaccattcaccaagtatgctgagatctctgctggaaaaatgggatccacacaccaacagcttcctttttcctcatggcgagaggaccatcacattactcgatatatacaaactctcaggactgccccttgacggtgatctttttgaagagtacgttccacctcacagtgagttagagccatctctcttgatgtacccaaagagcttaatgctacatatggacattaggaagagtcttgaagttggtggagaagtttcgcttcaggattggtgtgatcattttcacaaccgcatggaggggttgccagattcctcgggcattgagtcctcacgcatttacatagccgcctttatagctttgtggctttgttgcttcgttgttgttgggttgggtccagtccttcgtcatgggggtattggtcatggcttcctggatggccctagggtggagaaattcgttggctccgcccgccctatgttctttgtactattctttgatattggctagtacaaatcttatcatcccctcccatgctgcaagtagaccatggcctatacactttttggttggatgggcatttatttgaagaagttgtatggcaacaaaaaacaacacccatatttcccttcctacagacacccttctgctgagaagccactcatggagcataccatgtttaggatcccctaattttatacactgttgacggacgttatagaccaatctcgaccgtcaatataactataataaagagaactagctatgcttacaatgcatatttgttttagaataacatatctccacttgtacttatagtattatttgttacaggaatttagcaaataaaataaagagaaagtgaagaaacctcactcctaagcaagcttatggataaggagggtccacaaatcaggtgtaaccatcctggaaaccgcattaactgccacaaccaccaataggacccacctgtcacccaccctgccgaagctggagacctgctgggctagcccaggttcagccaaaccctggctacgtcggctcaggtcagccctccacgtggacgctccaaattgattcccaatgacggttccgggggaaaatggacaattcgcatagctacaaccatcataactgccctataacaggaggagttcattcactatctcaacacactcaagcaagctcaagatttctcttcatactttagtttagtatttttagtgctaagtggagtagaatagaatagttctcggagtcctcggagtcttcggaagagttccggtatggctctagcagcttttctactttcatctataagactttcgaaattaatgaaatattcttctttatatactttca

SEQ ID NO: 51641 - DNA, 1318 bp, Oryza sativa
agagaggtgcaatggcatgggtttagtgtccgatttatcggttgctctatatcatgtccagaggtgtagagtagtatttattaatgtaagcatggtgcttagattactaattatcactatctgggcatatatgctgcaggacagtagaggtggaccactgatgatgacagctcaatacaggtattcctccacgttagtatatattcctaagactaattcctagggagggtactctcatgtatttagccccggttggacggccatgacaggttgtcgtaaggaactcggtaacccaggatggtctctcgaaacaccaggagggcactgttagggggtattagccacatgattgtatacttctgggtgaaatgctacaatggtatatccgtgcgcttgcggattacttctttgaccatacatatataccaggattattcatgcgccattgctgggaatgaatatttgtagtaatgtcgttaagaaataccaactagcatttctagcgctgtttctagggaagattagtaaagagattactataagctaataatcttttatatataattacctctgcataaatcattgtccgttgcaggctaacctttgtgtcatgaaaacagggtatgaaaacaggatagtgcatgactggtaaacctgccagaaaacttcaacgaaaatccagaagctttcttccagagcgtcagaccgagtgtcgtccctccgcagaagaaactttcagctaagaaaccagtcatcccagcgtcaccatgtttcaggaatatggctgagaagacacttcgtgagttcgctgctccgtccgctgacaatgtgcccgtcgggccacaggttaacctcggagacactgacttcgatctcaagagcagcctgattactatggcgcatgcaagcctattttgtggcaggccaaatgaggacgcaagtgctcacttgcagcagttcctagagatctgcagcacctacaccatgaagggtgtcagcccggacaccattaggctgcgtctgttcactttctcactcctgggaaaagtgaagcagtggttttacacgaatcgggttgcagttaacacatgggacaagtgctccactgcgttcctctcaaaattcttcctgatgggcaagacaaatgccctccgcaggagaatatcaagcttccaggagttttacaacgtctgcaggaatatgtagctgcctgtcctcaccatgggatggacaactggctcattctacagagttttacaacggacttactgtttcgtcccggaatcacttggacgttactgctggggggctgcaggaa

SEQ ID NO: 51642 - DNA, 2032 bp, Oryza sativa
ttcctgcagccccggttttaataatttgggtttcaaagatatccggtattatggttcaaacgacatcaattgaggattggagctatatttgagggacacgaattggacttatttcctttttgttttccgtaagtggaccgagccttagaggctctgtagtaggccaggccgcgctaggagttctggcccaggcagaggagagagggtccagcgctagggttggcccccgctctcttcgccctttgcgccgcttctcctcttctcttctcttctcttctcttgggaacctccacttgtgctcgcctcctcgtcctcctcctcctcctccccctcccggtaaggcggacgaccgagctgaggctgagctagggctagggcacccacctcctccccttccggtatggcctctcccctctcctcatgatttcttttgcgagttcgtccctgcgatcgatttgttaggcgagcgctagggatgcgcagatctgttacctgggtgggttggatggatggatggaacctgtcgattcgattcttctgtttgtttgtttggaacgtgtagatctgcccccaaatgggtgctttggagaatcacgcggatctaccatccgccatgggatgggatgggatgggatgccattttgactagtttgtttgatgcctgtgaaccgcctagatctgcccgctctgtttggtttccttggtacttgttgttagaacaatggaacccctagtgatgagggacggactagtgctgtggatttgggcatatggtccagtacgtgaacacgcatcgtgtaccacatggatcatacccatttttttccctttttcttgtcacgtaccaagtaatctttttcgctagatagattaggcacggctgagatatcactacatcatcatgaaaaattgagatgatttattcctgtggctacttatgttcaatgtgccttacagttggcacctaacaattgagatgatttcgcatggtatgtgcttatttatcgacaatagtgcaatgctccatttatactaatctaaactttttgcgatgcaagtttcatcttgtttctttgatatcatgttttaggtcactggcgtatctggtacacttctttttgtatattttcttgtaaacacactgattagaatactgcaatttgtgagttatggcctagatgaggtgttagataaaagttttgcaccatatgtctttcactatcttcatcctacttttagcaaattagtttacatgatatcgatatgtcaggtatgtcactataggcacatcaatataggatgttgccgtcatggtttacgtgcatgcattaggtcttctgcaaatgcagtaacagcactatcctctaattaggttattgatataatggtcttgtgttaaccacatagatggataaattggcctagttgctattacgcggtcttccacggtttgcatataagaagggggctaggggttgtagctagacaatcaaatctatgctttgtctatgcaataacaaggttccctttttcgacctgtgtaacttgtttaggtagagcattgtggtgagatagcatacatacttctttcaaggagcaagtatgtagtaagttaaggtctgcagtaaggtcaatttaaacagtttttttcagagattgtaatgcatggcaccaaatgtatgcttatttcttttcatgagttaataaaaaaataccattcagttgttttaattttgacattgggggttgattttctgacatatactccctccgttccagaaaaaaccaacttctggggacaaatctagacaaatgcatgtccagatttatctccataagttgattctttttgggacggagggtgtaaatttgcggtgaatcctcctggttattactcaaattcactccacttggatggttagatactgtaaatgaaatatgcacagttgcttctactaattatgatgccataacctcttttattgtacatctcagttttcaatatttgatgcagtatcctggatggctgctg

SEQ ID NO: 51643 - DNA, 1786 bp, Oryza sativa
gctgcaaggctggtacttcctccatttcgcaatgtaagactttttagcattgcccatgttcatttagatattaatgaatctagacatatgtatgtgtttagattcattaacatctatatgtatgtgggcaatgctagaaaattttacattatgaaacggaggaagtcccatacatagatggctaaaaaaagtattgttctaccataagaattcaacttttttaactgacaataaccggaaccatatctgaaatatgtcatacttggcactcaaacaattgttgataaaatcatagctgggaattctcaaaaaaattgtgggctagacttctagcagaaattgcaagatgaaaatatagaggtgtttaactaggggctgttcagattatagccaaaataaacattatcaaattttggcaatgctagaatgttggtaagttatcaatattgccaagtttttgcaggattccttatgtatttagcaatatttggtacaaaactaaatgtatgcacatctttggtaactttagaaaatttggtatggtttaaaatgtcatcaatctaaacaacccctagattcatcaacaaacctaattgaatcaagcttttcttttggtccattgattcaaagatccaacaaattttggtccattgatttaaaaacattagcatgatcactatttttttcaactttggagtagagcacagaaacttggtaacatggcagaacaagtactctgaaacaggtgaaatcacattgatagaataaaaggttgggggatacccagtacatcattggccttaatcaaatagtttggcagttgctggaacattcagtgcttctgcaaccattccaacaatctgagcaccctgaaaagtgaataaagaaagaataaacacatagaagtaatgcagtagatacactgcaaatgtttatttaccctaaaattgtgcatatggttaaactgggaatgtctctacaccatactatcgcacaggggtttaattcagtttggatcacatggattaaacagcttttggaatccggcaaagtacacatcatgattaatggaacaacactaatcaaataccaacgaagagtcagggtgacccttgttaaaaatatacatattgatttaatttattctataaataaatcataagattgaacatgtaaactagcataatcgtatcatacaatctatacatgtaaactaaaactagacagtacgtaaaacatgaatagattgaatatacgaaacagagtgaatgcgtaccgagggttttggatgttcaactacacagcaggaagaactcacggtaaggtgggagccggtttccaaatggtttacacaagagcccaacctcaccgatcaaaccgtcaaacctccaaatcccctagttaaggaatgggtaaggtggaagccaaacctgaagttgttcatataaggctcgatcactaggacggttattccttcagctgaaggtggttgtgatgcctagggtctaaaggcggatttaggcgcaactcaatttgttggaccatactattgatgctaaaaatacacactgacctgggagatctgcttagctccagtgcaggtccaaatcttgatgatatgcgagcgtgccagtcagtttgatcctgcaaccgacaagatatataaacaatagataaaacagctgatcggttgacaagccgatggaatagttctagccgataccgataccagccgatagcgatagggtttcgagtaatcggctatacgtccaatgtatataatgat

SEQ ID NO: 51644 - DNA, 1633 bp, Oryza sativa
  unsure (1)..(1633): unsure at all n locations
tccgcaaggaaaccgtctccccgaataaaagatgttagtgttgtcagggttacggataccacatacctaatagtagttgactaaatcttggtaggacccaccacataccatatcttatacggaaactgacctcggatatggagggagttccggataagaaaagacaaccagagttctacatggaaacgacaaggactactcggattgtatccatattggtttccctagttctacttggacaaggagacacctatgggtataaatacaaggcctcctaggaggagagggaccacccaccacaatcaacatacacggaacaatagatcaagacagaagatcaacatacaagccaacatacgccaagacaagacgtcggatatcgacttcagggataagcatagctagttccctacggtgtctccggatactgtcaggagaaacgaaagctctatctctgatctcgccgggcacgattcgaagaggaagactaccctgttgtcgactacgagtcagaacttcagaccaccatgtcgacaacaattagataggctaccccaaatattgtactggtgtgattatgatgaataagagcaacgaccggcttcggccaacgggatgtagggctattacctggcaattcaggggcccgaacctgtataaaaatccttgtacatatctcttttacctcagtctcgcatatatcctagcaccgacgatccccataccatacaaataccggaatcgcgacatcaaacgtcgacaagagtcatattcggaagaaataggggatttgtgatcccatacgtagaaaggtatctccgagttctactggaggtcaagataacctacgatataaatacaggaccctggaggggcacatggcatcgaatcttagcgcaagacacacaccatagcagaaacaatcaagagaacgcgaagccaactcaccggtggatctcgtcgagccgttcttgatagggatctcgtcggcaatctcagggttccattgttctctattataatctatatggttttctccataatcccatataaactggattagggcttcctcgcaagggacctgaaccagtataatctttgtctcatgtgtgcttgatgtcctatcgtatagattctcgtacacagaaaacaaaatcaaagctacaaataaaaaaaacgcgctcgtgtactaatgtggcgtgtgtttgcttagggcatttgtagtgttggttcggtaaggctgtatttgcaacgcctgttcccaacccctctccctcgttttttgtccgcacgcttttcaaactactagacggtacgtttttttgtaaaaattttctatacgaaagttgcttaaaaaatcaaattaatccatttttgaaaaaaaaatagccaatacttaattaatcatatgttaaaaggacgctccgttttacgtgcaggagggatgtgttcccatcctgcacttgcgaacacaaaagtctagtccacaaaagtcaaataaacattcgattcgacccctacaacgttaaaatcgattttgggtgggacccataaaaaaaatcttaatcccacctatagcaacaagcaattntttatcatcagtgttcgacttttgttttggagttgctttttc

SEQ ID NO: 51645 - DNA, 1000 bp, Oryza sativa
tccttgttcgcaaacattctcttcatgcgctccgcaattgggagataccacaccacctttgctgggcctcccctctttgacttacttccttcacctcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttatgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagta

SEQ ID NO: 51646 - DNA, 1011 bp, Oryza sativa
gtaagagttcatagcataatgaactgtcgttgtacatgccgtaattataatacaatatagctgataagcatattaattaaatctaattacaagtgataagggtctcaaaattaaactatatttgaaacatgtgttaccccgcaagcacctaatgtgagcataataattagttctcacctggagacatttgtctttatagtttcccttattgtgcatgaattagttaacttgactacatacgacgctaatttttttatattttagcccttttggaagcttcttttacaaatagaaatctggaaaaacttattctagctaggaatagatttttttctcaactctagggttattggcgctaaggctcaatatgatactccttgccgccaccccaccccccccctcctccccggtggtaggcaagtcgctgacgttgaagggtcagcaccaacctctttagcactaaggacctattcggtgctctttggcactatggatctatttgtaagaaaaatatttatattttgacccttttcataaatttatgttaaaacataggccctcgatacaaggatcattggcgccgagggtccattccgagaataagtttgtccaaggatctatttgtaaaataaattttaaaaagaaccaaatgtaaaatctagacctacaacaaacaatagcgagcatatacttagcgcaacgtcatcaagaaaggcacttatgcaagaacagggataataccaaatgttgttaagtgtattctccatgttcttgagtaagtgtattctccctgtggttacttacagaagaatgagatcgacctagtaacttttagttctagattattatgagtcaacttctgatggtatgtctctgatggtatgtcatatttattgggcctgttcggctgcactcatttagccgtggtgcagccagcctaaacagtgttttgtgtcatcagctgcgacaatgacgtcgcaacacagtggcttcaccttgcagccgaacagg

SEQ ID NO: 51647 - DNA, 2062 bp, Oryza sativa
catatggtctctatgtttctaaggtaaatattttagaagttatatatagttcaagttttaaaattttgacatcagtattgtcctaaatgacaattatttttaacctgaagcctgaaggaataccaattatagctgtcattatacccaactaaattttaacatatataattattataaattacactttgcacataaatatgcaagtcatagccttgcaattgcatgacttaattggctagttataggtgattgccaaacaattgaatagtgctgctattatggggtagaaggctatggaatggacaaggccattcttgccatgattttttccattctttttcctttcacttatctttacagcttcattctgttggcagagaagtgtttctcaactaaatttcagctcaaagaatatggaaaggaaataaaagaatgaacaaaaaatatatcccaataaatgcttgcagcgtgctaaattttccaggttttgcaaaagtgtctcaatcttgctaggttccattcgttgaggtccttaaatttccctatgcatgctcaatagagtaattatttagtcaattgaaatgttggagaaccaaagaggatttaagtgtcgattaattaagaaaaatgggacagcacatctggagttgaaagctagcagggtgggtgcatgagagcttccccagaaaactattctaccacagctctctatttagtcacttaagcgataatattaaatccagttggagtgtatgaaactaaagtataagtcatttacgttagtaacatgaacaagaaaaatactatggtttagattgatgtagtgacacaaacaatatggggaagattttactcgagatgatacacttatatgggttttcttgcttacccttaccatgacctttttttatcacatcttatcttgacgatgggaactatatggtatgcatttttcatattccaattttaattacattgagtttatatttggatacataacaatagataagtatctcaatatgtgcatagttactagtggtctcaatagtacataaactcatttgttagttttattgcattgaatgccacctaattaataccctccaaacatataaaaatctagagatgtttgcatcaatgtaaatccatgcttctagttatatcttttccacaacaccatattatacccatcatttaagaaaaatatgtcaaacaatcacaccttatccaataagaaaaatttacctcttgcatagttttgttcccattctcattcctccggcgaaatattttttttgagggaataatgttcatctacttcaaacactcaatcctgaatcctaagctccaacaaatctgctcgaccaaagacaaacaagactagatattgtctagcaaatcttccatgcacttctcttttgaacattatatacatttggcaatagtgtggttgactgtttgcataatattttttactcccccgagtcaaaaaaaacaatattttgcactccctccattccacattaaaaaatgttttggcggtttggcctctccatccctcgtctagattcactaacatccatatgaatttagacacatatatgatatcatgtattaatctattcatactcaaacatcttataatgtgaaacaaaaggaagtactcaacaacagttccaagaaccgaacaagtttactcaacaagccattaacgtatgcatactccccttctctcatgttggcatggatgccagggctcactcactttgcgagggtgctatccacattgttgatagcggattaatcacaccaattgtaccatgcataagcacctactgtgcccccaccccagcatgatgtgcacgttcccgatcttccgagaagttctgataaacaacgatttgggcggagtcgcgacacaaatcgatccggcttcttgaacgcgcacgctcttgagctccgcaatcacagcaccacgtctcctctggttatcacctgtgtcgaaacgcgatgacctcgccgagaaggctaatccctgtttgccaatcgaagaacactaaca

SEQ ID NO: 51648 - DNA, 1037 bp, Oryza sativa
catgctttatctctaaaaggttctttttggtggaaagatgctctacagtttgttgatatctttagaggtcttttaaagtgcacaattggtgatggcagaacctgtttgttttggtctgatctatggaatgataagattaggcaaaggagttatcctagagctttctcttttgcaaggaaccaaaaagactcgagaaaatcccttgtatacccctgaattttaagctaatcccttctatgcctctgaattttgcttacttccttgtatacctccaaaatttaattttgatccctttcatacccctgccatcagttgaccgtctaatttctaaaaatgattattttaccctctggatgaacatagaaatttattaattatattactaaaaatgtaaaagtttgtcgcatgagactattatagttatgagtttgttgtgtgatgcattatttatcacaaaatttatttttagatatgaaataaaaaatatgtatttatttttgaaacaaagtcatcaaaaagaggagcattcctacaaacataggactaccaatgctcacaataatttttttatgaatgctcccgataaaaaaatccattatcctattaaaatttcaaatagaaattttaatttattacatttgtttttattttcaaaatttagtctcattagtttcataaaatgcacatattgtgcactcaaacaaaaatttcaatttttttcaagcttatattcaaacctaaagcatcaagggcaaaaaagacatttgcaatcaaacgtaatagtgaaatgaatgaaaatgtagcggtaggggcataaaagggatcaagttgaaatttcaggggtatataagggatcgggtaaatttcaggggcatgaaagggatagagtgagttttcagggggtacatagggaatttactcaaaagactcagttcatctgacttccttaatggacttgtcttagacttttaccctccctttgtctaaacaggcttttcaagagtatctttcaatgctttctacagataccttagatc

SEQ ID NO: 51649 - DNA, 892 bp, Oryza sativa
tatatatatatatatatatacatatatatatatatatacatacatatatatacatatatacatacatatatacatatatatatatatatacatatatacacatatatatacatatatatatatatatatacatacacacacacacacatatcatgatagtaagttacttggctagagaatttgttttgaatacatcattcgcattgaggtacgactaattgattgtattagtactttcaaaaactaaaattctatcttttcagttttatatgtaataacaagttgtgcattctacagttttatcatgagttcgtatgcaaaattgattaatcacttcgatttatcatcacacatggtatttagaaaatctcacttgacgatggccatccgatctaaagatacttcgactatagatttaatgtaatacctcatcaaaagtgctatttgctgcagagtttacgataacatccactatcaagatccgaccgccatcttcaaaaggaactccgaataatactaagtggatctgaataatatgaaatgcatcgatcgattaaaaccttgcttttttaaagtaatcaacatatacaaaattactagcacacgtaatcctgaaactaatacctagcacacgtttttagtacctttccacgggtaccttcactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagacgtataccagtgacgagtttttcttccaacccgtcactggtatcccctcacctg

SEQ ID NO: 51650 - DNA, 4905 bp, Oryza sativa
attggcagtatatgacaatagtttcgccgcgcgaatcacgaggtgatattttgccacgacgcacccacacagtccaatatgtccaaaaatcatgttttggtgatttttgaactttttcattccgggtgaaaaacatcgcacccacgtgtgccaagatatggcaatatgggcattaattgacaaaagttcgccgcgcgaatcacgaagtgattttttgccacgaatgcacccaacacactccaatatgtccaaaaatcatgttttggtgctttttgaaatttttcattccggtgaaaaacatcgcacccacctatgccaatattggcagtaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggcagtaattgacaaaagttcgccgcgcgaatcacgaagtgattttttgccacgaacgcacccaacacactccaatatgtccaaaaatcatgttttggtgctttttgaactttttcattccggtgaaaaacatcgcacccactctatggcaatattggcattaattgacaaaagttcgccgcgcgaatcacgaagtgattttttgccacgaatgcacccaacacactccaatatgtccaaaaatcatgttttggtgctttttgaacttttttattccggtcaaaaacatcgcacccacctatgccaatattggtagtaattgacaaaagttcagcgcgcgaatcacgaagtgatattttgccacgaatgcacccaacacactccaatatgtccaaaaatcatgttttggtgctttttgaactttttcattccggtctaaaacatcgcacccatatatggcaatattggcattaattcacaaaagttcgccgcgcgagtcacgaagtgattttttgccacgaacgcacccaacacactccaatatgtccaaaaatcatgttttggtgcttttcgaactttttcattctggtgaaaaacatcgcacccacctatgcattggcagtaattgacaatagttcgccgcgcgatacacgaagtgatttttttccacgaatgcacccaacacactccaatatgtccaaaaatcatgttttggtgctttttgaactttttcattccggtgaaaaacatcgaacccacctatgccaatattggcagtaattcacaaaagttcgccgcgcgaatcacgaagtgattttttggaacgaacgcacccaacacactccaatatgtccaaaaatcatgttttggtgctttttgaactttttcattccggtgaaaaacatcgcacccacctatgccaatattggcagtaattgacaaaagttcgccgcgcgaatcgcgaagtgatttttttccacgaatgcaccaaccacactccaatatctccaaaaatcttgttttggtgctttttgaactttttcattacggtcaaaaacatcgcacccacatgtgccaatatcggcattatcggcaaaagttcgcccgcgcgaatcacgaagtgatattttgccacgaatgcacccaacacactccaatatgtccaaaaatcatgttttggtgcttgttgaactttttcattccggtgaaaaacatcgcacccacatatgccaatattggcagtaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgatttttttccacgaatgcaccaaccacactccaatatgtccaaaaatcatgttttggtgctttttgaactttttcataccggtgaaaaacatcgcacccacgtgtgccaatatatggcaatattggcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatggcaatattggcattaattgacaaaagttcgccgcgcgaatcacgaagtgattttttgccacgaacgcacccaacacactccaatatgtccagaaatcaagttttggtgctttttgaactttttcattccggtgaaaaacatcgcacccacctatgccaatattggcagtaattgacaaaagttcgccgcgcgaatcacgaagtgattttttgccacgaacgcacccaacacagtccaatatgtccaaaaatcatgttttggtgctttttgaactttttcattccggtgaaaaacatcgcacccacgtgtgccaagatatggcaatattggcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggcagtaattgacaaaagttcgccgcgcgaatcacgaagtgattttttgccacgaacgcacccaacacactccaatatgtccaaaaatcatgttttggtgctttttgaactttttcattccggtgaaaaacatcgcacccacctatgccaatattggcagtaattgacaaaagttcgccgcgcgaatcgcgaagtgattttttgccacgaatgcacccaaaacactccaatatgtccaaaaatcatgttttggtgctttttgaactttttcattccggtgaaaaacatcgcacccaccgatgccaatattggcagtaattgacaaaagttcgccgcgcgaatcacgaagtgatattttgccacgaacgcacccaacacactccaatatgtccaaaaatcatgttttggtgctttatgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttgatggtttttgaactttttcattccggtgaaaaacatcgcacccacgtgtgccaatatatggcaatattggcattaattgacaaaagttcgccgcgcgaatcacgaagtgattttttgccacgaacgcacccaacacactccaatatgtccaaaaatcatgttttggtgcttttcgaactttttcattcgggtgaaaatcatcgcacccacctatgcattggcagtaattgacaatagttcgccgcgcgaatcacgaagtgatttttttccacgaatgcacccaacacactccaatatgtccaaaaatcatgttttggtgctttttgaactttttcattccggtgaaaaacatcgaacccacctatgccaatattggcagtaattgacaaaagttcgtcgcgcgaatcacgaagtgatattttgccacgaatgcacccaacacactccaatatgtccaaaaatcatgttttggtgcttgttgaactttttcatttcggtgaaaaacatcgcacccacctatgccaatattggcagtaattgacaaaagttcgccgcgcgaatcgcgaagtgattttttccacgaatgcaccaaccacactccaatatctccaaaaatcttgttttggtgctttttgaactttttcattacggtcaaaaacatcgcacccacatgtgccaatatcggcattatcggcaaaagttcgcccgcgcgaatcacgaagtgatattttgccacgaatgctcccaacacactccaatatgtccaaaaatcatgtcttggtgcttgttgaactttttcattccggtgaaaaacatcgcacccacctatggcaatattggcattaattgacaaaagttcgccgcgcgaatcacgaagtgattttttgccacgaacgcacccaacacactgcaatatgtccaaaaatcatgttttggtgctttttgaactttttcattccggtgaaaaacatcgcacccacctatgccaatattggcagtaattgacaaaagttcgctgcgcgaatcatgaagtgatattttgccacgaatgcacccaacacactccaatatgtccaaaaatcatgttttggtgctttttgaactttttcattccggtcaaaaacatcgcaaccacgtgtgccaatattggtagtaattgacaaaaattcagcgcgcgaatcacgaagtgattttttggcacgaatgcacccaacacactctaatatgtccaaaaatcatggtttgatgcttttgaactttttcattccggtgaaaaacatcg

SEQ ID NO: 51651 - DNA, 1353 bp, Oryza sativa
  unsure (1)..(1353): unsure at all n locations
gcaaaaactcaattcgtgttcgcacagcgactttgtgcaatcattgacattattggcacacgtgggtgcgatgtttttgacggnaataaaaaagtcaaaaaagcacaaaacatgtagtgtnttggtgcgttcggccaaaaaatgacttcgtgtccgcgcgccgaagttgggtcaattaatgccattattggcacacggtgggtgcgatgtttttggccggaatgaaaatattcaaaaggcaccaaaacatgatttttgaacatattgaagtgtatggggtgcgctcgtagtaaaaactcacttcgtattcggcgcggcgaccttttgtcatttaatgccactattggcacacgtgggtgcgatgtttttgcccggaatgaaaataattcataaagcgccanaccatgatctttggacatattggagtgtatgggggcgttcgtggcaaaaactcacttcgtattcgcgcggcgaagttttgtcaattaatgccaatatgagcgttcaaagagcaccaaaacatgatttttggacatattggagtgtattgggtgcgttcgtggcaaaaactgacttcgtgattcgcgcggcgaacttttgtcaattaatggcatttttggcacacgtggggggtgatgtttttgaccggaatgaaaaagttcaaaaagcaccaaaacatgatttttggacatattggagtgtattgagtgcgttcgtggcaaaaactcaattcgtgattcgcacggcgaacttttgtcaattaatgccattattggcacacgtgggtgcgatgtttttgaccggaatgaaaaagttcaaaaaagcaccaaaacatgtttagtgtattgggtgcgttcgtggcaaaaactcacttcgtgattcgcgcggcgaacttttgtcaattaatgccattattggcacacgtgggtgcgatgtttttgaccggaatgaaaaaattcaaaaagcaccaaaacatgatttttggacatattggagtgtattgggtgcgctcgtggtaaaaactcacttcgtgattcgcgcgacgaacttttgtcaattaatgccattattggcacacgtgggtgcgatgtttttgaccggaatgaaaaaattcaaaaagcaccaaaacatgatttttggacatattggagtgtattgggtgcgttcgtggcaaaaactcacttcgtgattcgcgcggcgaacttttgtcaattaatgccattattgggacacgtgggtgcgatgtttttgaccggaatgaaaaaggtcaaagagcaccaaaacatgatttttggacatattagagtgtattgggtacgttcttggcaaaaactcacttcgtgattcgcgcgg

SEQ ID NO: 51652 - DNA, 6627 bp, Oryza sativa
ttctgttccttgtcgtcaggtacacacaatctttcccccatccagattgtgccacgctcatcctcaaggaaatcccgagccttttcgactctcatgttctttttcagctctactatttcaggatcatttacttgagcggctctaacttgatcgacgagcgtaggccgtgattctagagcggctacgaacccgtgttccacaattcccacattgagacgctcaaactcctgctgcaattcctcatacatgccctcgatgcatagggcattgcaatagcttttcctgcttaacgcatctgccaccacattggccttccccgggtggtagtgaatgctcatgtcatagtctttgattaattccagccgtcttcgtggtcggagatttagatccggttgggtgaagatgtatttcagactcttgtgatccgtatatacttcacagtggttgccaatcagattgtgcctccagatcttcaaagcatgaaccactgctgccaattccagatcatgggttgggtaattcccttcatgtggacgcaactgtcgcgaggcatacgcaaccactctgccttcttgcattagaacacacccaagcccgtggcgggatgcatcgcaatagacttgaaagtccttcatctggtcgggcagaatcaaaactggtgcggatactaatttcttttagagctcttcgaagctcttatcgcactcagctgtccatttaaacttctcatctttcttaagtaactgagtcatgggtcgggcaatcctggagaagttttcgatgaatcggcggtaataacccgcaagtccaagaaaacttcgaatctgcgacacggtcttcggtggggtccatttggtaactgactccacgttcgatgggtcgactgccatgccttgagctgtaacaacatggcccagaaatttgacttccgtcaaccagaagtcacacttgctgaacttagcatataactggtgctccttcaacttctcaagtaccagtcgaaggtgctgctcatgttcttcttcggattttgaatagataagtatatcgtcgatgaataccacaacaaacttgtccagaaattccatgaacactttgttcatcagattcataaagaatgcgggtgcgttggtaagtccgaaagacataatcgtgcactcatacagcccgtaccgagtggtaaagccgtctttggaatatcctcttcccgaattcttaactggtgatagcctgatcgcaggtctatcttagagaacaccttagctcccttcagttggtcaaacaagtcatcgatccgtggtaaaggatatttattcttgattgtgacctcattgagtgcgcgataatcgacgcacatcctcttcgtcttattctttttctccgcaaaaatgaccggagcaccccaaggtgaagtacttggtcgaatgtaccctttctgcagctgctcatcaacctgcttcttgacctctgcatcctgtacggtctcttgtaaattggagcggttcccggtgccaaatcaatccggaattcaatctctcgcttgggtggcatggtagtgaggtcttcgggaaacacttctggatagtcgcaaactatgggagtctcttccaatttcctcgaattcttctcctcggtgaccactgggatttccgcctcaatctgattcaaggagatcccttgctttggtgagactagtgatttgtacactacggtttctcccttctcgttggtcaaggtgactgtgcgattcgcacaatcaatgactcccttgaacttggtcagccaatccatcccaagaatgacatctaggtctttggattcaagaagaatgaggttggctagaaatggtgatctttgaatttctattagcactgaagggataaaactgaccgaggttgaactatttcctggggtatgaaccctcattggtgtactaagctcttctttccttaacccatgcatccccacaaatttcattgaaatgaaagaatgcgttgcaccagaatcaaaaagtactgttgcagggattgagttaacaggaaacgtacccagtatgacctctggtgctgcttgcgcctcctctgcagacgcgtggttgacacgagcctggacaaacctttggccggcacgcctaggctacgggcatttgtcagcgaagtggccaagctcgccacagttgaagcaagaccctggttttgttccagtctccttcttggcttgcgcggacgggcctgattgtgctggtgccactggtgggcgtggagctgcaccgcggttgggctgacctccatggtggttctgactgtcactggcgcccaggtggaagttgcttgacttgaacgggcggtgctggcggacgatcatggtggtaggtccaccctgctgccggtagtgaaacgcggtcgctgctggttaccttggttggaccggagctgtgccgccattctcttcctgtccattttgttgcgctgatcctcctgacagattgccttgtcaaccagcctttcaaaatcagcgtagtccccagatatcagttggttggtcagctcgtcatccagacctgccataaacttttcgtgcttctcggcatcagtgcggacatcctccggtgcatatcacgcgaggcgattgaactcatgaagatactctgtcactgtcctgttgccctgatggagtgcctggaattccctcttcttttgtgccacgaccccatctggcacctgcgccttcctgaagctacgacagaactccgcccaagtgacttcagcgcctggcgggcgggtggccatgtgattgtcccaccaagctgacgcgggaccttgaagttggtgtgtggcgaaagcaaccttctcctgatcattgcactgcaggaggttcaatttcttttctatggcatggagccagtcattcgtctccatggggttggtagtgctagagaaagtgggtggcctgacgcgtagaaacttgggcaatttggattgagggggagggggaccaaactgctggtgatgctgttcggcgtgctgctgcatcctctggtgcatctgctggtgctgctgctgcatctgctgcatcatggctgccatcatctgagtctgatgtgccattacttgggccagcgtcggattctcgggaaatggtggcggaccattgccggaatcactgttggggtgcacaccatcagtgcgctcttcgccgttgctgccctcgcctgtcgtgcgggtgccattcctggtgtagaccatctggaggaatagcagacggggaaacggagaaaaacagatactcaggaactaagctttattacatagaaatttaaactgcaattgttctgatctgaattaaaacactttaaacagcaagcaaaaaatccttattaaggcagccatattataggcacatgatatcgaccgccgactgacccacaagcaagcaacctaaacacacaaactaacaagcagaagctagacagtcgataagctaatggaaaacgagcctaatgctcggaacggctcctgcggtcggtggagtcaatggcgtcctcctgctcgtcaccaggtccctctaagcgactcctggagcctggcagatatgtctcaccgctgcccggctctgagccactggagctgctgctgctgcggtcgcggctgccactgggtgtagcaggcaaccaaccccctttgccactggcggggcccctaacggctgatgctggcgtgaaggagagagcggatgcaggagctgacacgggaataggagctggagctggcgctggagctgcaggaactgctggagctgcgggtggaactggaggagctgcgggagctgctgacggaggtgggttcttgggctcaagctggacgcgcacgggtgccgttgtcgacttgcggggagtagtgcggatccggactcctcctagcgcgggaagacccttcaactgagcattctccctcttcaggcgcgctatctcgtccttcagagcgatgatcctcacaagcttcccatcattcaaggccttggacgccttgtgcaggtctgagtgcatcctgtccatccccctcatcacagcgcacatgtgaccaaaggtgctgtcgttctcgccggctgtcggacggaaggaactgacatcgctgccgctggcttgacgagggtggaaccggtacgccgtgtcgtggaagatgtaggtgtggcgctcccgtagtctggccatcatcagatatgctgcctcctgacatgcgtgatctgctgtgcctccagacgcctcaaccaccatgttagcgaggcaagtacccacgtagccatggacctccaggcggacacggtgaggaagctcgccactaagtggtggaacagtcgtgtactctggcgtgttggggtagcccaccaccagtgtcatgcgtgccaactctgccacgaaatcatccatgccttctccgcggtggttgggtgggtgctcggccatctagagaagacaaaggggtaggatcaatgcatgctcaaatccaatttaaataaagcaataaaggactcaaataagagaatcgaataagagcgaaattttatgcatagatcattttgcatgagagcgaataaataagacggacttacatagcgataaaataatggggaaattagatacatacttataataacaataaaagcataaataccttacaacccatattcctgagctaagacctaatgcatttcgcccatcaaatcccaactgatggtcaaaacatctcaaataattttactaaaaccctagaccgacttgttttggcaaatctcacttaaacgagcgacaagatttttcccttgaaccacaagaacagatcccaaattttcccggaacaattccaactgcaaagaacttatgcaatgaaaggattcagagggctcttaggtttccatttggcttgtcctacggtcaaggacgatctgataccaacttgtcacgcccaaaaattcccgaatagaattccaagcagaatgtgcattaaaacccccgtccaggaccggctggggtacacaaacgacaatgttgacataaagatccacgtcttacaaacattataaaagtcttacataaatgcagcggaaaacgaaagataacaggagctaagcctagacttgaactgcagcgggaacaccactccgacggcacggacgaagcctactcctcagagaacccgccatcggacacatactcatactctggggttgggggaaaataaagtaagactgagtactatccactgtactcagcaagtcacaccggaataggggtatgatgcagggattaacaagggatagctatacaggttcatttgcataatactggcatttataaacagaagttgaatgcggaaacagttgtaataattaatcaatattaatcatccactgtccaatgttacaccacgttgcaacaggcccaaccatccacccgtactatccaatttcattacactaaactaggatgagactaatcacggtgaatctggttgaccgcccataaccgcgggcacggctatttgaatagttttactctggtcagaggtgtacaactgtacccacgagacacagccccacgacacgtttccgtgcgccgacatgccaccacgacataccggaaagaagccgtgacaggacccttcgcgcaaccccctctagccaagcacaccacacctcaggtttcacccccgtccccagcgggcgacaggaagtcccctctcgtgcctaggtgaatccggaagccgcataggccgtcacagggcccatccaaactccatcacgcccacccttgcctggatgcgtcagctagagaaaagctacactataagcccagccgttgcccacgctggcttgtggtaagcacgataaattcttctagggtttcccgcgaaccggtccttaattgctatgggtgcgactagcaaaaccatgtacccacagcccaccatgtgagttattttaattaaccaacaccaaagcggtggtactattccaatattttaaatgttatttccccattgtgtgctagtggaactaagcatggctaagcaattcctagtccaaagtctattcatgttataacccgaactaacaaaggagcatggtatcaaaatagcatggctgtaacaataggtaaacatcccatagtattattgcaaaacaaatgcagtatttgaaagaaaacattagaacatttgcaatataggatcaacatgatcaagtgacaagcatgacttgccttgctctgctgctggaggaacctcggcgactatttcgaagtacaccggagcgtcggaagagccggaatctaacgacatacaaggcaaacaatgcaaacaggctataagactattgaaacagagaacaaaaccatttttaatggattctacacatttttcttgatttacggagacttgaatgggcttaaacggagctcggatgaattagttatgatttttagaagattcactgtgcttattactataaaaaaaactttaatgaattattgcgcaataaagccttccagggctgacgtcaacaaggggttgggcggcgccgacaggcgggtcccactggtcagcggctcgggacagaggggaagggggcgcc

SEQ ID NO: 51653 - DNA, 3698 bp, Oryza sativa
  unsure (1)..(3698): unsure at all n locations
acgaaaaagatcaaaaagcaccaaaacatgatttttggacatattggagtgtattgggtgcgttcgtgaaaaactcccttcgtcattcgcgcggcgaacttttgtcacttaatgccattattggcacacgtgggtgcaatgtttttgaccgaaatgaaaaagttcaaaaagctccaaaaacatgatttttggacatattggagtgtattgggtgcgtttgtgccaaaaactcacttcgtgattcgcgcggcgaacttttgtcagttaatgccattattggcacacgtgggtgcgatgtttttgaccggaatgaaaaagttcaaaaagcaccaaaacatgatttttggacatattggaccgttcgtggcaaaaactcactttgtgattcgcgcggcgaacttttgtcaattaatgctattattggcacacgtgggtgcgatgtgtttgaccggaacgaaaaagatcaaaaagcaccaaaacgtgatttttggacatattggagtgtattgggtgcgttcgtggaaaaaactcccttcgtgattcgcgcggcgaacttttgtcacttaatgccattattggcacacgtgggtgcaatgtttttgaccgaaatgaaaaagttcaaaaagctccaaaaacatgatttttggacatattggagtgtattgggtgcgtttgtgccaaaaactcacttcgtgattcgcgcggcgaacttttgtcagttaatgccattattggcacacgtgggtgcgatgtttttgaccggaatgaaaaagttcaaaaagcaccaaaacatgattttttgacatattggagcgttcgtggcaaaaactcactttgtgattcgcgcggcgaacttttgtcaattaatgctattattggcacacgtgggtgcgatgtgtttgaccggaatgaaaaagatcaaaaagcaccaaaacgtgatttttggacatattggagtgtattgggtgcgttcgtggaaaaaactcacttcgtgattcgcgcggcgaacttttgtcaattaatggcattattggcacacgtgggtgcgatgtttttgaccaaaatgaaaaagttcaaaaagcaccaaaatatgatttttggacatattggagtgtattgggtgcgtttgtggcaaaaactcacttcgtgattcgcgcggcgaacttttgtcaattaatgccataattggcacacgtgggtgcgatgtttttgaccggaagaaaaagttcaaaaagcaccaaaacatgatttttggacatattggagtagtgtattgggtgcgttcgtggcaaaaactgacttcgtgattcgcgcggcgaactttggtcaattaatgccattattggcacacgtgtgtgcgatgtttttgaccggaatgaaaaagatcaaaaagcaccaaaacatgatttttggacatattggagtgtattggcacgctcgtggtaaaaactcacttcgtgattcgcgcggcgaacttttgtcaattaatgccattattggcacacgtgggtgcgatgtttttgaccggaatgaaaaaattcaaaaagcaccaaaacatgatttttggacatattggagtgtattgggtgcgttcgtggcaaaaactgacttcgtgattcgcgcggcgaacttttgtcaattaatggcatttttggcacacgtggggggtgatgtttttgaccggaatgaaaaagttcaaaaagcaccaaaacatgatttttggacatattggagtgtattgagtgcgttcgtggcaaaaactcaattcgtgattcgcacagcgaacttttgtcaattaatggcattattggcacacgtgggtgcgatgtttttgaccggaatgaaaaagttcaaaaagcaccaaaacatgtagtgtattgggtgcgttcgtggcaaaaactgacttcgtgattcgcgcggcgaactttggtcaattaatgccattattggcacacgtgggtgcgatgtttttgaccggaatgaaaaaattcaaaaagcaccaaaacatgatttttggacatattggagtgtattgggtgcgctcgtagtaaaaactcacttcgtgattcgcgcggcgaacttttgtcaattaatgccactattggcacacgtgggtgcgatgtttttgaccggaatgaaaaaaattcaaaaagcaccaaaacatgatttttggacatattggagtgtattgggtgcgttcgtggcaaaaactcacttcgtgattcgcgcggcgaagttttgtcaattaatgccaatatgggcgttcaaaaagcaccaaaacatgatttttagacatattggagtgtattgggtgggttcgtggcaaaaactcacttcgtgattcgcgcggcgaacttttgtcaattaatgccattattggcacacgtgggtgcgatgcttttgaccggaatgaaaaagttcaaaaagcaccaaaacatgattttggatatattgcagtgtattgggtgggttcgtggcaaaaactcactttgtgattcgcgcggcgaacttttgtcaattaatgctattattggcacacgtgggtgcgatgtgtttgaccggaatgaaaaagatcaaaaagcaccaaaacatgatttttggacatattggagtgtattgggtgcgttcgtggaaaaaactcacttcgtgattcgcgcggagaacttttgtcacttaatgccattattggcacacgtgggtgcgatgtttttgacccaaatgaaaaagttcaaaaagcaccaaaatatgatttttggacatattggagtgtattgggtgcgcttgtggcaaaaactcacttcgtgattcgcgcggcgaacttttgtcaattaatgccattactggcacacgtgggtgcgatgtttttgaccggaatgaaaaagttcaaaaagcaccaaaacatgattttttgacatattggagcgttcgtggcaaaaactcactttgtgattcgcacggcgaacttttgtcaattaatgccatcattggcacacgtgggtgcgatgtttttgaccagaataaaaaaagttcaaaaagcactaaaacatgatttttggacatattggaccgttcgtggcaaaaactcactttgtgattcgcgtggcgaacttttgtcaattaatgccattattggcacacgtgggtgcgatgtgtttgaccggaacgaaaaagatcaaaaagcaccaaaacatgatttttggacatattggagtgtattgggtgcgttcgtggaaaaaactcacttcgtgattcgcgcggcgaacttttgtcacttaatgccattattggcacacgtgggtgcgatgtttttgaccgaaatgaaaaagttcaaaaagctccaaaacatgatttttggacatattggagtgtattgggtgcgtttgtgccaaaaactcacttcgtgattcgcgcggcgaacttttgtcagttaatgccattattggcacacgtgggtgcgatgtttttgaccggaatgaaaaagttcaaaaagcaccaaaacatgattttttgacatattggagcgttcgtggcaaaaactcactttgtgattcgcacgacgaacttntngtcaataatgccatcattggcacacgtgggtgcgaatgttttgacccggataaaaaaagttcaaaaagcactaaaacatgatttttggacatattgcagcgttcgtgcaaaaactcactttgtgattcgcg

SEQ ID NO: 51654 - DNA, 5076 bp, Oryza sativa
  unsure (1)..(5076): unsure at all n locations
gcagcccgattntttgacatattggagcgttcgtggcaaaaactcactttgtgattcgcacgacgaacttttgtcaattaatgccatcattggcacacgtgggtgcgatgtttttgaccggaataaaaaaagttcaaaaagcactaaaacatgatttttggacatattgcagcgttcgtggcaaaaactcactttgtgattcgcgcggagaacttttgtcaattaatgccattatttgcacacgtgggtgcgatgtttttgaccggaatgaaaaagttcaaaaagcaccaaaacatgatttttggacatataggagtgtattgggtgcgttcgtggcaaaaactcacttcgtgattcgcgcggcaaacttttgtcaattaatgccattattggcacacgtggctgcgatgtttttgaccggaatgaaaaagttcaaaaagcacgaaaacgtgaattttggacataatggagtgtattgggtgcgttcatggcaaaaactcactttgtgattcgtgcggcgaacttttctcaattaatgccattattggcacacgtgggtgcgatgtttttgaccggaatgaaaaggttcaaaaaagagcaaaacatgatttttggacatattggagtgtattgggcgcgttcgtggcaaaaactcacttcgtgattcgcgcggcaatgtgaagttgaccctttgagggtgctgacacaaggaagggcaatgttggtgtcagaattatgcgaaatgaaagagaagacacaagatcagggagaaggaggacatgcttacctctggaatttcagatgagagtgccattgcaagctcggagaagctggaagaacaaagggtgaaactgcttggagttggcccctagaggggttgatggctaggaattgctacagtagaaggctgtggcggaaatccggtgggaaggcgaaagagctcagagcaacgggttaatatttgtgggtctaacggttaagatttggaaagcctcaatagtccgcagggtcagtcgaagcaaattctattgtactttcccaagtacagcggaattggggggcatgtgtgaatagaaaaatctggcagcagaagtcagatggacgaaaggaaatcaagacagattcggtgcgaaaacatgttgggttcaagattgaatcatgcatcggctaggaaccatatcggccagcaaccaggaccgaccaagtcgacagatggttaagcccgccatcacaatacgactcgggctcagcatgggcctaaatttggaacgaccgtcaatgccaattagagatgaaagctcaatgagtcagtttggttagttttggcaagagaccgccatatatggtcttgtctgtatcttagagtttgtccgtgatattggcccgggggcctgtggtatagggggaaagaaagcccttcccgtgtggcgcgtatgggcgagccccctccccacaaaggggtcgtgcccacgcatagggagcagcggcctgaaccccccccccccttcgggctcagggtacctcgtcatacctctcgggcccgaggggttgaaccgtccccgaggcccttgctcggccgccacatggcgtccatgtgggagccttgagcgggcgtgagcaccatccgccaggcgcacttatgagtggtgcggaaaccacccccgtcacatctaatgcaacgtggcgtggcatgcggcgcaggccgaccgacgtgcgcctgcgaccaccctgtgaccggtctatgaccaggcgatggatggatgggacaggcggaattgcaccgacgcgctgacttgtgtcaggcggtgaggggctaggtatgccctgtcccgtcatgtgcagtaggaagcccagcgtccctcgcccagttgacagtggctttaaccggtgatgcatgtccggatcggtcctcccaatgcgcgtgagcccacgaagtcaccaaacatttaataaggaatgatgggggatgtcccccgtgttagccggagggattcagtgggggccacccgagattagccatgtggatcgcttccggcccaaggcataagatgtattttaatatagacaatgtcggccctctcccgatgggagaggacaggagcgacgcgtgtggtatccccttcatctataaaaggaggtccctgccccacgagtagagagaggttctttgaaaaaccggattctggacggaaggctggcctagccctagcttgttcacccagaatctagagtccttgtaaccatatgaagatcatcacacacataggagtagggtattacgctcgatagcggcccgaacctgtataacccctctctctctctctctatctctctctttctctctctctctctctctctctctcgccttccaccacgtgagcccgatttccgcagatccatcgcgattgcgagaaaggatactcctcagcattgctgtcacgccctaaaaatcgcttaatttaaaaatacattgtttaagtcatctttagaaattaaattaaaagcctacaagctaaaccctaataatttaggaaaaatttcaacataaaaataagctagataaaattttattaaataatttgcttgttcctctattttctagaattttctgggaattatttgagcaagggaagtatttttaataattgaaacaatatttcacaaattattttcattcaaaaagtccaaaaatcccttccttaaagccgttgggccaattttggcccaactcctcccgtcagccgcgcggccgagccggcccagccaactcagccggcccagccagcccgccagccctccccctcctgtggagaccgacaggtgggccccacctgtcgggagctccttcaacctccggccggccatggagccgagcccgagccgccccaccgcgccactttgccgcttcgaatccgcctcaatccggcctcgattctttcggatttttgaggggtttttatcctctcgttctcctctatctttacccccaaaaatcggagcaaatcgttgagtattttatccgagtcgactcgttttcgagtttatctctaaaaccgagtttttgattacccgagtcgatttcttgcgggaggagtccgatctcttccatccaaggctatatataggaccccctagttcccctctttcgtttgcccctattaccaagccttcccgtgctccgtagcttcgtcgccaccgccggcaagcaaaccggcgcagcggtccatctccggtgccgcgcgccgacgtcttcatcgtcgtcgccggtcggcgtcaccaccgttgggtgtgccgtggtgaggggaaagctcggcaaccttccttttccgtcaccggtcaccggagctccgctggcccgtgcaagccgagcccgccgccgccgcccctttgtcgccgccgtcgtcgtttgtcgtttgactcgagggtgagtaccgtcgggttcgtctcgtcgccctctacgtgtccgtgtcctccaaattcgcagccgaccatccaatctccggcgagcttgtcatcctagccggccaccattgatgatgtcatcatgacatcatcggtttttctttttcccgattttctaatagattaaatcttcagaaaatcataactaaataaccgtagatccgtttcaggtggttcaagttgctaaatttttctaaaatcaagatctacatgttaaaaatatccacatgtactgtttatgcttgtttttgtactgctttgttgatttttgtttaattgctttagtttccgacgttccggaggagagtgtttccgttgaggaaggttccgaatcgtttgcggaagctcaaggcaagtcacatagatcccaaacaaccctttgagcatgttgaacccgtttaaagctattattttatttcaactatgcattattttcgaatgtcatcgggtggtgaacctttcccagttaattattggccgaagatgactttattttcctatgggttataatttgattagcgtgaaccttatatattggattggttcaggtaaatgctatatgtatgtttgcttagccatgcctagaaacattagctaactaaaggggttaaatataaattatattatactgtgattattaatgatggttataataaatggtagctcacgatggtgaatcgtgtgatgttaattaattgataattaaaacctggttaaggtgggttgtgagcatatggtgttgatggttgtgctcatgacaattaaggactggttcacgagctactgttgtgaaacatttatcgtgccaaccacaagccagcgtgggcaacggctttatcttttgtatagcatgattcattatagtgtgccagactgtgaagcggcgagaagtccgtgggggtcgctggggagtccattgcctctggttttgagggggagattatgatccaggaacggtgcattgtggtgagttgtgttgtgcgaggggtattgtcacagctcttttccgaggtaccgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtcccatattattaatcaatggtaattgtgataattaatttgactcctggtttggaatggtatattcctggtgtggaggttgggtttgttcaaccggggttagttgttcaaatgaggttgggcctatgcaacacgggtgtgttgtatggtgtttatttaatattgattaattatacaactgttttactattctcttgaatatttattaaatgttgtttatgcaaatgagctatattatgccatcctttgttatcctgtgcacttgcatatttgctgtgtggcttgttgagtatgtcatatgctcattcttgcaatattcaatcatcagaggaggagtatctcagcgaaggtgatgacctggaggattaagcttgttcttggttaagatgcctgtggagtggagtagccatagctgttccgtagtttgttttagttttattttttccgctgcgtagaat

SEQ ID NO: 51655 - DNA, 886 bp, Oryza sativa
cgtctccttcctcccgcccggtttctctctctcccgtgcgaaccctagctcgctccctcctccaaatccgcttgattcaattggccaattccaaaattgattagggggttttaatccccattgattcctcttcaattccccccaatttcccccttgaatggcgcccccaattgtcaggaacggccgcgcttttcccggccaccaaccatggccgccggccgtgcttctcgtcgccgttccgccctctcccatgcccggctccctcccccatcctataaaatagaaccccctctttgcgttctaccgttttagtctcctcccgagctctcccgtggtccctagccacctccccgccgtcgtcccctctctcccgtgccgccggccgtcttcagccgcccctgccgccgcgttagcacgccggccggccgtgccgtcgcctcctccagcatcgcagccgcctcctcttcgccggcttgccctccgtttcccgcggagacccccggagctacgttcccgccgtcgcccttctctttccttcgcgccggctgcctccagccgcttctccctcctcgccggagcgtcatccggtcgcgccgtcgccgccagcagcgtcgcagctgcttcccctccaccggcgtcgcctccgtttcacgcggagaccaccggagacgcgtccccgccggcaaccagtggcattggtgccactgtactccctccagccggctgctgtccctcgtcggagcgtcggccgacgtcgccgtctccttcgtcgacgccgtggcatcgtctccttccccggccacaactcggtttcgccggaacaccgccgtgtcgccaccaacccctcgatccgcctcaccggagttgttcggccgcccgtccctcc

SEQ ID NO: 51656 - DNA, 8527 bp, Oryza sativa
cacaactctcggagtgaagagtacttagtgacaaaggtcaaaagatgactgataggtgatatcgaaaaagatgtttattaccaggcaaagaagtaggtcgaaaggtgattgataagagaaatctaaaaagaatacgtcagggctgaatgtgtaaaggaatactttgaatgctaaatgatgacaaacatggtatcctagtaatgacaagctagtgttgacgcatgacatgaagtggtaacttgtatgaggttgactccaaagatacgagttataagaagttctggaactgaagccccatcttccaatgccgcatcccagtcgaagtcagctagaggtacaaccagggaaaagtcaggtgaagagaagattccatctgcaacaggagatcgagccaagcagtccagagtggagaagttttgttaggcaagtttgttatagaagacggagcggaagaagttagacaagaagagaagaccgcccaacctatcttcttgctagcctcctcgaatctcggggacgagattcttgtaaggggggtggatttgtcacgtcctgataaattcatcccgaaattaaaaatcattctttaaaaggaataatagaattaattaaaattcgaaaagaaattggcaaacactaaaatacgtgcaagaaaaattcaaatgtggcccggagaatttttgttaaattctccttggtctaaaaggagccctcaaattttacttgaattttcagagcaccggaaatatttataaaacaacaacaacatttatcaaagttcaataaaaagaaaacctaaaaatccctcctcttcctcctttgggccaagcccagtccgaagtcctcctctcctccctcttttctctccctcctcctcttgggcccccttcccctcgggccacctccctcttccctctccctcccgggctgcctctctcttcccctcccctcccggcctgcccggcccaggccgcctctcactcctctcttcctgggccggccgccggcccaagccgccccagcccccgagccgctcccctcccgcacgtgccgcgcgcgtgcgcgcgctgacgccgccggccgaccgcgtggggcccccgcgccaggcgcgtcttcttcctcccgcccggctcctctcactcccgtggaaccctagctcgtttcctcctccaaatccgccccgaatccaaccgttccttccaaattaattagggggaattaatcccctttccctcctctctctttcccccttaatttcccctttgatggtgcccccaatcgccgggaacggccgcgccattcccggccgccttccattgccgccggccggcttttccgccgccgttccgacctcccccgtggccggctccctcttctctcatataaaatgggatccccgcactccgttctaccgtttaaccccatcccgagcctccccgtggtctctagccccatccccggccgcgccctccctctcccacgccgccggcgacctccagccgcctgtgccgcctcgcccgtgcgccggccggccgcgccgtcgccttctctagcatcgcagccgcctcctcttcgccggcctaccctccgtttcgcgcggtgaccgccggaggcgcactcccgccgtcggccttctcattcctccttgccggccacctccagccgcctctccctcctcaccggagcatcgtccggccgtgccgtcgcctccctcggctctgcaacaccgtccccttcaccggcctcaccgtctcctcgccggaaactcgccggaacggtgcccccgccggcaaccagtgacattggtgccactgtactccctccagccggctgctgttcatcgccggtgcgccgatcgacgccgccatctcctccttcgacaccgcggcatcgccttcttccccggcatcacctcctcctcgcccgaatttcaccggaacgccgtcgtctccgcgccggcctctccttcctcctcgtcggctcgtcaccccgctgcaccaccaccttcaccaacatcgcagcggcgtgttccacgcgtcccctcctccgctcagccgctgctgcctgccatcatcatttcatcgtcgtctccattcatcctcgccgatcgacgtcccatcggttgcccggctcgtcgtctcgcggcgccgcctccgtcatcgtcatcgtagcggcgtgttccacgtcgtcctcgtccccgtgcagctgctgctggctgcccctcgtcgccccctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtctccgtcctcggccccgcgtcgtcaagcctcgtgccggccgcgtctcgcctttgtccaaggatcgccgccgaagtcgttccctcgccgttcgcctccgtcgtccccgagctgtcctcgccggtcccgttcgtcgttgtcgttcccacgcctcgtcgcgtggtggtaaggatccgtcctctcgcttccccgccctcgtccttccggtgtcgccccgtacccgttgtgcggtcgtcgaccccggtacccgtgtaccggtgtcggtagtcgttcacgtgtgcgggtggtgaccgggtagtgtccgtgttagtgtgcccgctcggtagccgcgtggtttccacgggtgcaggccgtgtggtgtctagtggagtccgtttgtcggccactcgcctcggttgacacacgggttccgcttccgtcgacccgtggaccgtctctgtgtactcggtctaccgtggtcctttaggttgacatgtggggtccgcatgtcaacggcgcagccctcctgtcttttccaggctagcgcttacacctgttttatagttgcaaagcttaattataataattcgcaaatctccatataacagcattaaacttcggatgatcatatcctggtcatacgagctccgaatcgacccgttcaagtctcttaatgtttgttataacctaaagaaccctgtgctttgtttttatgtattgttattgcttctttataggcttgtagctttgcttgtgtgcttcgcgtagcttctgtcgttccggaggttcccgaagcgtggttcgcggtcgtcgccgaaggatcggaagtccgttctctctgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgctgattaattaggcaacattaggtggttttataactttagactttggggattctcatatcatttggacactatggaattgttggtttatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggttggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaaacaactaaaatgtggaatggttggcctgggttggcttgggacgagctggaacccaggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgtttactgcaaaactgaacccctatattattatccccttgtacccccttgcattaattatgcatctccggtgtgacttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacagtccaggtgatcgacgacggccgacatttattagtaagaatttatctccagagtttagaaccatgttgatagagctattcaaagaattcagagattgcttcacttgggagtattatgagatgcctggactcagccgattgattgttgaatatcggctacttatcaaaccaggggttagaccacatcaacaacctccgagaagatgcaaagctgatatgcttgatcccgtaaaggctgaaatttaacgattatatgatgcttgttttattcgtccttgccgatatgctgagtgggtttctagtatagttcatgttatcaagaaaaacggcaagatcagggtatgtattgatttccgaaacctgaataaggctaccccgacagacgaatatccaatgccagtagcctatgagctagttgatgctgcctcgggacacaaaattttgagttttatggatggtaatgcgggatacaatcagacctttatggctgaagaagatatccataagacaacttttaggcgtcctggtgcaatcggctcgtttgagtgggttgtgatgactttcggcttgaagagtgcttgggctacatatcaaagagccatgaattatatatatcacgatctgatcggctggttagttcaggtctacattgatgatgtggttgtaaagtctaaagaggtagaagaccacatagccgatttaaggaaggtttttgagagaaccaggaaatatggcctaaagatgaacccgacaaagtgtgctttcggcatatcggctggccagtttttgggatttcttgttcacgataggggaatcgaggtaactcaaaggagtgttaatgcaatcaagaagattcagcctccgaagaacaagatagaactacaggagatgatcggcaagataaattttgttagaaggtttatttctaatttgtctggaagattagagccttttacaccattgttgagattgaatgccgatcaacagtttacttggggggtagagcaacaaaaagcgttggacgatattaaggaatatcttagctctcctccagttttgattcctccccagaagggggtaccttttcggttatatctgtcggccggtgagaagtcaatcggctcggtttgattcaggagcttgaagggaaagagagagttgtgttttatctaagtcgtcggctcttggatgcagaaactaggtattcccctgtggagaagttatgcttgtgcttatatttttcatgtacaaggttaaggcattatctatagtctaatgaatgcactgtcatatgcaaggccgatgttgtcaaatacatgctatcggccccgattttgaaaagaagggttggaaagtggatattttctttaactgagtttgatcttcggtatgagtcgggcgataaaggacaagctatagccgattttattgtagagcatcgtgatgattcaatcggctcggttgagatcgtaccgtggactttattctttgatgggtaagtgtgcactcatggttgtggcatcggcttggttattatttcccctgcgaattttgagtttgcttatactatcaaaccgtatgcaaccaataatcaagctgagtatgaagcagtgctcaaagggttacagttactcaaggaggttgaagccgatgctattgaaatcatgggggattctttgctagcaataagtcaattggcaggagaatatgagtgcaagaatgatacattaatggtttataatgagaagtgccaagaattgatgaaggaatttcggttggttatctttgaagcatgtatctcgagaacaaaatattgaagctaatgatttggcctagggggcatcggggtataagccgatgatcaaagatgttaaggtcgaggtcgcagcaataacagccgataattggaggtctgatgtgcatcaatatttacagaatccatctcaatcggcttctcggaaattaagatataaggcgttgaagtatactttattggatgatgagctctattatcggacgattgatggggtgttgcttaagtgtttgagtgccgatcaggctaaggttgcaatcggcgaagttcatgaagggatttatggtactcatcaatcgcctcataagatgaagtggttactttggcgttcagggtatttttggccgacaatgctggaagattatttcagatattacaaagggtgtcaagactgctagaaatttggagcaattcagcaagcaccggcgtcggctatgaatcctatcattaaaccatggggtattgatatgatcggaatgattaatcctccatcgagtaaaggagataagtttatattggtggcgaccgattatttcaccaaatgggtagaggcgattcccttgaagaaggttgattctggggatgcgatacattttattcaagaacatataatctatcgatttggtatccctcaaaccattacaaccgatcagggttcaatttttgtatccgatgagtttgttcagtttgccgacagcatgggtgtcaaattgttgaattcttcgccatattatgcacaagctaatgggcaagctgaggcatctaacaagagtttgaacaaactgattaaaagaaagatttctgattatcctcggcaacggcatactcggttggctgaagcgttgtggtcttatcggatggcttgtcatggatcgatccaagtccctccttataagcttgtttatggacatgaagctgttttgccatgcgaggttagaatcggctcaagcagaactgagctgcaagataatttaacagctgatgagtattgtaaccttatggccgatgaaagggaggacttggtttagtctagattaagagccctcgcaaaggttaccaaggataaagaacgggttgctcggcattacaacaagaaggtagtacctaaagatttttccgaaggtgaacttgtatggaagttgattttgccgattgggactcgggatagcaaattcggcatgtggtcgccgaattgggaaggaccattccaaattcataaagtggtgtctaaaggagcttacatgttgcaaggactcgatggagaggtttatggacgagcgctaaatggcaagtatttgaagaaatattacccaagtgtttgggttaatgcatgatcggctgatgttgttgatatatgatagccgatgtgtttacatcgccttgagatggctgatatggttatattgcccttagctgtttttcgtattgtaatcggctgtggtttgccgatgtacaatggccgatatggttatatcgcccttagatgtttttcatattgtaatcggttgtggtttgccgatgaataatggccgatgtgtttacatcgcccttagttgtttttgtaattttctcaatgcttttgacattataaaatcagggggcacatatatacaaaacaaatgaaaatttttgagcaaatttagaagttatattaattggcacagatgattgtcaagacagtaaagtactggagtatcttagccaattacaaaaatttctaagacctattatacaaagagtcactgagacaaatagtgctggatagccgatattgccctttgcctaatctgttctacttcttcaatggcttgggcgtcttgagcatcggttccagggatgattttcaaagacttggtcagctcagcaacattcttgatagccgattttaatcgtgacttctgttcttcaacggattttgggagatcggccagctttttatgttctatatccagctcggcattgcgttcttcaagct

SEQ ID NO: 51657 - DNA, 12263 bp, Oryza sativa
atttgagggaggtaaggagctagggttcacgggagagagaggaagtaggccgggcgggaggaggatgatgacccggcgcatgggacccacgcagggagtgcggtcagcgcgcgtgcggcgcgcgtgaggggtgtgcggctcgggagtctggggcggcttgggccggtaggcggcccaggcgggaggggaggaaaagggagtgggccgggaggggaaggggaggcccaagagaaggagggagagaaagagagggaggaagagaggacttgggccgcgggccgagggagagagaaagggaggactttgggccagacttggcccaaaggtggaagcaggattatttttaggttttctttttattgaactttgataaatgttgttgttgctttataaatattttcggtgctctgaaaattcaagtaaaatttgagggctccttttagaccaaggagaatttaacaaaaattctccgggccacatttgaatttttcttgcacgtattttagtgtttgccaatttcttttcgaattttaattaattctattattccttttagcgaatgatttttaatttcgggatgaatttatcaggacgtgacaacctatgtcaatttcttccaaatcatcagccgacacaaaaccctgtccttgcttgtcatcgagatcatctaatgtgtccttagtgtagacattcgaaccctccacgacgccctcaaaataatagcttgggttctccatcttcaattggctgtatctcagaatcggacacttttagaaaatctccatcccaaacttttccagataaacaatctagaccatccatctcccaaagagctaaatcggcactggcaacattgactgacctgtcggctggcacaatttcaatcttgtcgtcttgccactgaatcaagcattgatgcatagttgaaggaatacaataattggcatgaatccaatcccttccgagcaacaagctgtaagaacccttcccatcgatgacaaagaacgttgtagggatggttttgttgctgactgtcagctccacattcaaaacccctttggtttctgatggattgccgccaaagtccatgagcaccatgtttgtcttgatgagatctttggcatttctgcccagtttcctgaacgtggtgtaaggcatcaagtttactgcagccccaccatcgaccatcatcttggacatcggcttcccattaacgtaaccatctatatacaatggcttaagatgccgatgctctgtaccctctggcttctcgaaaactgcctgctccggtgataaaatcaacttagccgattcgtcttcaattttatcgacatcggcttgtttgatcccaatttcaacaggcaatgtgaaaaccatgttaaccgaagcagttacaacactttttcacttagccaaccttcttgcttcatcatccgtggcttcatcagctacaggaacttgattcttaacacgccactcctgcctcggctttgttttctttagccgatgattgatttcctgctgacttcctgaaagcgctccctgttcctcaatatttgaacccttctcttctgattctttgtaaagataccagaaggacaccattgagttttcctgttttcattgtcctcctggccacgaccttggtttactggacccaatctttgatgaacaggaaccattgtctgccttagccgattgcccctgctatacaatcggcttgagctctccgcaatatcactgcacccaggacagtcctcaatagatggcagccttataccttcattccaataaaatctaaagaactcgcaaccccaatgaggatcaaagccatcaccaccttcctcataatgcttctcctgctgtttgtcatacttcctctgatatttgttgataatcttagccgaatttacctgaaaccctcttgcacgacctccatcggctgtccagccagctgtatgtaccatattgacaggaaaaggattgccatcaaccttcatcggcctcttagaatcatcaaacttgattttgcctccttcaatagccgcttggactgctgcctgaagaccttgcaatcattagtagtatgagacccagaattatgccacttgcaataccttttcttgcccaattctttagccgatggaattgtgtgaccagcgggaagttgaatctgcttttctcggagtagcaagtcaaaaatcttgtcagccttggtgatatcaaagtcatacctctcctcttttctagaattcttcacccattggtatggtataacctttttgctccttacccattcgagtgcagctatcttagaatcatcatccccatcatccgatccatatatatatacatatatatatataaggacaaacatgattaacctttctagaattcttcctagcctctgcaaacctctgttcatgcaaggttaccttctgtgtaagatgtgacaagctttcgaagtcttcagatgagaatttctccctgattggagcaatcataccctgaaaagccaaatcgactaactgggcatcagtcaaacttaagctgtagcacttattcctcatttctctgaacctctgaatatactcatgcacaggctcatcatgtctctgcttgattgctgtcaaatcagacagtttcatctcatgtaccccactgtagaaatagctgtgaaaatgcttctccaaatcggcccaactgttaatcgacccatatggcaaagaagaaaaccaagtgaaagccgatccagacaaagacaaccagaacaacataaccctcaaggcatccatagccgatgcttcaccacactgagataaaaatcggctaacatgttcataagttgatgtgctatcttgccctgagaattttgaaaaatctggaactttgaaccgattaggtagaggaactctctcaaaccattcagggtaaggttgtcagtacaaatttctagcaactttcggcctaagcccaaactgctccttcatgacatccgcaattgtcacgtcccaaaacgaccctaaaatatatcctttaaattatgcccagaataaataaaatccttgtgaaagcctccaaaaattaaaatatgcaaagttaaaagtcaaataaggcttggagaatttttgtatatttcctaaaagcctaaaatgtgtaaataaattttagtggaattttcagagcacaaataataattattaagaaataaacaaagttaaaaaggttttataaaaagaaaaaccctaaaaacccctctcccctctaatgggccggctgagcccatctccctcccctctctctcctctcccccgcggctcattcggcctctccccgcgcgcgcaccgctgacgggcgggcccgcccgccaccctcgctgacgggtggggcccacccgtcatccccgacctcccgccgctcccgccgccccgcccgtgccaagcgccaccgccgccgccgaatctgccgcatcccgccgtccccgcgcgcaattaagtggggggaattattccccgtgatcccctccctctttcctccctatttttccctctctctctctcgcattcaaatggccggatttgctcccgcaaatctcgccggcgccattgatggcggccgcacctcccacgccggtttccttccccgccggccgccctctctcccttccaaccctatttaaaccctccccgcaactctctcgcccgtttccgccacttgccgcaccttctccccgccggaaacgagctcgcgccgtcgccctctctctcctccgtcgccgacgacctccggccggccctctccgctcaccgggaccatctcccgcctcggcatcgccttctccggcttcgccgcaccgccgccgaccccgtccaccacctcgccgagctcgccgaccgccggaacgccgtcgtccccatccacccgagccgcgccgccgccttcctccgctccggccgcctcctttgtcatcgccgtcgacccggggtgagccgtggaccaccgcctcttttcccccttcccttcccctctctcggccgccgctctgccgtgcctatggccgccgccggcgaccataggggcgcgggcgccgcctccgggcgcgccgtgtggccgccgagtggggcccgaccgtcagccgcccgcgccctcgggtgcggctgacgcgcggggcccacggcgccggccggtgtgagcccgggtacgcccggtccaccgtggaccgtgatgctgccgcgtgggccccactcccgtggacccggtccgcgcgccctcacacctcggctgacgcaataaaccctttttaaattaaaatttaaatgcagaaattcgtaaatattcatttaagagcagataaacttcaattggccataacttggccatttgaactcggaattggaccgttcaagtctctaatttttccttaagaagtcaagaacctatttgtgtgctttgttcttgcttgttatatggagtttattagagtaaaagccttttttcctttccgttggtcgtgtagacgctgcagcttcagaagatccgctccacgtggaggttgaagccgatgtttgggaaagcgagcaaggcaagtcacatcatctttgaacatattggatcccagtttgtgaaattattttgatttaaattaatgcattaccgctttatttaaattcccgcgttatcactattttatttagccatgcctatttgcctttgttatgaccttattattattgttattgtgattattaccttgttcaccctagaataaacaaaaccccaactagtgggtactctattcatggtaccactagtatgaatttaggtagatgcttcgctgtttaattaggcaacattaggtggttttataactctagactttgggaatattcatatcacttggacattatggaatggttggattattgtggaattggatgcacaccttcccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgggctgcggcccggtagtcgagatgtcatggcacagggatggtgtcctgctgctaggggctcagtcctgcctacctgtcctagaggtttcggccgtaggtggggttgggtcggtactcttgtctatggctaggatgggttggaaactatgtcacgtcttccgtccatatgccgtggtggtatgtggcacgtggttgcacgtgaggaagacgtgtcttgtgggtaaagatgtacacctctgatcagagtacaatcaattcgaatagccgagccctcggttatgggcaaggctagcaatttacccaagttagtgttttaaattcttaaaaacctgcttaataactaaaatgtggaacggttggcctgggttggcttgggacgagctgggacccagggtcgggttgcaagttcggtctgaatcatcgtaggccttgggttaaggcaggttcgtgtgggttcacggccttgtttaataatattgaattgttctaggatcgtgttttaaaagtagctttaagcaactaagtgtcttttaaatgctgtttagtgcaaaccctaaccccctatattataactcctttgtactcctttgcatttattctgcacttgtgggtgtgtcttgttgagtatggtggttgtacttagtcttgctcaatttttcccaaactcagatgaggagctcctagatgatgaaggctttggtgtctagctcgtgcctgctgtcaagcgcctgtggtcgtcgccctagtcatccgttgtttttcgttgtcttcttgtgtgctggtccttcgttgcccatgtaataattaactatttacgcttccgcttgttaaactctaaattgtatcaacttttggtgttccttgcctcctgggacaaggaataatacacgcacgcaaggaacgcctgttgggttatttccagtcgtgacagcaatcaactcggcccatggttgttgctaaggtgctccttgaggttgctgtggcatgggctcaaattgattgtattgaggaacaaactggggttgagccgatcctgcctgctggtattgaacttgcggtgatggcggctgttactgataattcaaattgcccccctggtaattttgaagatcctgctgaatattgcgcaccaaatgcttgggaataacttgaggtatcaccgtgccatctagttgtacatgatgaaccaaatgctccgggacaacttgatttgcagcatgctgcacaggctgaccaccaggtgtcgcaaacctagccgatgcattcattaagccttgttgctggatccgctggacaacctgctgccttagtggcgtctattgaattggctgcaaaacctgccgtctgtgtggcatatgctgagctggttgcacaacctgttggattgggggtgtttgttgaatcggttgcacaacctgctgccttggcgttgtttgctgaatcggctgctgctgggttggatcaacggtatgttgaggaggtaagaacatagatgcaacctagtcttgtgttagccgattcacgttctgtccgctgtgttgtggttattctctcaccagcaaacggggattaaccaattggcctggtgccgacggagctgcaggaggtgcgggagccgatactggtgccgtcagctgagccgatggtgcattgtgagggattgactggacaactggttgattatcggtgattaatggccgataattcgggaaccctcctcctggtagataaaccggtcctgtagcttgatgctcagccattgaaccatcaaccattgattttaccatgcttgccaaagtattggttaatatgccagattgattgatcaaagcatggtgtacaacatagtcaacctgatcttagaagttgttgaactacaactgtgctgtattgctatcttgattaacacctccaccttgaactccctgagcaccatcaccttgaactccctgtactccttgagagttgtcaccttgatttccttgagaaccatatgtagcacctttatcactcggttgagccgagccatctggagcttgtttcacctctccatccttagaagaaccagtcctaggaacatcagcaactacctttaccttatacttctgcaccaccgttctcttgcgcgtttgcataaatgaacttaagaactggttacgtgcttactgcatcattgcttcaaatccttcttttgatcaggtgtcagcttgtctggagtgatggtcacgatgttgctctcattaacctcggacaggcctaactgctggatcttctctttaacagaaccggggctagccgaggacggtgatgctggtggcttctcctccatggagaaaaactgttgtcgcggttctgacttcttatcaggtccaactaggcgtgccaaaagcgtgttgatgaaaaacacgaggcttgggagatccgctttgttccagtgcaggtccaaaactcgcctccgggtatgctaacgtgccagttgatttgatcctgcaattaacaagaaataaagacaaagaaaccgcggttaaacttataaacgatagacgatcggcaaaaggccgatgatatatcatttatctttgagccgatgtcatatatgtatcgatcggcagtcatgaataaataagaaagaactaaaactactcgatcggctgcagatattaacgatatatactccttatatcgatatatacttaaatcaagtgattgggatagatcggtcgccatgccgagacagtataaatcacttagatcgaaatatatattaataatgggactatatatgttcatagcatagccgatcagatagatctagcatgtatcggctagtactccgatacgactctatactaagatattaaagcaagtagaatataccaaacaaaagcctaatatacttaaatgcaacaagatctcaacataaagggcagatttaacatgttaataaagcacataaaacaaatatagttaaatcaggtaagatcagctgaaactccgatactaccccaatcggcaaccaagaagtaggctagagattgagattctaatcacgactcataagatcaaacaactgatgcagctataagtatgaagggaagaacaatatctagacaatcaagccgctggaagtttcatagagtggtggatatcttatataatctgaatcaacatcgatatttaacctaatcggctgccctctatcgacagatgttagccgattgtaagttaaatagagatattgctagagattatgtaagatatatgataactcgacgaattatataaacaagattagagtatcattgagatggaagcactaatcccgagaacgcaagttgtcataacaagttttacctcttgttgaagatcgaaaccgatgcagctcaaaccaaaagtaagaactcgtcgaaataaaactaaagcaaaaagggtggcgatgcgctgagattgtattgaacgtgtatgttcaatgattacatggggttcagggtctatttatacccgagaatcacaaactatgtccataccggacacgactcttatctctaacatactctaagataccataagtctttgcggcagacttttgcccaaacatatctctaaggaaattacataaaatatcctaattaatagatacaattgccttctcaggactctatccatgcatggcaatcgtcttgaagcatatcaactcaacccgatgtcgcacaccaaatcgtatcgtcggaatcggctgtatcggcttacccagtctgatcggactcagccgattctgatcgtaaccgatttggactccaaccgattcttactgtgtttccgcaatgatcttcactttcgattccgcttcgattcaatcttcttctccgatactaatattaccaaactttaaaaagtagggtcaaattggtagctagatttaaagcggggtcaaataagcaattgccccaaaaataaaaaatgggtgcacccctataagatttaaaatcggcaccaatgggtttctctgcagtagtgagtataaactatgtttagtaatttatatcttaacgatccatcttatcaatttagtatttcatatttttttaagtacaagtttaacgtacacacaacacaatcgtgcaatcgctcacatatctaccaggactcgttttgtgaagattttaaaaaaaatttatagctatttagattgcatgtatgcaattagggccatgtttagatttcaacttttttcaacaaatttctaacttttccgtcacatcgaatttttctacacacaaacttccaactttttcgtcacatcatttcaatttctttaaaattttaattttgacgtggaaatcacaacctaggtgtgtatatgtactttggtgaaatactttctgcaagcacgaaatcctatagacacagctagcatacgaatcataagattgaacagagctgatcgacaaaagaaataaagaacggggaactacgttctgccgcaaaggatgccgtggcagcatcagctttcaacggcaagtttttcccatcccgcggcagacagtcaaaacaacggcgggtcgacaagtcaatgtttttgacacgacgaacaccataaaactttaaaacgtgtttgagagttgacgaaagaaaaaaaaaacatacccagaaaataacacaactattagctatgattaattaaatattacaacaattcttttaaatttaaaatttaaaaatacaactttttaaaatttcttttgtaaaagaaaatatcgtttagtattttggtaagcgtgaggttgaaaaaagtaatttttttctctgtgttgttgctgaacgcaacctaagatagcattaaagaagtactcatgggacaaaactttaacgaagtaaaactgaataaaaggatgcaaagtgcaaaaactaaaaagagtatcagtgactaggatctaatttttcaagctgttttcttgaatttagatatatatataaaaaataacttatctttaattaagaactcaccaggccatgtactagttggttgtcctcatgcttaattaatttggttaatctcatctttaatttggccaaaaacttgcttgctactccatatcgttatcaaccataacgaatgagattaagcaaagcacgagggtcgttgttgaagctgagtacatatttgaccaaattttttaatgtttagtggcacgtacatatatacctacagatacatctctttggcatgcgcacagtgttgtttatagagagagagatgcgttctagcgggatcagcgtaattgttgtcgttcgccacctggcgtggctggtgctaattttgtgctcatggccgcgggttgcagctgctcaggctcaacaagcaccaaaaactgatccagtcgaaggtttgtattgagttgttttgtttttccccatataaatcgcaggagtatagtacacttcggttgatatatggtgtcctctcttgccgcattgacacgagaagagttggaggaaatttgattcattaatcgcctagttttttcatctacatgattagtacttcatgacgagttaaccacacagcggccgccctgaacacgatcctagggagatggggcaagaaggcatcgtgggagtggaacattagcggcgagctctgcagcggtttcgcctctactgaaatcgactgggattactaccccaccatcaacccgttcatcaaatgcgattgcagtttcagcaacaacaccctctgccatattaccaaactgtacgtttgttttcatcagttgtgcaacatgtatctcgatgcggtgcctgaaaaatataagcaaaggaacatgtcagattatcgatacgtctgttttcaccagttgtgcaacatgtatctcgatgcatgcagtgcctgaaaatataagcaaaggaacatgtcagattattgattactagtatttccaattcatagagccatcacatcggtttatcctaaattgggtcctccggctccagtgacctttctttaatttgcatcttatttaggcaaaaccaaatatatcccaattagcacaattctcatatataggtattgcatgtctattatgcaggagggtatataaattgggagtagttggtcaaatacctgcagagctacagaatctcacccacctagagtatttgtatggtatctaagtcttttctccttaatcttgataactaattgttacactacagattaaggttttgccgtaaatataaattatattccatgttctttttgtgaaaacagacagcttatgctttttttctgctaattgacctagtgtttctttatgttgtcttcaggaactttaattataattacttgactggtgccattccatcattcattggaaaattcagttcaatgaaatatttgtaggagttacacatcacattctagatttatgtactatatccctttcatattataagtcgttttcagttttccaaatcaaatttctttagctttaatcaagtttgtaaaaaaatgtagcaatatttttctacataaaacaaagaaactattaaaatgttttcaatgttagatttaataaaactaatttggtgctagaaatattgctatattgttttataaacttgatcaaactttaaagaaatttgattttaaaaaagtcaaaacgacttttaatacgaaatggagagagtaccattcaatggttaatgttttttcttaattctgtttcatcatttgaagggcattagcttcaaattcactgtccggacaacttccaaaggaacttgggaacctcaccaatcttctctcgttgtaagataatctttcccatggcaaataaatcatcaactatttacttggactgcctcacccaatataatacaacaaatattaatcgcataacttctcaacaataataaattaagtaataaaaaaccataattgcaaaaatatcataaactactaaacaacatgtaacagacaagtcagtgcaattccttttccatgtgttgcatcgtttgatcaggaaaacacgatgccccctttcttctattatatagttgaactaaaaaaa

SEQ ID NO: 51658 - DNA, 919 bp, Oryza sativa
ttgtaggagagcatcagacaatggattcatagggaagatacctcattattttggcagcatgactaatttagaagatatgtaagattaattatgtatattaacttgttaacatatcattcgctctatcctaatcagagacaaatgaaattttgcaacataaattttctgcatatatgattttcccattcgaatttgaacaatataatagcaaacatttccactcaacaaaattgcacacatctctatcacactaaatttatccagggggcatgttactacatcgagattttatgaaataaaaaaggaaaaaaaaactgttgatacacatacagcttactttaaccttactttaaataaatggtggcatgtattctttctaaagtatgagctttagtggtttcgaaggaaactcatttgaaggaccaattccagaaaatctgtctaatctgaccagattagaaaacttgtaagtatacttttttgtggtattgatctctcttgaagattgacaatgccaacgctgatgagttatttctgaaaaatacatgtgagcagacggattggagatatagtaagtggggcctcttcattggcatttatcagtaatctgacatctctgtaccaactgtatgtgatgtttttgcttcaaattaagtttacagtgtataggcaaatttgcaagttacaaaagttggatttcgttcttacacaggatattaagaaactgtaagatatcgggtgatctcagagcattagatttttccaagtttcgaacactaatatcgctgtaagtctcccaaccaccggctatggtgtcacatttcctcatgtagtgaaccatatgtactccaagtaatttatactatactgttgtggcacagggacctaagttttaacaatatcacagcccaacttcctt

SEQ ID NO: 51659 - DNA, 4048 bp, Oryza sativa
gtagttttgtgaagttactcaaaaaaaacccataaagggtacccagctatttaaaagataggagggtgactagagagtctctagggttgtgctccaccaagttgggaagctaaccacttgggcctctcagatgaatttacatgccaatgggctcattacaggtggcgtatcatcttgtttctgtaattcccactgactcatttggaatttcgaggtaaggccgcaaataatgtaaaagaggactccaagagctttctagtatgtaatatatatatatatatatatatatatatatatatatccgacccaaaacaaagctcgtatggacatttggcattcgtttgaattcaacactattgcaggtagcccaattggattacataacttgggcggcttgatctcaaggtttaggatcaaagacataatagagggggtgaataggattcctaagaaacatggtgtaattagaagttaaacttgctaaacaaagactagcctatgtgcctaggtttatcgcaagtgcaggcatgttttgtaccctagttgaagtcctaacaattttacagcaaactaagtattgaaaggaaatacaaactaaagagaggaaagtgataggaaattaaaacacacggcacgatgagttcttcccgaggtagtggggataggaaattcaaacacaagatacaagagtatagctccctcccatagtcatgaagtctatatgcgctatcatcatggtgattcttttttgctccagaaggtgaacccaaaaccttcacaaccacataaggtttcccacaaccttcttgagagatcaccggattgcctctgagactgactaggcatgccggaaagccaagagtagtaggaaaaaaccttcactagaagcccttagaaacaagactcttggatggtgcacagtaagctactctcaactcaaactagcactaaactactgaagaaaattataacaactagctcaatggtgttcttggacacgcccttcaattattgagctaaatagggtttccagaaacattagggagtcctagaaaagtgataaatatagccccaaccgagctcacttatagccattcgtagccattggagatcaagcagccagccctcctggtgaatctacacttcaatttgatgaaagtagaattggagatatctctcaagtatctcaattagagaatgaagctttaactcaacatttcactgagaatgagattaaagagcctgtattcaaaatggaacatacaaaagcacggggccctgatggttttcctcctgagttttaccaagttttttagaatgttgttaaaaatgatttgttcgctctttttaatgatttccataatggtactcttccgttattttcgcttaactttggtacaattatcttgttacccaagtgtgatgaggccatgaaaattcaatagtataggcccatatgcttacttaatgttagtttcaagatttttaccaaagtccggaatatttggtaatgtttcggatttgccatatccgttcctccaagaatatcgctcattgcctttttccgaccgttaccgcaccgctttaaatactaaccgtcgtccccgagaaatttcacaccgttagctccgttttcaccacttaagccaacctcgtcttctctctctccggcgatcccctcgacgcaccagacgatcccaaggcgatttcctctccgaccaaacttccgcctgcgatgatgtcaacttccgccatcccgtctgccgcgccatcgaccgaatacgcagaggtaagtacccatcggctagattctctcctttatgcagtagattggttcttctttgtcttatcttgttttcttcttctcttttcttgtttgcatctgtagcacttgtccaacctggtcgcaattcccagtttgtcacatgaacatcactactttctcggtccaatcggcaatcccgatcccactaagtttattattgctggaaccaataggatcccttttagattggccaacccaatcctaagtcactggaagaataccttcaagtcttggccttctcttgagaaaacttcccctgagaaaagctggtctgtgtggtataagcgtgtattagccagcaagcaagttcattgggacgaactaggaatcggccatgcccttgctcttacattagcaaattcggctaaggacaaacccttgatggcctctccagcctattgttggtccaacgcccttaatgctttcttgtttaatcaagggccgatgactcccactctgcttgacatcaccatgattactggtctagatgtgaccttatcggctaaccccatgagtttgaataccaagaatcaatttgattttaggaccaacagcataggtggttggtctggctatgtagccgcatatatgggcaaaggatctgccaccccccgagagcacactgcctttctcttcatgtggcttgaaaagtttctgttctgtggatcaagctgcggtcctaccaccaactggcagttcttagccgaagcccttgaaagcaagagacaattccctctaggcaaaatccttctcggctatctgtaccaaatgttgagtaatgcatcggctaagatagccacaggctcagtagtgggtgcgggtggaccatggtgattgctacaaacatggcttaatcttgtcgttatgaaggttgtgaatcggccgcctctgatagatgctgaattcccaaggctggagcccaccaccaatgatgacagggaagaagttacccatcgccgatgcctgtcgtatggtgaagctacatcaacaccagccgattctggagcaaagctatcggctcaactgctcaaggactggttctgcagtttctatgaaggcttccaaagagatgctcgagtctggtttccatatgaggactcagtaaactttgatctcccatcggacttcagatttgaagacatcaactctgaaaattccaaaaatccagagaagtcttctcggctgccattagtccatgcatccttcctgttggcattcaccaagggagaaacatacaagtatcttaggagttataccatccaatgagctcggccagacaattggaatgggatagttgccgatcggcttgttctttgccgataagatccagtgcagaggagaaatctgatcaacattgatgatggatcggctgctcaatatcctaggaccccctttgggtagtattgataacatagagctggcaaggttcaggagcaggaactttgaaagatggtggggtgaatggaagcaacatatattccatcagctagcctctatgtatatgacagatctattcccagatattgttcctcaggtatatcgttactctgtcaattctgttgtaataaaagttagccgatttgtacctttaactaatctcttcgtttattttgcagacaatagaatcttctcctcctcgcaaaagcaacagtggcagagatatagaatatgtcctaggccttctaccaaatggaggtggactagctcctcctgtcattggctatcatgcccccaggaccacaagtctgcttcaagagcaaatgagagaaccacccgatattcgtaagaagagaaaaaccaaggcatcggctattgatccatcggctctggctcccaagaagaagaccaagaagaataaacccaagccagccgatgacctgcctactttagatccatctattgagcaagcctgggatgaagaagagatcgaagaagatgtttgtcacaccctgaagttctcctcccaagccaaaaatttaatttataaatgaccctaagaaaatgccggcgcaaatcaagagaaaaccctaagaaagtaatacaaataataatcgaatctgacatgtggaatttttcttgagttctacatgtcgaaattcactaacaggatttttagtggaattttcagagccctagaaataattttgaccaattaaaattgagcataagcaatatttaaatccctggaaattcctttcttcctttttctttttccttttccct

SEQ ID NO: 51660 - DNA, 3743 bp, Oryza sativa
cgtcgccggtggacgtgcgcgtgccgtcacccttgccatggccggccgccggctttgtgccgagccgagccgagccaggccgtcgccgcaccgtccaatcgcccccgggccgatccgggccgtcgatcccgtggaccggtgttggaccatccgcgtggtcccggtccacggtagaccgaccacccgtgcgccgctgccgtgtgggccccgcttgccagcgccgcgcccccccccctttgatgacgtcagccccgggacatattgcgcaataaatgatttaaggactttttgttatagtaataaacacagtgaatcttctaaaattcataactaattcattcgtgctccgtttaagccctttcaagtctcagtaaatcaagaaaaatgtgtagaatccattaaaaatggttttgttccctgtttcagtagtcttatagcctgtttgcaatgttagccttgtatgtcgctagattccggttcttccgacgctccggtgtacttcgaaatagtcgccgaggttcctccagcagcagagcaaggcaagtcatgcttgtcacttgaacatgttgatcctatattgcaaatgctctattgtttttcttcaaatatcgcattgatttataatgttactatggggtgtttacctattgtcatagccatgctattgttataccatgtccctttgtcagcttggggttataacatgactagagattggactaggggttgcttagccatgcttagttcaactagtgcacagcggggaaaatccaattaatgtttagactgttggttctaatggttttgttggtttcgttccaccgctttggtgttggctaattaaaataaatcacatggtgggctgtgggtgcatggttttgctggtcgcacccatggcagttaaggaccggttcacgggatgccctagaagatcttatcgtacttaccacaagccagcgtgggcaacggctgggcttgtactgtagcttttctctagccgacgcatccaggcaagggtgggcgtgatggagtttggatgggccctgcgacggcctatgtcgcttccggattcacctaggcacgagaggggactgcccgctgccttgcgaggagtgggagtgaaacctaaggtgtggtgtgcttggttagagggggttatgcgaagggtcctgtcacggactctttccggtatgtcgtggtggcatgtcagcacacggaaacgtgtcgtggggctgtgtcttgtgggtacagttgtacacctctaatcagagtaaaactattcgaatagccgtgcccgcggttatgggcggtcaaccagattcaccgtgattagtctcaccctagtttagtctattgaatttggatagtataggtggatggttgggcctgttgcaacgtgggatagcgttggacagtggatagttaatattaattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctatttttcccaaccccagagtatgagtatgtgtcaaatggaggtttctccgaggagtaggcttcgtccgtgccgtcgaggatgcctgtggagtggtgttcccgctgcagttctagtcaaggcttagctcctgttgtctttcgtttttccgctgcatttttgtaagacttttatgatgtttgtaagacgtggatctgaatgtcaacattgtcgtttgtgtaccccggccggtcctggacggggattttaatgcacattctgcttggaattatattcgggaatttctgggcgtgacaatgttgatcaggcggtatccgaattgagtgatgccggagaaaaaacaccattggctttacccaagcaaactcctccaactcttgctgcccctgctcacttttcaagggtaaaccactcaccttgattccctcttacaatcatttattcatagccgatcacttataaatcttgcatttgcagaaaaagaagactgctgtgaagaagaaatcggcagcagcaccatccaagccagctccaccagtaatattttcttcatgaaattttcaagtctaatcataacccatgtggactaacacttgtcttttcagcctcctcctcctccttcacctcctatacagcaaatgtcaagtgaccgaactccatcggctataggaagtcataatattgaggaagaggaacaatcagccgctcctgccatcccagtaagtctttcattgtcttaacatcttatatcggctgaatctgtttgatcttcaactgtcttcaaatctctcctttgcatgtattaaccgatctattctcctttgacatcaaggattactttgatgaagaagcagaagaagaaaccacaagtaaggctctagcccctctcgatgaaactgtcaagaaaacacttgaagatatatcccttcggctagagtcatcattagataacctggtggccgactgtagttcgatccgggcacgatttatagaaatccaaccctaatcccacattatctagtgaacaccatcactccagcgatgtacgttgagcaacatcaattcaagctggaaaggcctaagcaacggatagccgatcggcgggagcggaaggacattgaagcaactatccaagccaatcggcagcttgtgcaagaagagtgtcacgtcctgataaattcatcccgaaataaaaatcattctctaaaaggaacaatagaattaattaaaattcgaaaagaaattgtcaaaccttaaaatgcgtacaagaaaaatttgaatgtggcccggagaattttcgttaaattctccttggtctaaaatgagccctcaaattttagttgaattttcagaacaccggaaataattattaagcaacaacaacaattatcaaagtttactaaaaagaaaaactaaaaataatccttcttcctcctttgggccaagtctggcccaaagtctccctctctccctcggcacgctgtcgaagtctctcttccctccctctcgttttcctttcccatctcactctcgggccgcccctccctcctctcctccccggcccactccctcctatcctcctcccgcctgggcctgccctggcccaacccgagccgcagccctcccgcgcacgcgcgccgcacgcgcgctgatcgcgtggaccggtgggtgccacccacccggtcgtcgtcctcctcccgcccgactcctccctctcccatgaaaccctatgcgtttcgtccttcaaatctgcgcgaatcaattcccttctttccaaattgattagggggaatgacccctttccttcctcttcaattccccctaatttcccccttgaatggcgccattagtcacccggaacggccgcgtgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctgacaataaaaataaacagcagcggactagcgggcctacggctccatcttcacaggcgctcaactggggtataagccaggactccacctaagacttcttctccaaagcttctcttactgaagggggaaaagattgagca

SEQ ID NO: 51661 - DNA, 6320 bp, Oryza sativa
ctgattgtgagtatatcagaatgtcgtcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcgcggatgcgcaactggtgatatccggaacgaagatcaatcttggagaataccgtggcacctttaagctgatcgaacaggtcatcgatccggggaagagggtacttgtttttgatggtgacttcattgagggctctgtagtcgacgcacctcctcttcgtcttgtccttcttctccacaaaaatcacaggagcgccccagggggaagtactcggacgtatataccccttctctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacatctccgaactctctgacgatggggatttctgacagtcctatctgatgaagttctgaactactgacagaggttgggggtgcaaagaaaacaaccggttgttccggtcctcggtacagagtaacagtgcgtctcgcgcaatccactactccttgaaattgagccaaccaattcattccaaggatcacatccaagttcttggtgtctagcagaatcaggtccgagggaaaaggaatcccctgaatttctatagggacggcaggactataatactttgctgtcataacccctccaggggtggtgatgagcagagggtttctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccctgaatgacatccttcccaccgttgttggagcggggaggcgcttggccttgctggcgcctcggtttcgggcatttatccgcaaagtgcccgggctcgaagcagttgaagcacagacgctgctgaccttgagcgtccctgcagccttgaccagactgcacggctggcgtaggaggacggggcgcacgagtcccttgctgactctgctgctgctgcggctgtgggacgcgcaccacgtattgaggtcgaggcacggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcagaattccctttttttaagagccacgactccggcgggcacatgggttctccggaaagcggcggtgaaacgggcccaagtaataggctgcccctctggctgcgtagcctggaaatggtcccaccatagagatgcgggcccctgcagttggtgggcggcgaagatgactttctcctcatcgctgcactgcacagtgtctagctttttccccacggcatgcaaccaatccaacgcatccacggggttgttggagctagagaaggtgggtgggcggatgcggaggaactcggcgagtttagagtgttgcgggggtggtggtggagcattctgttgtggcggattttggaggtggtggaggaaagcagtcatcatgttggcctgctgggcgaggatttgggtgagaatggcgttggtatctggtggtggtggtggaggcggaggaggaggtggaggtgggctgccatggtggttgcggttgctgccttcaggttggttgccatcaccggcattagcacttctcctggtcgtcaccatctgaaaaccccacacagaaccagcaaacagagagagctgacaattaaggctaaccatccacgactaccataattcttaaatttattactgctattaaattggttcattaaagttcaagttgcttaggcaaataaaataaagacaggctccgacacagttatgccacacaccggcctaaccatgccccacacaactccaacaagaagacaaacgaggaagaacacacgcgcaagcctactaactgctcgtctaccactgcgacgggccagggcggaaggtgagcaacagcgcatcctccgtgctaccaacgccggaggcttccccctcctggggaaccacaggcgcgggctcggcacgaggggtctccacgaagcaggtccacgccagggactgacgaacaagctcgggcctggaggtgctcttgcgggcggtgatcttctggctgcggcagacacggcgacgcttggggcggcagacctctccctgggcgatcttgagctgatgcagctgcgcctccaccgcgtctaggtccttcttgagctgcaggttctcctgacgcagctccaggatcttcaggttgttctcgaccatcccacggcgcaccatctgatggaagtcgatacgagccgcgtcgtacgcctccaccatgcgcgccaggtgcacgatggtagcgtcgtcctccgagctagcatcccggaaggtggcgtagtcgcgggctcctccgcggtgagggtggtagcggtagggcgagtgctgcaactcgtccgggtagcgctggtgaagagtgccgatggcgaggagagcggcgttctggcaagcggcggggaaagaatctccacccgcggtgactgccagcgaagtccgctcgggagagccagcgaggatcactgcagtgacctcccaagcagcgtggggctctgcatcgtcaccctcctgcttcggaagcggcctggcctggtagtccactccatgcggataccccaggaccacgcacatgccccgcagctccaagacgaagccagtcatgtccaaaccacgacgggtgacgctgccggccatctacaaacaaaaacaaaaagaaaaacaacattttaaagatcatattttggcgataaatgaagcagcaagacagagagagactagacagttttcacaaataacaaaggatttttatttcgaaaatactgctaaggcttgggatctaaggctcgtcctagggtcaagggggctctgataccaacttgtcacgaccggaaataacccaacgggcgttccttacgtgcgtgcattaatccttgtcccaggaggcaaggtacaccaacagttgatacaaatcagagtttaacaagcggaagcgtaaatagttaattattacatgggcagcgacggcccagcacactcaaagacaacgaaaaacagcggaagactagggcgacgaccacaggcgcttgacggcaggcacgagctagacaccaaaacctccatcttccaggaactcttcttctgggcttgggaaaaaattgagcaagactgagtacaaccaccgtactcaacaagacacacccacaaatgcagaataaatgcaagggagtacaaaggagttatactataaagggttagggtttgcagtaaacagcatttaaagatatttagttgctcagagctattttgtaaacacgattctagaactgtacaatattatttatcaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcgtggctaaataaaacagtgataacgcgggaatttaaataaagcgataatgcagtaatttaaatcaacataattttacaaactgggattcaatatattcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaagcaaagcacaaaaatgggttcttgacttcttaaggaaaaattagagacttgaacggtccaattccgagttcaaatggccaagttatggccatttgaagtttatatgctctttgattgaatatttgcgaatttcttcatttaaattttaatttaaaatcggatttattgcgtcagccggggggaggggcgcgcggaccgggtccacgggagtgggcccacgcggcagcctcacggtccacggtggaacgggtgcacgcggcttacgccggccggcgccgtgggtcccacgcgtcagccgtacccgaggcgcgggcggctgacggccgggccccacatggcagccgcggggcgcgcccgaaggcggcctcgccggcacagccgacgggaggcggcgcgcccgcgcccctatggtcgccggcggcggccataggcacggcggagcggcggccgagagaggggagggaagggggaaacgaaatgggcggtccacggctcaccccgggtcgacggcgacgacgggaacggcgaccggagcggaaaaaggcggcggcgcggctcgggtcgacgaggacggcggcgttccggcggtcggcgggcgaaacggaggggtggacgaggtcggcgatgttgcggcgaacccgaagaaggcgacgccgaaacgggagaaggtccggggcgacgacggcggcagaccggagctcggcggcggcggcggagagagagggcgacggcgcgagctcgattccgacggggagagagagcggcgagcggcggaaacggaggagggaggcacggggatggtttatatagggttgggagtgagagagggcggccggaggagaaggaaaccggcgcggcgctctcgggctccatcaatggcgccggcgagatttgcgggggcaaatccgcccgtttgaacgcgagagagagaggggaaaatggggggaaagggagagggaatcacggggagtgatttccccctctttattgcacgcgggggcggcgggatgcggcggaatccgcggcggcggcggcgctagggcacgggcgaggcggcgggagcggcgcgaggtaggggatgacgggtgggccccacccgtcagcgagggtggcgggcgggcccgcccgtcagcggcgcgcgcgcgggggaaggccggatgggccgcgggggagaggagagagagggagagggagggggggaaaaagggactttttaggg

SEQ ID NO: 51662 - DNA, 3305 bp, Oryza sativa
gagagagaggacgacggtgcgggcttgattccgacggggagagagagcggcgagcggcggaaacggaggagagaggctcggggagcgattatatagcgtcgggagggggagagagcggccggagaggaaggaaaccggcgcggcgatctcggctccattgatgcgccggcgaagattgcgggagtaaatccgagcgaatccgagggagagagagagggaaaagagggggaaaagagggagggaatcacggggagtgatttccccctctttatggcgcgcggggacggcgggatgcggcggattcggcggcggcggcggcgctagggcacgggcgggcggcgggcgcggcgcgaggtaggggatgacgggtgggccccacccgtcagcgagggtggcgggcgggcccgcccgtcagcggcgcgcgcgcggggaggaggccgatgggccgcgggggagaggagagagagggagggagttggaccgagccggcccaagagaggaaggggggggaaaaggacttcttttagggtttttctttttataaaacctttttaactttgtttatttcttctcaattattatttgtgctctgaaaattccactaaaatttatttacgcattttaggcttttaggaaatatacaaaaatcctccaagccttatttgacttttatatttgcacattttaattgttggaggctttcacacgaattttaattattctcggcacaatttcgaggatgtattttagagtcgttttgggacgcgacactcggtccttaactgaccagggacagcactagccttttccggacaccacccaagtaccctagccgccccggtcgaaaacagtgtttaattttgtttctcttttcacaattcatgttatccttgtcatggcaatgtggtgtccacgcctccacatgccgcatctcaactaccttccctaaggtagttgcccaagcatatagcacttgataaatatgagaatgcatgattctaattagcatgactaagcatttgttcaatatcgactaagtacacacgttagcacggtttgcaatggtcatatggataatcaatatcaaggcatggcatatttaacaagtagggcattcatattcacatatgtatagcatgcaattttatttaaatcaacataattttcgcaataggttcaacatgctcaaagattagtgatgacttgccttgatcgcagtcttgctgacccagatcttcgattaactcagcaactccttcggaatctaaatttacgtgcgaaagattgatttgaattcaattagaattcatattaaatcaccaaaaattcaacagtacaaaaataaatagcaaaagtggttccatcagaaagatcttgattttagatgaatttaggttcaagtttcattcaaatccgagctaaaatgaatgagttatgcttgtttaaagattcaaatttgaattaattcaaacaattgtgaaatggcactgtgcagccgagaggggcattattacagtggctgacatgtgggccatcccccaattttatttccggtttttttttattattattttttttaaaggaaatcctattgtgtcattgacaggtgggtccggccccctgttgactgaggtcaagccggccttttaatccccggtgcgacccgcatgtcattgagacatttacttaaaacctaatttaattagatttctaagcatccgggcctacatgtcataggttcataataatactattagtttggggattactgtgcgctaatgaaatggggtccacatgtcataacccctccctctctcgtgtcttctctctctcccgtcgtcttcaacctcgcgcgcgcggccgaacagaggagcagtgcgcggcggcgcgacggcccgagccggaacagctcggcgcacggcgaggcgagcggcggcgcatcaccggatgcccgccggtggcggcggcgaagcgcggcgaccgttcggcgcgcggcacgacggcgcgcgtcggcgccgagatcccaaactcggcggcggcacgatgaggaccaatgtgagcgcaaccggctacgattcaaccatctagggtccacatggagtatatataagcaaaatctagcctaggttgtattggaacgaagtccccccacggcgagctcaaccatggcgcagtggcggccggtgccggcacggttacggcggcgcacaccccaaatcgagggggccgggggtttctaggtgactaggcgggactactggcgcgagggcttaccacgaagtggcggaacggcgaagttcgacggcgagtggcgcggcgcggtcgaaatagggacggacggcggtcggcgacgggcgcaggtgttcgacgctcgacctccctcgcgtaacggctcccggctccctccaatagcagcaacggcaacgggcacacctcctcaacacaccccgccacccacactggccgagaagccctgtggcggcggcgcagccggcgcccaccaggtgttcgacacccggcgacggcgtgatcctgcccctcttcggtggagcaaaagttttagagagaggaagagttaatggaatgttgagttcggataagaacgagccaaggacaagcctatataagcgagagggagagcgattccttaatggataagggtgatcgatgacgcggctctgtttcgattcctcctaggttcgattcaatgccctgggccggcatgattgcctacgcggtagtatgcaggagaggtctcgctagctggagaaaggggcaccgcattacccagcggtcgcaaccgggggtgacaagatggagacgcgacggggacgtgatggcgacaagagcgacggcgatgggcagtggtaacggcttggatagggggcgccgggctatgccctagggtgacgcgggcacccgtggtggccattatcactccatcccgagggcgacgcgcgaggggacgggatgacgcgggcacccgtggcggcgcagcctttggcgcgggcttttggccgcttggtcggcggcgggcccacacagcttggcatgacgcggtgcggcgcacgggcacgactagtgtggcgcacgagtcggaaggcaggcgcgtggcacggcagcgattggcgagggtggcgccgggtgttcggttgggttaggcacagatcgaacacctggcgcgcaatgaacagtagcgccaggaaaagaaaaaggaagagaagagaaaggataagggaaaaaggaagagctaaattgcaaaatggcttggaattgagttgtaactctacatattttgaattcaa

SEQ ID NO: 51663 - DNA, 3094 bp, Oryza sativa
ctcatttttggtttatttcaccttaggtcatgactaatattccattcgcattatgtttttcttattttgccatattctggattttattatttgacttccatctcaacatacacctcttatagtatttgaattaaacaatatatttgcaatatataaacgaataacaccagcatgatgcaaagtttttaaaaagttcgaatttttagtgatttttattattgaggatttttaggatgttacatctttctcatggggcactcgcgggtggatggtcttcctcacaatgaaagcaggtagtggcacacgagctagcaacatgaccgatttctccacaacgagagcatgccttatgttccattttattctggttgaaaccttggggagacttctcatcttcatcatctgaggagacttgatctgaatcttcactatcatacactctacctccactagctaaaagatgctctgtcaactgtggtgcacctcggaaggaatttcttctctgacgttttgtcattcctggtggaggccattctgtgctggtaatgatcatcttacggacttcatcttcggttcgcattggtgcttttcttttctgctgaggacagttccttgcatagtgcccttgttcatcacacataaaacaaatgattcttgcttcttttgagtcaacatgtgacatggcatgaggggccttctgggatgttggcggtgcgctgacttgtggtgtgagtgcttggactgcctccaactgcacttaaggttgcatctgactccggttcagaattggcgtccgatgctgctgtagtatctctataagcaatttgttctgcttaatcaagtgttggaccactgccacacaattggtgtctggtgcttcattcactcgggagcttgaggtacccatgtcctgacttctgaccttattgcctttctcattgtcagccatctgttgcaaggtttggagagggagagagggaaaacaaaggggagagacagatcaaaaactaaggataggaccttaacagatctaagtcttttgctgttatgatgtatgttaggcttattctgcaagttgattaagcaaacaacctagcatggttacatcacaccccactgatgcaaaccacgtgctacacacacaagcaaggaaacacacgactatcgaaaccctagagggtggcttaggttctacgacgggttctctaagatcttcactcctgcttcacatctagcttcactgcttccttcgcttcgctagcggaccctgcggtcttccggagcttcggcaaacaattggcgacatctttttcttcgcaaaactaaccatctagtactagttgaaaatctgaaggaggaagaagagaataaacattttgcaaatagcattagggaaaggaggaaaaaggaactttcgcaaatagtttcatttataaaatatgtccttaggttttatccacttggcttatcctacagtcgagatggctctgataccaccttgtcacgaccgagaaaatttgcattttcccgaacgctagtgtattaattcccgtcccaggaaaagccggggtacaccacacaaacatgatataaaagacacatctttattataaagataatatttacattattacaaaggcacctcaggcttgacaaacaaaaaaaaacagcagcggactagcgggcctacggctccatcttcacaggcgctcaactggggtataagccaggacaccacctaagacttcttctccaaagcttctcttactgaagtgggggaaagattgagcaagaatgagtacaaccaccgtactcagcaagccacatcggcagatgcatgattaatgcaaggggggtacaaggggataataataggggttaggttttgctgtaaacagcatttataagtcacttagttgcccaaatctattttgtaaacacgatccaagagctacacaatattattaatcaaggccgtgaacccacatgaacctgccttaacccaaggcctacgatgattcagactgaactggcaacccgacctgggtcccagctagtctcaagccaacccaggccaacctttccacattttagttattaagcaaattttaagaattaaaccactaacttgggtacattgctaggcttgcccatatctgagggctcggctattcgaatagatttactctgatcagaggtgtacatctttacccacaagacacatctttactccgcattccatgggcatggaacccgtcgtaaacatgtgacataacccttcacccatcctagccgtgtagtcttcatttgcctagacatctcgattaccgagccgcagctcgcgtagcctttatttggctcagagatatccatcgtcgcaacgacttcatccatctctatccatgtccttttgttcaggactagactgagcaccaagttaagccttacccattagacatgtggttagtacggtagtgctttgcaacagaggcccaaagaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagcatccccaaagtctaaagttataaaaccacctaatgttgcctaattattcagcgagcatctacctaaattcatactagtggaaccatgaatagattacccactagttggggttttattttcctagggtgaacaaggtaataataaacaatagcaataataataaggtcataacaaaggtaaataggcatggctaaataaaacagtgataatgcgggaatttaaataaagcgataatgcattaatttaaatcaaaataattttataaactaggattcaatatgctcaaggatgatgtgacttgccttgcccagagagaacggccttctgaaccttcggcgacgaccgcaaacgaccgcaagaatgatacattaatggtttacaatgagaagtgccgagaattgatggatggatttcggctggtaactttgacgcatgtgtctcgaga

SEQ ID NO: 51664 - DNA, 783 bp, Oryza sativa
tagacatgtggaagtacggtagtgctttgcaacagagcccgaagaccggtccttatatggtcgaggtgctactatcaaaaccatgcactccgagcccagcctaaaaccattttggggattttgaatagagggggcggtgtgaatccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataataacaataataataaggtcataacaaaggtagataggcatggctaaataaaacagtgataacgcgggaatttaaataaagcgataatgcaataatttaaatcaacataattttataaactgggattcaatatgttcaaggatgatgtgacttgccttgctcagagagaacggccttccgaaccttcggcgacgaccacgaaccacgcttcgggaacctccggaacgacagaagctacgcgaagcacacaagcaaagctacaagcctataaagaagcaataccaatacataaaaagaaaacacagggttctttaggttataacaaacattaagagacttgaacgggtcgattcggagctcgtatgaccaagatatgatcatccgaagtttaatgctgttatatggagatttgcggattattataattgagctttgcaactataaaa

SEQ ID NO: 51665 - DNA, 1268 bp, Oryza sativa
tttttcttttatttttcctcatacaccatttccactatataccacacacattatgcacgatcttgatcttgagtatgtttagttatctgcattagtctaagttttttacttagtaacaaatgtgaatgcaactatgccatgtttgatccctaccgagctccacatataaaccttagagtaggaatcaacaaggcaacatttggtgaagaattcatgttgatacacttagagagactgagtgaatcacttgaggaacttggttttcttttccaaaatcatttgaaaacttccagaacaagagttgaataaagattgggtgaattggtactctaattgctattctgtctttcaactgcccaagacaaggagaagcagtgtctcgtgggaaccaggggtaagggtaagccaccgtgccaaagattatttaatccgagagagagtacatataccttgcacctgtatctttgagatatgcagcatagtagcaactcctgatcaacaaccaagtctttgtttcctttcgtccttcattcgggacgagcaaaggttcaagcttggggggttttgttgatggtcgttatcgatcagtttcgaccgtcaatattaccaaaatagaggagaactagtgatgcttgcaatgcataaatatgttagaataattatattccactaatattggctctactaaccttttgcacagaatgacaataaaatgaaggagaatcgacatcaacttaaacgataaatcaatcagatgatgtcgaagaccagacttatgtatgaatgggccaagaactcagaattgacacgacgaatcaggccaaaattcacaagtctacgaagtgaagcagcagaggaggccaccagccaaaatgtgggctggttgggccggccctaggtttggccgatggatgcagggttttgagggaacggtggagattcacaaccaatggcggttggagggtattaccgacctttccaaccgccataaccgtcattacctgcctatttaagaagctcactctcttcacttcaacacgcacctcaagcaagagctctctcattcctctcaagtttagtttagtattatctagctggtggaatagaattagaataggaatcaggagtccggaagccttcagaagagttcgggtttggctctagtagctttcctttctcttttgtaagctttgtacttttattacaatactcttctaatacattaatggtatggaatacttttcgagtatatagtacctacttacatt

SEQ ID NO: 51666 - DNA, 5066 bp, Oryza sativa
tatgaggatgagtagtaatgcttatgtgtcaaactacccttggattatcttaacccctgcttagaatacgattatcacaagtaatatgtatgttattagttgagttctctctacatgatctttccacgggataaaataaatacgataccctttgaatactctcgtgtgaaataatacaatggtatatccgtgctcttgtggatgaactctgtaaccataatataccagaagtattgatgcgtcattgctgtgaattatatttctagtaatgtccttacgaaataccaacagtaataattttaatattatcgatataataaagatgtgtctttttatcatgtttgtgtggtgtaccccggcttatcctgtgacggggattaatacactagtgttctggaaaagctatttttccggatgcgacaaagagaaagccaagttagatatgctctctgccgggccaattcagccgaacatagatcggcttgaagcccgcaagattgatctcatagctcaacttgaagaatgtaatgccgaactagatctggacaagcaaaagttagccaatcttccaaatgctgtcgaagaacagaaatccagactgaaattggctatcaagaatgtagctgatatgatcaagtacctcaaggtcatttctggaaccgatgctcaagatatccaagctatcgaagaagtagatcaaatcaggcaacgggctgtgtcggctatccaacgctacttgtctggataattaccctgtgtaataggacttagcaaattttgtaatcggctcagaaaccttgatactccttttgtcactgaactgttgtgccgattaatataacttctcaagttgctcaaaaatttgcaacttttgtatatatgtgcccccctaattttgcaatgatgaaggcattgataaaattataatttggactaagggcgatataaccatatcggccattgtacatcggcaaaacacaaccgattacaacaagaaaacaactaagggctatataaccatatcggccattgtacatcggcaaaacacaaccgattacaacaagaaaataactaagggcgatataactatatcggccatctcaaggcgatgtaaacacatcggctatcatgtatcggcaacatccagccgatcgtgcattaacctaaacactggggtaatatttcttcaagtacttgccattgagcgctcgtccataaacttctccatcaagtccttgcaacatataagctcccttggacacaaccttatggatttggaacggtccttcccaatttggtgaccacttgccgaatttattatcacgagtccctatcggcaaaatcaatttccaaaaaagttcaccttcagaaaaagactagggcaccacttttttgttgtaacgtcgagcaacgcattccttatccttggtaacttttacaagagctctcaacgtagattgaactaagtcttccctttcatcggccatgagattataatattcatcggctgtcaactcattttgcaactctgttctccttgggtgtcacaccctgaaaaatcgctaaattataaatcattgtgaaaaagaaatttttagaaattacttaataattaaagcaagtgtgtgaataaaatctatgaaaattttgaacattaagttgatatagataaaattgtattaaatatttttaatgtccaagtattttaaggatttttcccagaattatttgagcattggaagtatttttaataaatgaaagatcattcagtgattaatttaattggaaaagtaattaataattctttctttttcctcctttggttgtgaatcattcccagttcactctccctgtctgcggtttgttgtatccgccgacctctttccgccacggtttcgttttgtatgacgagccgagtcctactctctttctggttccgtttcattttcctttcccaaaaaggcaccgcatctgtctcccccacctttcctttctaggcaacccctcctcccgtatcgttttcctccctccccatcttttttctgtttttttttcagccgcccctagcctcctcctcctcctgtttagccgcctcctccaacaccctagccgccgctgccgctagccgtcacccttcgccgtcgtcgtcttggtcgtcgctgtcatcttatccggtgagctttcctctctcccatgtcatttaccggtgtagtttatccctagggatttaatctaatctaatctaatctaatctgttgtttggccctagcgtcgtcatcgtatccgtgtgttgtcgccggatcgtcatcgtcgaccctccctctcctgtccctttggtttggtgagatttctattcgtgtcccctcgggttaggtttagatccctcggtcgtgtcaccgccgctgttgctctaaccctagcgcagctgttgccgtgtcgcttgccggctgtcctgtgcaccgccgctgtgctagctgccttgttgccgctgcgtcgctatttagtcgctgtacgtcgccgtcgcgctgctgctgtaggtgtgccaccgcaaccgctgttgtgccgctaccgtgtgtcaatccaagccatccgatcttggtcgactcggtcgagattaatctcagccgtccaaaagcgatataaatccgttctctcttttcaatggcatattattcctttttaatatatgtcatctaccaaatatgatctaatctatttccggttttaatcttttgtctcagctataagtcatttataaattgtttaatcaatttggaatagtcttttctttaataggtttaaatggaattaaatcctgtaaaattcatatctaattcatacgaactcggaatgaggtcgttcaagtctcataattcatctaaattcaagctctacctatttatgaactttaattgtactgtttatttgggtttttattagtgttttttcttgttttgcgttctaggtttagttttccgttatttcggaggatcgttcgttcgttggagaagttcctgaagacgaattgaagatgcttgtttgcaaggcaagtcacacagatcccaaacaagcctttgagcatgttgaacccgtttaaagctaatgttttatttcaacttatgcattattttagaatgtcatcgggtggtgagcctttcccaattaattcatggccgaagatgactttattttcctatgggttataatttgactagcatggaccttatatattggattggttcagctagatgttatttatagttgcttagccatgcttagaaacaatagctcattaatgggatgaatcatactacattattatttatggttatatttaatggtagctcacgatattcagtcatgttatgataattaattggtaattaaaatatgattaatggtgggttgtgagcacatggttttgaaggtcgcgctcatgacaattaagaaccggttcgcgagctattgttgtgagacattaaccgtaccaaccacaagccagcgtgggcaacggctttatcttttgtatagcatgattcattatggtgtgccagactgagaagtggcgagaagtccgtgggggtcgctggggagtccattgcctctggttttgagggggaggttatgatccaggaatggtgcactgtggtgagttgtgttgtgcgaagggtattgtcacgatttcccccttagcagtgccgtggtggtacttcggggcatggcaacatgtgtggaatcgtgtcttctgggtacaatggtacatctctggccagagtaaaactattcgaatagccgtgcccacggttatgggcgagtctaacaatgtttttcgtgattagtcccacactactcattaatgttaataatgtgatgattaatttgactcctggtttggaatggataattcctggtttggaggtttgatctgtacgatcggggttggttgttcaggtttggttgggcctgtgcagcatgggtgtgctgttcagtgttgattaatattgatgattaattgctctactgttttacaaattctcaactctctgctaaatgctgctttcgcaaatgagcctatgttatgccatcctctagtatccttgtgcacttgcatacttgctgtgtggcttgttgagtatgtcatatgctcattcttgcaataatcatcaaacctcagttgaggaaaaggatccagaaggagaagacctttggcttagaacccagttgagctgcctgtgggagtggagctgaagcttcgctagattttattttccgctgcagatttcttcatggtgaggactaagtgcctcttatgcaagtatttatcgttttagttattttgatgaatctgtatattaaattgtcagtttgtgttcctcggctgattcctggacgagggttttaatgcacaaattagttcagaaattacttgagaatttctgggcgtgacaagttggtatcagagccatctcgactgtaggtcaagccaaacggttaaacccataaggacgtgtatttgctaaaacaagaatctatttgcaaaagtctgttttcctccttatcccattgctccttgcaaaagcttttctcatcctcccttccccgtctttcaacttgctttagatgaatcccttcaaggagaggttggaaaagatgatggcacactttgatgaaatttggggtgatctgcagacaaagattgatcagattaatgagaggagagaagctctggaaagcaaggcattattctaaaggaagctgagaaatatgggaacgatggttttacaagtgagctttgtcgtatgacgtatgatcttggatatgaggttccaccaatgtacactaaagtatctacttatgttggagaccaattgcattgaaagacaaatggtactctcgtttctgacaaggaagatcttctccaactatcatttactagtgaggccgattgtttcttctatgctcgtgaaggagttgtttacgaagctttgtgtcgtctccggcatcatctcaaggatcgtctggggaatactatatatcactaccatctaaaacatggtgatgatttt

SEQ ID NO: 51667 - DNA, 1496 bp, Oryza sativa
aagacgattatgaagatgtgaagcctattcatgttgtcaagcatctctgcactagaattatttttctcatggaaggtttattcccgtgaagatgagtcacttgagaagcccaagttcaaatgtaaaatgaagaagtcttaaagcacctatggcagaacctaagctttaccctcaagagtagtggtctcttgtttagttagatcgttgtgttagcttgcttgcttaagttttgtttgtgtgtgtgtgggttttagcgtatggagtatatcgagggttgtgatataaccatactagtttcagtgttcagttcagtgttaaagaacaacctacctcacatcaataaaagttaaagtttagtaaaaaaaaaagtctattctattctgagtctcctatctactttcttaacccttcctttctctctcttacctcctacctaagagaatggatttaaggaaaggaagttttgtgctcattagtgccagtggttttaacaagttaacagctaaggaacaatgtgtctggatctccaaataaaattcatcctgaagctaatgtggacaacacagtctgtcatccaaggaaagtaaaaagtcagaagctcaagggataccattgaaaaaaaaatcaagagaattctttacatttggtctcattcggtttaaggttccaagtttgatgtgagcaagagtcattaaggaataagaaagacaaaagcttacatctatgtcatcaagatgatcattatcactataatgtggtttaaagaaggaacaattatatcaaggtgtctaaaaagacaattctttttgtactatttttaagtcaagaaaatagtgtcagcaagaccaagacactcaacaatgagaaatataaagagatgttgatttagaagaaaaaatagcaagaagattcaattcacacgtcttcagtgtgaagtaaatggaagttaaagtttgcattgttatggaaaagtgaacacattaagtagagcaattattcctgttatcatggtaatggaatatcaagtgaaggctcggttcataaaagacttgtctttcaattaatggaatggatcaggagataatgattgctagcccaatttagtaatagtcaggctcgtgaatgatggcagaagttgtaatcgatcattcgatggtttcttgttgatggcagtaatcatgacattatttctgttaatagtaaccatataatactatcagatgtgatcaacaaaagtatcatcaagaaaggtcgcgctcatgacaattaaggaccggttcgcgagctattgttgtgagacattaaccgtaccaaccacaagccagcgtgggcaatggctttatcttttgtatagcatgattcattatggtgtgccagactgagaagtggcgagaagtccgtgggggtcgctggggagtccattgcctctggttttgagggggagattatgatccaggaatggtgcactgtggtgagttgtgttgtgcgaagggtat

SEQ ID NO: 51668 - DNA, 2726 bp, Oryza sativa
ccatgacaagccatccgataggaccacaatgctttggccaacctagtgtgtcattgccgaggataatcagagatctttctcttaatgaacttaatcaaactcttattagatgcctcggcttgcccattagcttgtgcataatatggcgaagaattcaacaatttaatacccatgctatcggcaaactgaacaaactcatcggacacaaaaatcgagcctcgattggttgtaatggtctgaggaataccaaatcgataaataatatgcttttgaacaaattgtatagcatcccctgaatcaactttcttcaaaggaatcgcttctacccagttggtaaagtaatcggttgccaccaatataaacttgtgtcccttgctcgatggtggattaatcattccgatcatatcaattccccaacctctgaatggccacggtttgatgatatgattcataaccgatgctggcgctctttgaatcgctccaaacttctgacaatcttaacatcccttgtaatatcggaagcaatcttccaacattgtcggccaaaaatatcctacccgccgaagcaaccacttcatcttataagccgattcatgagtgccacatataccacgcctatcgcaaccttggcttgataggcactcaaacatttaagcaataccccatcaatcgtccgataatacaattcatcatccaacaaggtgtatttcaaagctttatagcgcaattttcgtgaagccatgcattattttcgaatgtcatcgggtggtgagcctttcccagataattaatggccgaagatgactttattttcctatgggttacaatttgattagcttggaccttatatattggattggttcagctaaatgctataagtatagttgcttagccatgcttagaaacattagctaattaatgggatggatcatatatactacattattatttatggttatatttaatggtagctcacgatggttaatcgtgtaaagttaattaattgataattaaaacatggttaaaggtgggttgtgagcatatggttttgatggttgtgctcatgacaattaaggactggttcgcgagctactgttgtgaaacatttaccgtgccaaccacaagccagcgtgggcaacggctttatcttttgtatagcatgattcattatggtgtgccagactgtgaaacggcgagaagtccgtggaggtcgctggggagtccattgcctctggttttgacggggagattatgatctaggaacggtgcattgtggtgagttgtgttgtgcaaggggtaatgtcacagttcctttccgaggtaccgtggtggtgctgaggcgcatggtgacatgttgtgggattgtgtcttgtgggtacaatggtacacctctgatcagagtaaaactataaaaatagccgtgcccgcggttatgcgcgagttgggcaatgtttttcgtgattagtctcacgctactcattaatggtatttgtgctaattaatgtgactcctggtttggaatggtatattcctggtatagaggtttgatttgtacaaccggggttggttgttcagatgaggttgggcctatgcaacacgggtgtgttgtatggtgtttatttaatactgcttaattattcaactgttttactattctcttaaatatttattaaatgatgtttatgcaaatgagctttattatgccatcctttgttatcctgtgcacttccatgtttgctgtgtggcttgttgagtatgtcatatgcttattcttgtaatattcattcatcagaggaggagtacttcagtgaaggtgatgatctggaggactaggcttgatccgggttaagttgcctgtggagtggagtcgccatagctattccgtagtttgctgttatttttccgctgcgtagaatgttattctttgagaggaactatccacctctgtaataaattattatttgcgaatattaaatagctgtgtgttcgtactctattatcaatttgttattgtgtgcctcggctgattcctggacgagggtttaacacacatgtaagcgtttggaattttggatagaaattccgggcgtgacaccgattgagatggattctgcaaatattggaaaacatcatatcttcaatcatcaactgttatcgtagcaacttctactttgacatcctttatcatcggcttgtactccgatgctccttgagccgagtcattagcttcaacattttgctctcgagacacatgcgtcaaagttaccagccgaaatccatccatcaattctcggcacttctcattgtaaaccattaatgtatcattcttgcggtcgtttgcggtcgtcgccgaaggttcagaaggccgttctctctgggcaaggcaagtcacatcatccttgagcatattgaatcctagtttataaaattattttgatttaaattaatgcattatcgctttatttaaattcccgcattatcactgttttatttagccatgcctatttacctttgttatgaccttattattattgttattgttattattaccttgttcaccctagaataaacaaaacctcaactagtggacactctactcatggcaccactagtttagttttaggtagatgcttcgcaatttaattaggtaacattaggtggtttttcaactatagaccttgggaaatattcatatcatctggatactatggaatggtttggttatt

SEQ ID NO: 51669 - DNA, 1816 bp, Oryza sativa
atgccacctgagagagacagagttccggatagacctagtacctggaaccaaaccctatccataagagaccatacagaatggcagctaatgagttagtagaggtaaagagacaggtggatgatttgcttcagaaaggatacattagacccagtacttcgccgtggggagcaccagtcatctttgtggagaagaaagatcatactcagagaatgtgtgtggattatcgagcgttgaatgaggtcactatcaagaataagtatccgctacccaggattgatgacttgttgtcacgcccagaaattcccaaatagaattccaagcagaatgtgcattaaaatccccgtccaggaacggctggggtacacaaacgacaaagttgacatacagatccacatcttacaaacattataaaaagtcttacataaatgcagcggaaaacttaaaggataactggagctaagccttgacttggtctacagcgggaacaccactccacaggcatcctcgacggcatggacgaagcctactcctcggagaaaccactatctgacgcatactcgaattctggggtttgggggaaaatagagcaagactgagtactacccacagtactcagcaagtcataccggaatatgggtatgatgtagggaaatatcaagggatagctataatggttcatttgcataaagcgagcatttataaacataagttgaaagcagtaaaacagttgtaataattaaacaatattagccatccactgtccaacactaaaccacgttgcaacaggcccaaccatccacctatattattcaattccattagactaatctagagtgaatctaatcacggtgaatctggttgaccgcccataaccgcgggcacaactattcgaatagttttactctgatcagagatgtacaattgtacccacgagacacagccccacgacacgttacagtgcgccgacatgccaccacgacataccagaaagaggctgtgacaggacccttcgcataaccccctctaaccaagcacaccacacctcaggtttcacccccgtccccagcaggcaacgggcagtcccctctcgtgcctaggtgaatccggaagcgacagaggccgtcgcagggcccgccccgctccatcacgcccacccttgcctggatgcgtcggctagaggaaaactacactacaagcccagccgttgcccacgctggcttgtggtaagtgccatgggcgcgactagcaaaaccatgcacccacagcccaccataggatttattttaattaagcaacaccaggacggtggtactgatccaacatcaacactagaacctgaagtctatacattaatatgatttcccccattgtgtgctagttgaactaagcatggctaagcaatccctagtccaatatctagtcatgtcattccccaagctaacaaaggagcatggtaccaaaagaaatagcatggctataacagtaggtaaacatcccatagtattattgtaaaacaatgcagaatttgaagaaaaacagtagaacatttgcaatataggatcaacatgttcaagtgacaagcatgacttgccttgctctgcgactggaggaacctcggcgactatttcaaagtacaccggagcgtcgggagagccggaatttaagcgacatacaaagcaaacaatacaaaaaagctataagactactgaaacagagaacaaaaccaattttaatggattctacacatttttcttgatttactgagacttgaatggccttaaacggagatcggatgaattagttatgaatttcagaa

SEQ ID NO: 51670 - DNA, 915 bp, Oryza sativa
ccggcgcgcgcgggcggctcaagccgacccggggtcatggcgtggtggcggcgcggcaccggcggcgaccggcggacggcggcggcgattcagcggacgccggtaaagcggctaagcggcggcgctaccacgggaaagagaggaggaagaaggaaggggaaatgtcctcaccgaaggggcctgaccagcgaggagagagacgacggcgaccggcgacgaggaccgacggagggagatcgacaagcggcggacggggtccgggacgacctaaggaacgaaaaggagaggattagagagggagagagggaccatagagggcgggaatgccggccgaaggcggtggccatggcggctcttacaggcgcacggcggggatggggctccggcggctaacctcgacggaggaggggtggacgaggtggacctcggccacgcaaacccaacggcggtgacggcgcggtgcggcggcgaccctagcggcggctagaggcggccggagtagcgggagaggtggcggcgggtgggtgcacggtgcgggagcgatggagagctcgggagagaccggcggaaaaaggaaaagtgaagaggaggatgcggggatggattttataggggcggagaggtcgggaactgtcacaccctgaagttctcctcctaagcataaaattgaatttataaatcaccctaagaaaataccggtgcaaatcaagagaaaaccttaataaattaatgcaaataataatcggaattggcatgtggaatttttcttgagttctacatgtcgaaataccctaacaagatttttagtggaattttcagagctctcgaaataattttaaccaattaaaattgagcacatgcaattttaaatcccagggaaaatcttttcctccttttctttttcttttccctcct

SEQ ID NO: 51671 - DNA, 3778 bp, Oryza sativa
  unsure (1)..(3778): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggagaagatgtcttaggtggagtcttggcttataccccagttgagcgcctgtgaagatggagccgtaggcccgctagtccgctgctgtttatttttgattgtcaggcctgaagtgcctttgtaataatgtaaatattatcgatataataaagatgtgccttttatatcatgtttgtttggtgtaccccggcttttcctgggacggggattaatacactagcattcgggaaaaggcaattttctcggtcgcggcagctgttgacatttggaccgtaaaggagttttctggttacagccgagtgtacgtgaacctacagggtcgcacgctcaatgggccagaataaggggattggatggagatccaatatgagcttaattcggatagggatccgagtgggagtcctacgggtcttggaggcccgagtgatagattctatatattcatgagggatgtgaccagcggaggtaattgcatcacgtgagaaaccctagctgtcactcccctccccgagcaaaaccctagccgcgcgtgggtgctagcacatctgcgcgtggcgttccgtccttgtaggtgtggatactcgtagaggcgccgctggttttcggttattaataaccaaatttagtaatccaagtatcggagatggagataaaacaaagcggaatccaagataaacatcgtttcggaaacagagcgagaatcggctaaaagtccgaatcggctatgatcaggatcgacagagtttgagtcagactaggttggccgattgagccgatgtcgacaatgtgacgcggtacacgttgtcgggttgagttaatgtgcttcatgaggattgccacgcatggattgagtcctgagaaggcaattgtatctattaattaggatatttcatgtaatttccttagagatatgtttgggcaaaagtctgccataaagacttatggtatcttagagtttattagagataagagtcgtgtctgacacagacatattttgcaatctcgggtataaatagaccccgagtctcatgtaatacaacaacacacgtttaatacaatctcgggtcatcgccacccttttactttcgtttttgtttcgacgagttcttgctttcgggttgagctgcatcggtttcgatcttcaactagaggtaaaacatgttatggcggcttgcattctcgggattagtgcttctatttttatgataccctaatcttgtttatgtaattcgttgagttatcatatattctatataatccctggcaatattgttcttctttttatacttatagctgcatcagttgagtttgattttataagtcgtgattagaatctcaatttctagcttgcttttggttgccgattagggtagcatcggggtttcagccgatcttacctgatttagccttatatttcatgtgcttgattgatatgctaaatctgccctttatgttaagatcttgttgcatttaggtatattaggcttctgtttgatatattttacttgcttaatatagagtggtatcggagtattagccgatacatgctagatctatctgatcggctatgctatgagcatctataatctcattgttagtatatatttcgatctaagtgatttatactgtttcggcatggcgaccgatctatcccaatcacttgatttaagtatatatcgacataaagattatatattgttaatatctacagccgatcgagtagatttaagtctttcttatttattcatgattgcggatcgattcacatatgacatcggctcaaagataaatgatatgtcatcggctgctggccgatcggctatcatttatggatttaaccgtggtttctttgtctttatttcttgttgattgcaggatcaaatcaactggtgtgctcacgaacctaaaggcaagatttttggacctgcactgaagttaagtagatcttccaggcctcgtgtttttgcatcaacacgcttttggcacgttgccagtgccgatttagctctttgggagatggatggtattgattgcctgtctggaaaagtttgggatggagattttctaaaagtgtccgattgtgatatacaaccaattgaagatggagagcccaaattattattttgagggcatcaaacgtctataccaaggacacagtagataatctcgatgacaagcaaggacagggtttcatgtcggctgatgatttggaagaaattgatataggtccaggtgacagaccaaggccgacgttcatcagtaagaatttatctccggaatttagaaccaagttgatagagcttttaaaggaatatagagattgctttgcttgggaatattatgagatgccaggactcagccgatcaatcgttgaacatcggctccctatcaaaccgggggttagaccatactagcaaccgccgaggagatgcaaatccgatatgcttgaagctgtcaaggctgaggttaaacgtttgtatgatgccggttttattcgtccatgccgatatgctgagtgggtttccaacatagttccagttatcaagaaaaatggcaaagtcagggtgtgcattgattttcgggatctaaacaaagctaccccaaaggacgagtacccaatgccggttgccaatcaattggttgatgctgcttcagggcataagatattatgttttatggatgtcaatgcaggtaacaatcagatctttatggcagaagaagacattcataagacggctttcagatgtccttgtgcaatcggcttgtttgagtaggttgtaatgactttcggtttgagtgaatatttgctttaaccgaatttgatcttcggtatgaatcaccaaaggcgattaagggacaggctatagccgattttattgtggatcatcgtgatgactcaatcggctcagttgaaattatgccttggacattgttttttgatggatcagtatgcactcatggttgtggtatcggcttggttataatttctcctcggggggcaagtttcgagtttgcctacgttattaagccctatgcgaccaacaatcaggctgagtatgaagcggttctcaaaggattgcaattgcttaaagaggttgaagccgatgctgttgaaattatgggtgattccttgctggtgatcagtcaattggcaggagaatatgagtgcaagaatgatacattaatggtttacaatgagaagtgccgagaattgatggatggatttcggccggtaactttgacgcatgtgtctcgagagcaaaatgttgaagctaatgaatcggctcaaggagcatcggagtacaagccgatgataaaggatgtcaaagtagaagttgctacgataacagttgatgattgaagatatgatgttttccaatatttatagaatccatctcaatcggtgtcacgcccggaatttctatccaaaatcccaaacgcttacatgtgtgttaaaccatcgtccagga

SEQ ID NO: 51672 - DNA, 1474 bp, Oryza sativa
ccattaatgagtagcatgagagtaatcacgaaaaacattgcccaactcgcccataaccgcgggcgcggctattcgaatagttttactctgatcagaggtgtaccactgtacccacaagacacaatcccacatgtcaccatgcgcctcagcaccaccacggtacctcagaaaggaactgtgacattacccctcgcacaacacaactcaccacagtgcaccgttcctggatcataatctccccctcaaaaccagaggcaatggactccccagcgacccccacggacttctcgccgcttcacagtctggcacaccataatgaatcatgctatacaaaagataaagccattgcccacgctggcttgtgattggcacggtaaatgtttcacaacagtagctcgcgaaccggtccttaattgtcatgagcacaaccatcaaaatcatatgctcacaacccacctttaaccaggtttttattatcaattaattaactttacatgattaaccatcgtgagctaccattaaatataagcataaataattatgtagtatatatgatccatcccattaattagctaatgtttctaagcatggctaagcaactatacttatagcatttagctgaaccaatccaatatataaggtccaagctaatcaaattataacctataggaaaataaagtcatcttcggccattaattatctaggaaaggctcaccactcgatgacattcgaaaataatgcataagttgaaataaaacattagctttaaacgggttcaacatgctcaaagggttgtttgggatctgtgtgacttgccttgagcttccacaaacacttccgaaccttcttcaacgaaagcgctctcctccggaacgtcggaaactaaagcaaactaacaaaatcaacaaaacagtacaaaaactagcataaacagtacatgtggatatttttaacatgtagatctcagttttagaaaaatttagcaacttgaaccactcgaatcggagttacgatgaattagttatgaatttccgaagtttaattgatttgcatctaataaagaaaaactaaaaggaaaagattatgacgtcatgctgacgtaatcctcgccggcttgacacgggcgatgacctcgccggcgcttggaggctcggccggactattggagggcacctacgcgtagaggacaacattgcgaactcaccggtactaacaaacgcgacggatgacgacggatggcggccggcggcgagcttgagcggcggcacagttcggtcgacggcggcggtggctctccgtgtcgagtcccaaaacaactctcaaatacatcctcgaaattatgcatagaataagtaaaaatccatgtgaaagcgtgcccacaattagactgggcaaagttaaaagtcgaatacggcttggaggatttttgtagatttcataaaagcctaaaatgagtacataaattttagtggaa

SEQ ID NO: 51673 - DNA, 9986 bp, Oryza sativa
caagccgatcgtgttcgccgcctgtgtttcatcaagagtgcgtcgtagccccgtcgtcgtctttgtcctcggctccgcatcatcaagccctgtgtcggccgtgtctcgcctccgtccaaggatcgccaccgaagtcgtcccctcgccgttcgtctccgtcgtccccaagccgccaccgccgtgcccgttcatcgtcgttgttcccatgcctcgtcgcgtggtggtaaggatccgtcctctcgctgcccccgtcctcgtcctttcagtgtcgcccgtgcccgttgtgcgattgtcgaccccggtacccgtgtatcggtgtcggtagtcgttcgcatgtgcgtgtggtgaccatgttagtgtgcccgctcggtagctgtgtggtttccacatgtgaagcccgcgtggtgtctagtggagtccgtttgtcggccactcacctcggttgacacacggggtctgtttctgtcgacctgtggactgtctctgtgtactcggtataccgtggtcctttaggttgacgtgtggggtacgcttgtcaacagcgtagccttcctgtcttttccaggctagcgcttacacatgttttataattgcaaaacctaattataataatccacaaatcttcatataacagcattaaacttcggatgaccagatcttggtcatacgaactctgaatcgacccgttcaagtctcttaatgtttgttataacctaaagaaccatgtgctttctttttatgtattgttattgcttctttataggcttgtagctttacttgtgtgcttcgcgtagctttggtcgttccggaggttcccgaagcgtggttcgcagtcgtcgccgaaggttcgcaaggctgttctatctgagcaaggcaaatcgcatcacccttgagcatattgaatcctagtttgtaaaactattttgatttaaattattgtattaccgctttatttaagttcccacgttatcactgttttatttagcacttcctattaatccttgttatagtcttttcattgttattgtttattattaccttgttcaccctaggaaaatgataccgcaactagtgggtaatctattaatggttccattagtatgaatttaggtagatacttcgctgattaattaggcaacactagatggttttataacaatagactttgggagttctcatagcatttggacactatggaatggttggcttttggtggaattggacacacacctctcttcctctttcaaaacccctaaaacctattttccggtggggtttgggtgcatgtcagttgtgggaagtagtaccccggccaatacaaggattaagctcgggcctctgttgcaaagcactaccgtactaaccacatgtctaatgggtaaggcttaactcgatgctcagtctagtcctgaacaaaaggacacggatagagatggttgaagtcgttgcgacgatggatatctctgaggcaaatgaaggctacacgaactgcgtctcggtaattgagatgtctaggcaaatgaaggctacatgggccggtgtccattagttgagatgccatggcacaggactagtacgcgggtggtctcacccctatgtgtgtggcgcacctggtctagatcctgttgctaggggctcaatcctggcctgcctgtccgggataccggctgtaggcagggttgggtcagtacttttgttcacgactaggatgggtgaagggttatgtcacatgtttacgacgggttccaaggccatggaatgcggagtaaagatgtgtcttgtgggtaaagatgtacacctctgattagagtaaatctattcgaatagccgcgccctcggttatgggcaagcctatcaatgtacccaagttagtggtttaattcttaaaacttgcttaacaactaaaatgtagaatggttggcctgggttggcttgggatgagctgggacccaggtcggattgccagttcggtctgaatcatcgtaggccttgggttaagacaggttcgtgtgggttcacggccttgattaataatatagtgttttactgcaaaacctaacactatattatcactccttgtacccccttgcattaatcatgcatcttccggtgtgacttgctgagtactgtggttgtactcattcttgctctatctttcccccccttcagtaagagaagctttggagaagaagtcctaggtagagtcctggcttataccccagttgagcgcctgtgaagatggagccgtagacccgctagtccgatgctttttatttttgattgtcaggcctgaagcgcctttgtaattgttgacggtcgttattgattagtttcgaccgtcaatattaccaaaatagaggagaactagtgatgcttgcaatgcataaatatgttagaataataatattccactagtattgggtttactaaccttttgcagagaatgacaataaaatgaaggagaatcgacatcaacttaaatgataaatcaatcgaacgatgtcgaagtccagacttatgtatgaatgggccaagaactcagaattgacacgacgaatcagaccaaaattcacaagtctacaaagtaaagcagcagaggaggccaccagcgaaaatgtgggctggttgggctggccccaggttcggccgaacctggtggttcggccaaacctcccgtgaagccgatggatgcagggttttgagggaacggtggagattcacaacctatggcggttgaagggtattaccgacctttccaaccgccataaccgtcattacctgcctatttaagaagctcactctcttcacttcaacacacacctcaagcaagagctctctcattcctctcaagtttagtttagtagtatctagctggtggaatagaattagaataggaatcaggagtccgaaagcctttagaagagtttgggtatggctctagtagcttccctttcctcttttgtaagctttgtacttttattagaaaactcttctaaatacatttatggtattggaatactttccaagtatatgagtacctactttacattatgttcatgttatactgagtatactgctagcttatctgggagatgctttggtgcgggtatagtgtttgcttatgcaattactctatgtcatgacaatgatattagagtagtatctagtagtttagacgtggtgtctagattacgggatatcattatttggggttatatattgcggatgagaggttggccgctgatggtgacagctcagtaagggtattcctccgcgcctatatataatcctaagttaatttccatgggagggtattcctccgtatttagctccggttggatggtcatgacgggctgtcgtaaggaactcggcagtcaggggtggcttcttgaagtaccaggagggcatcggatagagggtattagctagtataccagttaactagaatgtatgtatactatgtatattagaggtataggaatagattctctttctcttttctttccacctagcttagattaattattatgagcatgagtagtaatgcttgtgtgtcactctacccttggattatcttaacccctgcttataatacgattatcacaagtaatatataagttattagttgagttctctctacgtgatcttcccatgggataaaataaatacgataccctttgaatactctcggatgaagtgctacaatggtatatccgtgcgcttgcagatgaactctataaccataatataccagaagtatttctgcgtcattactggaaattatatttctagtaatgtcgttaagaaataccagcaagcatttctagcgccgttgccggggaagattcatgatagagattacttgaactaatactttatatttacctctgtataatcattttcctttgcaggcttatcttggttgttttcactctttcttgtgaaaataactggtagtgcattttcctctgtataatcattttcctttccgttggtagtgcatgactggttccaacctgccggaaaacttcaaagaaaatccataagttttcttccggagcatcaggccgcgagtcattgcttcgcagaaaactttaccgacagagaaaccagccgtaccagcgccaccaagactcttcgcgagttcgctgctccctctgctgacaatgtggccatcgggccacaagtcaacataggagatgtggatttcgatttgaagtccagcctcatcacgatggcgcaggctagcccgtcctcatcatgggatggatgactgtctgatcctacagaacttttacaatgggctcaccctgatgtcccgcgatcacctggacgcggcatctggatgagccttcttctctaaaacggttcaaggagccgttgaactcatagagaagatggtctccaatatgggttggagcgaggaacgactccagacccgtcagcgaagcatgcacaccgttaaggagacagagttacttgctgccaagctggacctcctcatgaaatgattggacgaccatgagaaacggccacaaggcaccgtcaaggccttggactctcacatcacgtgtgaagtctgcggcggcacgggtcattctgggaacgactgcccggaaatccgtgaggaggcgatgtacatgggcaacaacaacaatgggtatcgtccacaaggaggtcaggagtggaaccaaccacgcccatattatcaaggaggtaataataacagtaacttctttaaccaaccctccttgaaggatcttctttttgtgcaagctaaaccactgatgcactaagcaaaaagcttgctgccaatgataagatcttagagaacataaatgttaagctagatggctttgcttccgcatttcaaaactagctgagctttaataagatgatcgaaacccagttagctccgttggcatctttagtccctacaaatgaatctgggaggattccggggcaacccgactcctccattgaaaatgttaaggcgatcacaacgaggggaggtaagtccactcgtgatctgccatatcctaagcctgtaggaactaatgggatgtcaaaagaagcgccatctattgactcgttttgttgaagtaatccaaaagattcacatcaatgttgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctacggctccatcttcacaggtgctcaactagggtataagccaggacttcacctaagacttcttctccaaagcttctcttactgaaggggggaaagattgagcaagaatgagtacaacccccgtactcagcaagccacatcggcagatgcatgattaatgcaaggggggtacaaggggataataataggggttaggttttgctgtaaacagcatttaaatgtcacttagttgcccaaagctattttgtaaacacgatccaagagctacacaatattattaaccaaggccgtgaacccatacgaacctgccttaacccaaggcttacgatgattcagaccgaactggcaacccgacctgggtcccagcttgtcccaagccaacccaggccaacctttccacattttagttgttaagaaaattttaataattaaaccactaacttgggtacattgctaggcttgcccatatccgagggctcggctattcgaatagatttactctgatcagaggtgtacatctttacccacaagatacatctttactccgcattccatggccttggaacccgtcgtaaacatgtgacataacccttcacccatcctagccgtgaacaaaagtaccgacccaaccctacctatggccggtatcccgggacaggcaggccaggattgagcccctagcaacaagatctagaccgggtgcgccacacacatagcggtgagaccacccgcgtactagtccagtgccatggcatctcgactaacgggcaccgacccgtgtagtcttcatttgcctagacatctcgattaccgagccgcagctcgcgtagccttcatttgcctcatagatatccattgtcgcaacgacttcatccatctctatccgtgtccttttgttccagactagactgagcaccgagttaagccttacccattagacatgtggttagtatggtagtgctttgcaacagaggcccgaagaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagcatccccaaagtctaaagtaataaaaccacctaatgttgcctaattattttgcgagcatctacctaaattcatactagtggaaccatgaatagattacccactagttggggttttattttcctagggtgaacaaggtaataataaacaatagcaataataataaggtcataacaaaggtaaataggcatggctaaataaaacagtgataacacaggaatttaaataaagcgataatgcattaatttaaatcaaaataattttataaactaggattcaatatgctcaaggatgatgtgacttgccttgctcagagagaacggccttccgaacgctcggcgacgaccgcaaaccacgcttcgggaacctccggaacgacagaagctacgcgaagcacacaagcaaagctacaagcctataaaaaagcaataacaatacataaaaagaaagcacagggttcttaaggttataacaaacattaggagacttgaacgggtcgattcagagttcgtatgaccaagatatgatcatccgaagtttaatgcttttatatgaagatttacggattattgtgattaggtttcgcaattataaaacatgtgtaagtgctaacctggaaaaaacaggaaggctgcgcttgttgacatgtagactccacatgtcaacctaagggaccacggtggaccgggtacacagagacggtccgcgggtcgacggaagcggaccccgtgtgtcaaccgaggcgagtagccaacaaacggactccaccagacaccacgcgggctgcacacgtggaaaccacgtggctaccgagcgggcacactaacatgatctccacacgcacaagcgaacgactaccgacaccggtacatgggtaccggggtcgacagccgcacaacgggtacggggcgacaccgaaaggacgaggatgagggcgacgagggagagatccttaccaccacgcgatgaggcgtgggaatgacaaagacaaacgagcgcggcggagacgactcgcggacgacggaggcgaacggcgagggaacaacttcggcggtgatccttggacgaaggcgagacgcggccggcgcagggcttgacgacgcggaggcgaggacgaagacgacgacggggctgcagcggcatacttaacggatgcggacgacggacgagaacgacttgacggagggacgaacgccacgacgaccgggaacgacgagaggacgacaacgatgacgaccggggccggcgaggagacgatgatggcagccgcggcagctgcacagaggtgaggccggcgtgggacacgccgcagcgatgcccatgacggtggcggcacaacgagacgaggagccggcgaggaggagcggccgaccgaagggacgtcggtgacgacgaggatggagaggaggcgatgccgaggacgacgtcaccagttcgccgctgcgatgcccgaggtggtggtggcgcggccgacggcgcacgggtagaggaagggccaaccggggaaattccggcgaagtggatggagaggccggcacggcacggcggtgttccggcgaaaccgaggagtggccggggaaggagacgatgccgcggtatcgaaggaggagacgaaggcgtcgatcggcgtatcggtgatgaacaggagccggccggagacggtgtagtggtggcgacgccactgaacgccggcgagaacgcgcctccggtgctctccgcgctaaacggaggacggcccgggggagaggaggcggctgcgaggctgctggtggcgacggcgcgaccggatggcgctccggcgaggtgggagaggcggctggaggcggccggcggcacaggagagagaggaggacggcggggagaggtggtgaggccacgggagagcgcgggagggggctaaaatgatagaacggagtgagggggttccattgtataggatggtggagggagccgggcatgggagaaggcggaacggccacgggaaacacgggcggcggccatggaaggcggccgggaatggcgcggccgttccgagcgttagagggcacgaatcaagggggaaattggggggaatcaaagaggaatcaatggggattaattccccctatttaattttggaatcccatgagtaaatcgcacagatttgagggaggaaaggagctagggttcacgggagagagaggaaggaggccgggcgggagcaggacgacaacccggcgcgtgggacccatgcggggcgcgcggtcagcgcgcgtgagggggggcggctcaggaggctggggcggctgggtggggcagcttgggccgggaggcggcccaggcgggaggggaggaaaagggaatgggccgggaggggaaggggaggcccaagagaaggagggagagaaggagagggagagaaagagagggaggaagagaggacttggtccgcgggccgagggagagagagagagggggcccaaaggaggaaggaggattatttttaggtttttctttttaataaactttgataattgttgttgttgcttaataaatatttccggtgctctgaaaattcaagtaaaatttgagggctcattttagaccaaggagaatttaacaaaaattctccgggcgacattcgaatttttcttgtacgtattttagtgtttgccaatttcttttcgaattttaattaattctattattccttttagaaaatgatttttgtttcgggatgaatttctcaggacgtgacaaaaccaccccccttacaggaatctcgtccccgagattcgaggaggctaacaagaagattggttgggcggtcttctcttcttgtctgacttctttcgtcgcgtcttttataacaaacttgcctagcaaaacttccccactctgaactgcttggcttgatctcctgttgcagatggaatcttcttttcacctgacttgtccttggttgcaccttgagctaacttcgactgggatgcggtacttgaagacagggcttcagttccagaacttctcataattcatatctttggcgtcaacctcatacaagttacccacttcacgttatgcaccgatatcagcttgtcattactaggataccatgcttgccatcgggagaataccacgcttggcgtttccttccagcttaccaccatatgctttagactatgatatcccgcttactaagaataccatgattgacaagttgccactaactgtctcatattagctttcctggtctccggttctagatatttcctctattcaatgtgagggtcgataactttgcctttgaattatgtttcccaagggaaccaacttatcccacttgacatgctttgacgtcttcccaaatgactttactgctgaacttgttattgtctgatcgttatcctgccaaatctgaagcttcgttgttggatgtgattttaatctgacctctgtagattttccttgaacatatcacttgtttcataactgggaatggctctcacgaacaagcaactcggattcactttctttacattcggtttactttccactattct

SEQ ID NO: 51674 - DNA, 3165 bp, Oryza sativa
aagtaaaattgagggctcattttagaccaggaagaatttacaaaaattctccgggccacattcgaaatttttcttgtacgtattttagtgtttgccaatttcttttcaaattttaattaattctattattccttttagaaaataatttttatttcgggatgaatttatcaggacgtgacaaatgtgccatttttggatgctatgcaagtaccaacatacgcccgttatctcaaggtcatactcaacaacaagagaccgctcccaacaacggaggtggtcaagctaacggaacactgcagcaacctgatactccacaagctccaggagaagaagaaagatccggggtgtcccacgatcacctgctcgatcggggcacaacaattcgtccatgccttgtgcgaccttggagctagtgtcagcgtcatgccaaaaaacgtctttgacaaactcaacttcatggtgttggcaccaacaccgatgtgcctccaactggctgattcatcagttcgttacccggcggggatagtggaggatgtgcctgttaagatacggaatttcttcatcccggttgattttgtggtgctagacatggacatggggaaggagacaccgctcatactggggcgtccgttccttagcaccgcaggagccaacagtgacgtgggaacggggagtatcagtttccatatcaacgggaaggagttaaagtttgagtttcaaccgaggacggaacaatgcttcatggtcagaatcaagtacaggccaaacccgcagaacattcaagaggtcgaagtggagcaacccaagacggatagcctggtaaggttcatgcagaacttcctgggaaaggaaacaacaatgcccaggaaccgttattggaggacgctagtaaaatcacctgtaccggccaagaagttagagcagccagctcagaggaagccgtcttctgcactaaaatcaaaggtgtggaaggaaaagccaaagacgcccgctccattacctccggagacgggtggaaaatccgtgaactgaatcgaaaggaggtatggtcttgcacgacggactttaaatgacgcgaccttcgccaacaggtaaattggtatgtatccgcatatttgttttcaacaatttgaatttttgcatcaccacatatttgaatttcaaaattgcttttaggacttttgaattttgaggaaattcttcaaatgaatttttcagagcaaaccaaaataaaattttcaacgaaaattcactgtgccacgatcacactgaccgttggattccaacggccgaaagtggggccggttgggcccactaggggttcgcccgaaccggccaggcaacggtcagctgcctcactttttgaggcaacggctagtgggttccacatgtcatttttgaccgttgtgggtatcctacaaaagccagccgcccgagagagggaattctaccccatttcaactcattttcatttcctctccaaagtttgctcccaagttcattcatgctttgatagttttcctcaacttcaactctttagttgcatacatacaagttgctttggtgaaactaacaggcgggtgaaactcttgtcatttctaacccccgccgagttagcctgttcttgctccattgtgtagtatgaggaggcacctgtctcgtctgtcaaaggggtcgggctctctatcaagtcgtcatgacgagtctagtactcgttcatcagccgatgcctcgatggaaaacgccgacgctccgcgacaactcctgagcgacactgacctcgaccttgtcagtgatcgggagagacaagcctactacatcctgagcgaccgggagtatgctcacacgcgagaatactcaccggagttgctgaaaaagataggtttggatgttgaatttcgttctatttggaaagctgttggttggcagagatttgctgtggtagatgagtctggttctcgtttgcttactttgcaatttctgtgcactttgaaagaaatagaagatggtatttcttttcgccttttcccgtaaggagttcacgctcacatgaaaggcttgagtacacttcttgtttttcacgattcctttaaaatcgatctccagaaaggaatttcttggttcaagaaaaataggttttgggaagatatttcgggtgctccaatttgcaagaaacctagaacgaatgatatccataatcctgcacttaggctcatgcacaaatggattgctatgactttgtttcctagaagtgatctgagacccattaggggagatgaattaattatcatgtttgccatggttagaaagatcaaaatttctcctgtaaaatgtatgataagacaatggttagaaaatataaagttctttgctcctgttgagtgcacttctctgattactcggatagcaaaagggctaggggtcgttagcgaccaaattgcttttatctcagccgctcgtccgcgtattgatgaggcttattcagtgcaagggcatattttgaaacatggggtagatggatctttgatatacttttttcccggttgtacaaatgaaatcccgttgccaaatgcggggtatcatttgtacaactgccatgaactaaccattcccctgcagaccgtagaagaatcccgtgcagatggaacatacagggagacgcgcaagatgacaaggaacgaacaaggaagttcatcaccctcaacacccgtgcagatgtatgaggcaggttgggcaccaactggggatgcacccggatggacccaagctccacgccatagcatcggagtctcaacctggtcaagcgccagtgaggaccggtggcatgcgcctgatgacatccactggggggataatcaacctcccagatcaagtggtgtgcctccatgtccaagtgaatggggctcgagttcctctcattgcaacttgggtgaaatcactaggagaatggacacccttgatatgcagacgggggagatccagtatgacctgatggaacacatagctcaaacgcaagaatggcaacaatctgctgatgctcaattcaccaacatcaacaacatgatgcagcaacagcacgacgaccttcaagcatacttttgctttcaggggttcaatccttatcaagggccctaagcaaaagccaagcttggggggagacgggct

SEQ ID NO: 51675 - DNA, 707 bp, Oryza sativa
tgcacccggagcccaggcctaaaccattttgggatttttaatagaaagaacgggtgtgaagcaatttccacaattaccaaccattccatagtatccagatgatatgaatatttcccaaggtctatagttgaaaacccacctaatgttacctaattaaattgcgaagcatctacctaaaactaaactagtggtgccatgagtagagtgtccactagttgaggttttgtttattctagggtgaacaaggtaataataccaataccaataataataaggtcataccaaaggtaaataggcatggctaaataaaacagtgataacgcgggaatttaaataaagcgataatgcaataatttgaatcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggctcttgacttcttaaggaaaaattagagacttgaacggtccaattccgagttcaaatggccaagttatggccgtttgaagtttatatgctctttaaatggatatttgcgaatttcttcatttaaattttaatttaaaaactcatttattg

SEQ ID NO: 51676 - DNA, 974 bp, Oryza sativa
tagcatgtgtctcacactctgcactcattgtgaagaagaccatccaccaggggagtgtctcacccgcaaggtcacatgttttctgtgcgaaggtacaaaccatgtgcccaaggattgccaactcagtgtgttgttgaccaagaccgtagaaatccaacgaacaaccctacgattgtctcatcagctagtcagctccaacagcaacatcgacgatatcatccacagcaccaatgctcctcctgctgcacctgactctgcagtaaatcatagcgataataccttcagcaccaaccattctctgcaccgacagcctcagcaaagaattgtcgtcgatggaagaagttgtgtctctccccgacctactccaggccaagcaaagggcaatcaacctcaggagggcgataccaagcagaaaaccgtcatccacttcaaacagcaatcagaaggaagcttctcctgtgaatgatagcaatacgcagtcctaccacatcatcacagaaccaatcaaggatgcagtcactagaacaatgcgagctatatctctccagaatcaaaatgagcagccacgtttgtgattttcagttcgctacttatcattgtgtaatcgggagtttgcagcaatcatgtaataaataaatacattcatgattataaacaatgagtttgttatgtttatggaagattcatgtggaggatgcaatgtaccgatgttaagcaccttccctttttgtttaaggccaggccttgcattcatgtaataagggagacatgtgtaataaaaacaagtgctatgaggattatttcggaagatgctgatatgggattatgtgtataattgtttactgacaagggagacctagggtctcatatccgtaagctcataatctatgataaatcaagtaacctagttgttgatagaaaagaaagtgaagcgacctgtgttagattaaaaagccaaagagacttttgtttgg

SEQ ID NO: 51677 - DNA, 1282 bp, Oryza sativa
ctttggtgtctagctcgtgcctgccgtcaagcgcctgtggtcatcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggaataatgcacgcacgtcaggaacgcccgttgggttatttccggtcgtgacaccgagccatgaagttaagcatgaaatgaccctcgtacaaccgtacttctcgtatgggtatagacctagcggagtacacagccaagcgaagccagtatccctgcatagtggttattcttagtgtgtgtgggtcagggcctacggtggggcagccattggtggggtcgcgagggcgagtgcctacaatggtgtcgccatcggtaggactgccatgtgtaaactggacttaactaaaacttaatgcatgtgtgagtcttcccttcccgggagcgccagaactcctctcactgttagaaacttataacgcctagagtgcatgaggatgcaagttcatggagcgggtactgtcaacgtgaggttattgaaaggctttgccgtggcaagtctcattcgttgggacgtaggctcatgtgttgggcaagtcgcggagtacgggtaaagtgtacatccactgcagtgtgagtaaaaccaatctattcgaatagccgtgctcgcggatattgagcatcgggacatgtattacacttggctagactctaaattcttaaattgattaggatgggatatgcatgatgattttcttctggcggatcacctcctctagagaagaaaaggagtaaaccccagaaaaccattacggccggtaacgggaagccatctttgggaagataaaggggtggcgaacagaaccgttgctgtgtaataaacactggaattaaaactggactagtctatactagataataggcttgtgaaaagaattgtgaaattagctttatgcaaataaaccaatggccgtaccttgaatatctctatcatatgcactgttgttatgatggcttgctgagtacggttggtactcactcttgctattacaaaatttaatcagtggatggcaatgaagtcgaggaggatccctatgcttatcttcaggaggatgcggaggaggacggcgctccgtaggtcttagttatggtcgttgcctgtggcaatggcatagccgctgcctatattctgctgccttatctatttctgttattgcttg

SEQ ID NO: 51678 - DNA, 1290 bp, Oryza sativa
tatgcgcacttgatatctcagtaatgtaatcgtgagtaccagactacttgatccagggaaatggtactattaacacgagtgattcctgttataaaaacgggggtctacacaagatcacttgtttcttgtgtgaaggaattgatcatgtaccaaaagattgtcaactcagttttctgctgacgaagaagatggccaaccaacatgcccgttctaatggagagaagcatcaaggcaacacaaatcctcgccaagattacagtttcagcctaactccagtgccaggacagaggaatcaaaatgagaaaagaaaatgccgagtccggaaagatatctgttgcttcagttgtcaagaaatgggtcatttcgctgacaagtgcccaaaaccgagaaacatggctgccagcacgtcagtccacgcaactccccgcaatcagaagcttgctcctcagcgaattgtcatccatgcatcccgaagcagtcctatagcacgcgttgcaacagctccaactccaacgagtgcactaccacaaggtgtcaatgcaccatttcagtcccatccacctgctgacgagacagaggccagtatctgcgttgtacctttggatgttccaatacagcagctgataaatcaagtacaagatgaagaacccgagtgtaagaaagttattgtttgttacaactgtagtgaagaagggcattactcgagggactgtcctcaaccaaggcaaaatcggcccccacattttcgccaatttacaggaagcaaacatgccaatcgccaagtggtcactggagcaaatgcagtacctgttaagcctagtgctagtcaatagcaaccataatactcttatatcggtgttcaagtacttttgttttatagctgttccctgtcaatcatgtaataacagaggaacatgagataatgaatgagtttgacaagtttatgaaagatccatgttaagattgcaagtactgtgagttgtgtacattttgttgttgattaaggagacctagggtctcatttccgtaagctcataatctgttcaaaacaacctacgattgatggcgaagaaaatcaagtgatcaaccaaagagacatttgtttggactaagagtttcagatgtgtcttattcggatcaaaggcaacaatcgtcagtctagcttttgacgaactacttcaagggttctctgaaagacagcacgcccaaggacctcatcgccccagaagtatcctcaacacccggagtgaagagtacctggttgagaaaggtcgaaaggtgattaatgga

SEQ ID NO: 51679 - DNA, 5179 bp, Oryza sativa
gtacacctctgatcagagtataatctattcgaatagccgcgccctcggttatgggcgagccgagcaatgtacccaagttagtgttttaattcttaaaacctgcttaacagctaaaatgtggattggttggcctgggttggcttgggacgagctgggacccagggtcgggttgccagttcggtctgaatcatcgtaggccttgggttaaggcaggttcgtgtgggttcacggccttgataaataatattgtacagttctagaatcgtgtttacaaaatagctctgagcaactaaatatctttaaatgctgtttactgcaaaccctaaccctttatagtataactcctttgtactcccttgcatttattctgcatttgtgggtgtgtcttgttgagtacggtggttgtactcagtcttgctcaattttttcccaagcccagaagaagagttcctggaagatggaggttttggtgtctagctcgtgcctgccgtcaagcgcctgtggtcgtcgccctagtcttccgctgtttttcgttgtctttgagtgtgctgggccgtcgctgcccatgtaataattaactatttacgcttccgcttgttaaactctgatttgtatcaactgttggtgtaccttgcctcctgggacaaggattaatgcacgcacgtaaggaacgcccgttgggttatttccggtcgtgacatctcctgtgaccggcgacggcggcgagggggcggccgaggttccccacctccgtgcgcacctaacggcggcgatggcgaacgcgacggcgcggcgcggctgggcgtcggacggcggcggcggcggcttggacggcgtggcggcggcgctacggggcacaagaaggctcgggagttagggcaaacgaaagagggcgactagagggtgctatttatagccttagattggagagatcggactctaaccgcgagtaatcggaccgggaaaaactaggtttaggttttggggataaactcgaaaacgagtttgattcaggtaagatacgaagcgattagctccgatttttgggggtaaagatagaggacaacaaggggatcaaaacccctcaaccaatcggaaggcggcggctcgggcggactcggccggccggaggttgaagacaaccccgacatgtgggccccacatgtcggcggctgtgaggagggggaggccggtggctcggctgggctcggcgtgggcccgcggctcgcgcgaggagggagggataaatcggcccaacggcttgggggagggtttttaacactttttcaattaaaataatttgtgaaatgttgtttcatttattaaaaatacttcccttactcaaataattcccagaaaaatctagaaaatagaggaacaagcaaaatatttaatgaaattttatctagctcaattttatgttgaaaattttcctagatttttagagattaacttgtaggcttttaaaataatttctaaaaatgatttaaaatatgcattattaatttaggcgatttttagggcatgataaacctaccctccttaaacagaatctcgtcctcgagatttagaagaactggcaaaaagatgaggatgatctgacttcaattcatcttctcgctcccaagtggcttcttcttctgaatgattgctccactgaaccttacagaaccgtatgacgcgattcctggtgttcctctcgctcacttccaagattctaactggcttctcaacataagttaaatcttcttgaagctctatacgctcaggatctgcttccttcataggtacacgcaaacatttttttaactgcgacacgtggaacacgtcatgtattcctgccattgacagaggcaactctagctgataagctacttcaccttttcgactcacgatcttaaaaggtcccacaaaacgcggtgccaatttccctttggtttgaaaacgatgaactcctcgcagtggcgtaactcgtaggtatatataatctccttcttcgaaagccaaatccctacgacgattgtcggcatagctcttctggcgcgactgggcaactcgcaacctttcttggataatcttcactttttcttctgcttctcgcaagatatctgtcccaaacacttgacgctcaccagtttgatcccaaaggagcggcgtacaacacttccggccatacaatgcttcatatggaaccatttgtagactagcttgataactgttgttataagagaattccgcgtacggcagattcttataccaacttccaccaaaatctagaacacaggctctcaacatgtcttctaaaatttgattcactctttccgtctgaccatcagtttgagggtgataagcagtactaaaattcaaacgagtacccatctccacttgtagtttctgccaaaacttcgaagtaaactgactacctctgtctgacactatcttcttgggtacaccgtgtaaacataccactctggccatatataactctgcgagcttatttcccgtgtaggttgttttgacaggtatgaagtgagcgactttagtcagcctgtcaaccactacccaaatagaatcatgtcccgacgacgttctgggtagaccggtgataaagtccattcctatttcttcccatttccactctggaatcttcaacggttgcaacagaccggctggcttccgatgttccgccttgactcgctgacatacatcacatagagccacatattctgctatttctcgtcgcatgctggcccaccagaattgttgcttcaggtcttgatacatcttagtgctcccggggtgaatggaatacaaagtttcatgagcttctttcatgatagtatccttcaactccttattgtcgggcacacaaattctttctcctagccacacaattccttgctcatcttccacatatccgatggcttttcctcttctcatgttcttttttatttcttggatatcaggatcattcacttgagcttatctaactcgatcaaactgggtaggttgagcttctaaagcggcaacaaaacctttgttgactattcccaagttcaacctttccaattcctagcataactcccaaggtagatgtcatccttctgacatattacagtagcttttcctgctgagagaatctgctaccacatttgctttacctatgtcacgcccggaatttctatccaaaattccaaacgcttacatgtgtgtgaaccctcgtccaggaatcagccgaggcacacaataacaaattgataatagagtacatttattactctaattaataagcgaataaaatgtcattacagaggtagatagttcctctcaactcaatcaataaagatctaagcagcggaaaataagataaacggcgcagacggctccacaccacaggcagcttgaccaaggctacacctaatcctccacaccatcagcttcactgaagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaataattaaacaatattaaatcaacgctatacaacataccctgttgtataggcccaaccattctgaacaaccatcccggctgcacagttctatctccaaaccaggaatataccattccaaaccaggagctaatcaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttacataacacaatccaccgcagcgcacctttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatgagtcataagttatcccaataatgtgctaatgtttctaagcagggctaagcaattatatctaatatctagttgaaccaatatacatagcccaactagtcaagttataaataacccaaggtatcaaggaataaagtaatcaagaacaaaagggctataacaaagaataggttaattccacccaatgacattcgaaaataaatgcaatagttgaatagaaacaatagcttaaaataggatcaacatgctcaaagggttgtttgggatctgtgtgacttgccttactggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaagggatttattgcgtcagcgggctagggtttcggtggaccgggcgcacggcggcggttcacgcgaacggacggccgagatcgatccatccaaaacggacgtgtcgagatcgatcggtccacgaccggctcacgggagacggggacgatgacgtcagcgatgacgtcaccaccggcgtgcggcggctcggcggctcgacaaagcaagcccgccggcgaacggcgacgcttcggcacgaacggaggacaccaacgggtagagcgcgacgcgatgaactcaccggtg

SEQ ID NO: 51680 - DNA, 2038 bp, Oryza sativa
acacgaagatacacataatctccttcttcaaaactcaaatctctgcggcgattgtcggcatactcttatgacgagactgagccactcgcaatctttcttgaatgattttcaccttttcttctgcttcccttaggatatccgtcccgaaaacctgacgttctcccgtttgatcccacaaaagcggagtgcggcacttccgaccatacagtgcttcgtaaggagccatctgaaggctagcttgataactgttgttgtacgaaaattcagcataaggtagattcttatcccaacttccaccgaagtctaaagcacaagctctcaacatgtcttccaaaatctgattcaccctttcggtttgtccgtctgtctgcggatgataagcagtactaaagttcagcttagaacccatctcttcctgaagtttcttccaaaaatttgaagtaaactgactgcctcgatcagacactatctttttaggaatgccatgcaaacacacaattcttgccatatacaattctgctaaccgactcccggaataggttgtctttaccggaatgaaatgagccactttggtaagtctgtcgactatcacccaaatagagtcatgacccgatgacgttctaggtatttttgtgataaaatccataccgatttcttcccgcttccattcaagaatcttcaaaggctgcagcaaactggcaggtttctgatgttctgccttgactcgctgacaaacatcacatactgctacgtactctgcgatttcgcgcttcatacttgcccaccaaaatctttccttgagatcctggtacattttgatactaccagggtgaatagagtataaagtatcgtgagcttctttcagaattgcatcttttaaatctttgttgtcaggaacgcagattctctcacccaaccatacagttccgtgctcatcctccaagaaaccgatagcttttcctcttctcatattcttcttgatctcttgaatatcaggatcattaatttgcgcttctctaacttgatcaattagagtgggcttcgcttctaaggctgcaataaaatctctactgacaattcccaaatttaatctttcaaattccttgcataattccaatggcaacttgtcgccttctgtagcattgcaatagcctttcctgctaagagcgtctgctacaacattagcctttcctgggtgataatgaattcccatgtcataatccttaattaattccaaccatctcctttgtctcatgttcaggtctggctgagtaaaaatatactttaaactcttgtgatcggtgtacacctcagtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggtaaaatcaaaataggagctgatatcaagcgattcttcaactcttgaaaactctgctcacattcttccgatcgtggtaacacattacctaggtgataatgaatttccatatcataatccttgatcaactctaaccatcttcactgtcgcatgttcaaatcaggttgagtgaaaatgtacttcaaactcttatgatccgtatacatctccgtacggttaccaaaaagataatgacgccaaatcttcaatgcaagcactaccgctgccaactttaggtcatgcgttgggtagttattctcatgagggcgtaactgcctagatgcataggcaaccaccttcccatcttgcattaaaacgcaacccaaaccatgtcgggatgcatcacagtacacttgaaaacctttcctaggatcaggcaagactaacacaggtgcagtcactagcctttccccccctttcccgctgggccggccgaaggccgaggcccagctgagccgagccggccgcccgcctcctctccc

SEQ ID NO: 51681 - DNA, 2055 bp, Oryza sativa
  unsure (1)..(2055): unsure at all n locations
catttaaccttggtttatttcttcttaataataatttgtgctctgaaaattccactaaaatgtatttacgcattttaggcttttaggaaatatacaaaaatcctccaagccttattcgacttttaactttgcacattttaattgttggaggctttcacatggattttacttattctatgcataatttcgaggatgtattttagatcgttttgggacgcgacaaacctaccccccttaaacggaatctcgaccccgagattcggaagaactggcgaagagatcgggatgggccgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgcgctgagtcggcctgctcggatggcactcggagacatttcttgagttgcgacacatggaacacatcatgcacgttgcccaaggaggcgggcagctccaactggtaagcgacttctccgcgccgagcaatgatacggaaaggacccacataccgaggtgcgagcttcccttttgtctgaaacctgtgtacacctcgcaatggcgtgacccgaagatacacaaagtcacccactgcgaattccaggtcacggcgacggttatctgcataacttttctgccgggactgtgccacttttagattatcccgaatggttctgactttagcttcagcttccctcaggatatcagtcccgaacacttggctttccccaacttggtcccacaatagcggtgtccggcatttgcgcccgtacaacgcttcataaggtgccatttgtatactggcctggtagctgttattgtaggagaactcggcataggggagactcttatcccaggtcttcccaaaatctaggacacatgcgcgaagcatatcttctaggatctgatttacccagctcttcttggagcttcttccaaaagtgagaggtgaattggcttcccctatcagatacgattttcttgggaacgccatgaagactcacgatcctagcgaagtagagttcggctagtttggtccctccataggtggtcttcacaggaataaatcgagctacctttgttaatcgatccacaactacccatatagaatcatatccaccttgggttnttggaagtccggtgatgaaatcccatcccaattcatcccatttccattctggtacttggagaggttggagaagtcccgcccgtccgttgtgctcttgcttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatttggaacgcatacccgatttccattccatagggtcccgtgttcatcctctgtgaaaccagcggctttaccctgtttcatattcttgaggagtccatgcatgtccgggtcgttcttctgagcctcgcggatttgatcgagcaaggtaggtttggcttccaacgcagccaagaatccacgactaactatgccaaggttcagggcttccatctgttgattaagttcgggtggaatgccacggacgttaagagtgttgcaatggctttttcgactcagagcgtcggcgaccacgttggccttaccaggatgatagtgaattcccacatcataatccttgatgagttctaaccatctcctctgccgaagattcagatccgactgggtgaagatgtatttcaaactcttatgatcggtatatatttcacagcgattcccaataagatagtgccgccagatttttagagcatgaaccaccgcggctaactccaaatcatgggtagggtagttgccttcatgaggtcgtagctggcgtgaggcataggccaccacatgaccgtcctgca

SEQ ID NO: 51682 - DNA, 758 bp, Oryza sativa
cctgttgcaacgtgggatagcgttggacagtggatagttaatactaattaattattacaactgtttaatctttcaacttctgtttataaatgctcgctttatgcaaatgatccactttagctcttctttgatgattccctgcatcatgcctctattccggtatgacttgctgagtacagtgggtagtactcagtcttgctctacttttcccaaccccagagtacgagtatgtgtcagatgaaggtttctccgaggaataggctttgcccgtgccgtcgaggatgcctgtggagtggtgttcccgctgcagttctagtcaaggcttagctcctgttgtctttctttctttccgctgcatttatgtaagacttttatgatatttgtaagacgtggatctgaatgtcaacattgtcgtttgtgtaccccggccggtcctggacggggattttaatgcacattctgcttggaattctattcgggaatttctgggcgtgacattcatcaaccttccttgccacctcctcttgcatgctgagctcgtagctcgataccctgaactcaaaatctgcaatcttcgcctcggtatctctcttgctcctcatccaactcctatacgtgtggatgtcctccttgaacccaatcttccaaggaatcactcctttccctcgtgttcgtcctggatgctctggagtctgcagggcgagtaacagctcgttcttctctctgtccggtcggaacgtgccctgagaagaagcttc

SEQ ID NO: 51683 - DNA, 865 bp, Oryza sativa
  unsure (1)..(865): unsure at all n locations
nnnnnnnnnnnnnnnnnnnnnnnnnnnnnnnnnnnnnnnnnnnnnnnnnnnnnnnnnnnnntgcattaaaatacccattacatagagataccagcacaatctgatttagtacatcaaatcagtcatcatcttcaattgtagtttaatgtttctaaattcactgactgacaatttgttatggtgtatcatatttgctagtaggatgagcacattttccctgcttaatctgatttagtacatcaaagcagtcatcatcttcaattgtagtttaatgtctctaaattcaccgactgacaatttgttatggtgtatcatatttgctagtatgatgagcacattttccctgctttcagtgcgctcttatttcctacatcttagcaagtgtaggaatcattttagatgattggaatcttatcttatttattgttttattgtatgattctgatgttctaataaatcctttaaaggctaggccgcacatctgaattcataatctatggaaatgggcagcagaggagggctgttattgaggcagagcgtctattggaaagtgacaaaaataatggtctaggagatgcaaataagaattgcgatggagatattaaaaattctttcaaggacaaagctaagaaatggcagaagtttgttacacaggtgccttctacttttgaagaattcatcatttaagcatttttgtttttattcccttctctattttggtgcatagggagcttttgaaaggaactgggtacatgttatattgtatgcatcctgtaaagtgaggtgcactgttgcatctacctaaagtgtgtgtggaatgctaattctttctagattggatatgctagttccaccttactgttac

SEQ ID NO: 51684 - DNA, 826 bp, Oryza sativa
  unsure (1)..(826): unsure at all n locations
nnnnnnnnnnnnnnnnnnnnnnnnnnnnnnnnnnnnnnnnnnnnnnnnnnnnnnnnnnnnnnnnaactccgtgctcgccctcgttgccggccacgacacctccgccgtcctcctcaccttcatgctccgccacctcgccaacgacccggccaccctcgccgccatggcccaaggcaagtagtagtagcactaactttcctctcctctcgcccaagaaacccaactctcccctcccctgacgaacactcagagcatgaggagatcgccaggggcaagcgagacggcgaggcgctgacatgcgaggacgttgccaagatgaagctgtcgtggcgcgtcgcgcaggagacgctgcgcatggtgcctccggtgttgggcagcttcaggagagcgcccgtcgacgtcgagttcgagggctacacgatcccgagagggtggcagatcttctggtcgccgagcgtgacgcacatggatccggccatcttccacgagccgaccaagttcgagccgtcgcggttcgacggcgcggcggcggcggcggcgtactcgttcgtgccgttcggcggcgggccgcggatctgccccgggatggagctcgcgagggtggagacgctggtgacggcgcactacctggtgaggcatttcaggtggaagctctgcctcggggaggagaagaacacgtttctcagggacccgatgccgacgccgcacgacggcctccccgtcgagctcgaccacatcgctcctctctgctaagccgcaccatccgttatcacgcttctcttcctccgtatctgttaaatggtgcttcccccaagtttttttttgg

SEQ ID NO: 51685 - DNA, 910 bp, Oryza sativa
taaacggcaaagccacaaacttgctgagaccgacaatccctctgggaataaggtgtccttaaagatgccacatattgcttcttcttgcatcattccagttacttattctatccatcattttgtatagatcattgttaaggagtgccacagtgaagattcacaatgtgcatttgttattgacaagattattgaaaccacatctagttcagttgaaggatgtcattttggcaaaattgctgtcctatatcgcagacaggttgagaaatcttccacttattgctgaaccatattttttggttgtgtttatggtctaagttacctgtacacagatcactggcaaagcattccaggcgtcattccgcaacagaaaaattccttttaatattcatggtgtggctttctacaggaaaaaggtgcttggattaatttttactcccaatattatcgcggactagcaatttcttgtgatttcttgagttgctttcttactgccaaattatcaatttataatccttggttctattaacattttaaaacatgaaaattactggtaccttttcaaattaatactttagttgttgctgaccataatttttctgtgtatatgatatgaagcattgatttggtaaacacaagtgcactatcatctataattattcaagaaaccaaccatgcaggctgattttgtttttttcaccaaattattttgggaatgttctgtgttattatatggtgtattgtgggggccaagggtcttattagtttttgaccataaagtttgtttggttgctgatcgtagtttccttcttttctagttttttcttcgttgtgtttaaccctggcccttaagggcctgtacgagtctttctagactcactcccctatcttctaatataatgatgcacagctc

SEQ ID NO: 51686 - DNA, 786 bp, Oryza sativa
ggccggaaccttgggggccaacggacgttccgaaggcttgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatctcctgggtcggaggcgctgacgaaggagtggcggccgaatggcgagcaacagccgccgctcgccacgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggaaggggcggtggagtacgagctcgacggcgtgggttcggctccccgtcgtcaccgctaacactcggagagaggctgtgcgcctttgcttgttcggccattgggctgaacaggaaaagctgccgcaaacgaaagagtgcgagagcttagaaaaacacaccccgaaccccct

SEQ ID NO: 51687 - DNA, 792 bp, Oryza sativa
attccctgcatcatgcctctattccggtatgacttgctgagtacagtgggtagtactcagtcttgctctacttttcccaaccccagagtacgagtatgtgtcagatgaaggtttctccgaggaataggctttgcccgtgccgtcgaggatgcctgtggagtggtgttcccgctgcagttctagtcaaggcttagctcctgttgtctttctttctttccgctgcatttatgtaagacttttatgatatttgtaagacgtggatctgaatgtcaacattgtcgtttgtgtaccccggccggtcctggacggggattttaatgcacattctgcttggaattctattcgggaatttctgggcgtgacattcatcaaccttccttgccacctcctcttgcatgctgagctcgtagctcgataccctgaactcaaaatctgcaatcttcgcctcggtatctctcttgctcctcatccaactcctatacgtgtggatgtcctccttgaacccaatcttccaaggaatcactcctttccctcgtgttcgtcctggatgctctggagtctgcagggcgagtaacagctcgtccttctctctgtccggtcggaacgtgccctgagaagaggcttccactacgtctgttagtcaacgcgcagcctcgcgtatctgatcgccgaagatcagggagccatcagctgggttgagcgttcaaccgtgagcatagtaccagaacttcgatcattccggccaattagcggtggccggttcgatacccctctcaagcaagctagcctcta

SEQ ID NO: 51688 - DNA, 5094 bp, Oryza sativa
  unsure (1)..(5094): unsure at all n locations
annnnnnnnnnnnnnnnnnnnnnnnnnnnnnnnnnnnnnnnnnnnnnnnnnnnnnnnntcttgtatagtaataagcacagtgaatcttctaaaattcataactaattcatccgagctccgtttaagcccattcaagtctcagtaaatcaagaaaaatgtgtagaatccattaaaaatggttttgttcctgtttcagtagtcttatagcctgtttgcaatgtttgccttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgtttcctttcaaatattgcattgttttataatgttactatgggatgtttacctattgtcttagccatgttattgttgtaccttgtccctttgtcagcttggggttataacatgactagagattggaccagggattgcttagccatgcttagttcaactagtgcacaatggggaaaatcctattaatgtttagactgttggttctaatggttttgttggattagtgacaccgctttggtgttggttaattaaaataaatcacatggtgggttgtgggtgcatggttttgctggtcgcacccatggcaattaaggacctgttcgcgggatgccctggaagaacttatcgtacttaccacaagccagcgtgggcaacggctgggcttgtagtgtagctctcctctagtcaacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcatggaaacgtgttgtggggctgtgtcttgtgggtacagttgtacacctctgatcagagtaaaactattcgaatagccgtgcccgcggttatgggcggtcaaccagattcaccgtgattagtatcaccctagtgtaatctttagaatttggatagtttaggtggatggttgggcctgttgcaacgtgggatagcgttggacagtggatagttaatactaattaattattacaactgtttaatctttcaacttctgtttataaatgctcgctttatgcaaatgatccactttagctcttctttgatgattccctgcatcatgcctctattccggtatgacttgctgagtacagtgggtagtactcagtcttgctctacttttcccaaccccagagtacgagtatgtgtcagatgaaggtttctccgaggaataggctttgcccgtgccgtcgaggatgcctgtggagtggtgttcccgctgcagttctagtcaaggcttagctcctgttgtctttctttctttccgctgcatttatgtaagacttttatgatatttgtaagacgtggatctgaatgtcaacattgtcgtttgtgtaccccggccggtcctggacggggattttaatgcacattctgcttggaattctattcgggaatttctgggcgtgacattcatcaaccttccttgccacctcctcttgcatgctgagctcgtagctcgataccctgaactcaaaatctgcaatcttcgcctcggtatctctcttgctcctcatccaactcctatacgtgtggatgtcctccttgaacccaatcttccaaggaatcactcctttccctcgtgttcgtcctggatgctctggagtctgcagggcgagtaacagctcgtccttctctctgtccggtcggaacgtgccctgagaagaggcttccactacgtctgttagtcaacgcgcagcctcgcgtatctgatcgccgaagatcagggagccatcagctgggttgagcgttccaccgtgagcatagtaccagaacttcgatcattccggccaattagcggtggccggttcgatacccctctcaagcaagctagcctctatctcctcccacttcggcatcgtgacgctatagccgcctgaccccaagtggtgatggtacttcttcttggtagcattttctttgtttctttccatcatcgcctgcccttgttcacctgtcttatatgcaacgaactcgtcccagtgatcccttagctttgggaatgtgtcgaagttcggtgtctgccccttcaggatatatttctggtacagatctcccttgaagctctgaaactgttctgccattttcttcagagtccaccttttcactttgtcaagagacgggcggggcgtggacacattgcgcgaggagggaggagcattggcccggggccacgacgtaggagggataccgcgattctgccatcagccacagctacacatactccatcgctttcatccccatcccccagtggctgcacatccatgtagaagtgggcagggaagtaggacatatgtcgtggtttgggggcagatccgctaaaaagtggatatccgcgcgcccttcccctgcgtggatagacgcgtggcacgcggcgcgcgcccctccccctgcgtggatggacgcgtggcacgcggagagggggggcagtcgctcgcgcgtgggaagcccacgtgggtgggtttttttggttggttttctttttaaaaaaaatagttttctctggttttctttttctttttttttggttttttggttttttatacgtgtggatacaaactttatatacatacatgtatataaactttatatgctcatatacaaactttatatgcgtgtgtataaagtttgtatatgtatatacaaagtttgtatacatgatatattttttagtattttaaattttttaatacgtagtatataaactttgcgcgcgcgcatatatatatatatatatatatatatataattatagtagtagtactagtattaatagaactactattactactattactggtagtggtaatgtggtagtattagtagtagttgtagtatttgtagcagcagtagttatactaatggactaaggcgggcaaaactgaccgtgcgggtgcagccccgcgcggctggtcaccgaccaatcacacccgggggaggggggtctggtccggcaccacgcggtggagagaatggagtggggttcggcaggcggccgttctctccctcaaatttttattttattttttgaactttttaaatttttaattttaaaacaaactctttcaaaacttattttcaagatatgaaccttttggctacaccagttagattggcgtggtaaaataatactatcacattggtctggctagtatggcagcgttatttggtcacgtcggtctggctggcgtggcaacgttatttggtcacactattctcgctagtgtagtaggacaaaattattatgctcgctatgtgtggggtgtcagtattgttttgccacgccagactagttgatatggccaaaggtttagattctgtaataagttttagaatggtctgtttttataatttaaaaataaaaaagttcaaaaaaaaatcctccccctgtaaggtgatgccatcatttgagtggatggccagcgcctttgccgtggccagtcaaaatgggtcggctgtggtggtggcgccgatgctgccggagctagcaaggccggtgccgtcggggttgccaacgaagatgcaagcatgggcggcaccaaatttctccgtgcaatatcggaccaaagacccactactacgactggcccataggtaccagtttatttaaaaccgatacctataccccttttctcacctctgccacaatgaaaaaaatatagaaccggcacctttaaacacataggtgtcagttttagggaaaaaactggtaccaatactacatgtgtcggttttttagaagaatcgacacctacacttacattacaggtatcaattttagagaaaaacaggtaccaatactacaggtgttggacttttaaaaaaaccaacacctataatataactataggtaccggcacctattaaaaaaaataggccatcatccttcctctccgtccttatattttcgagactgcctcctctccatctctctcacactggtctcctcctctccaccgtcctctccatccgccacccctcctccccccttctcctccgcgtgccggcggcggtggcccctcctcccctggcacccgcctacttcacgtcgcacgcgtgtggtggtgaaggtggcggcaacggtggtataggtgccggttccaaatctggcacctataagacctttggagccagcaccaatgagtattttttttagcagtgaccatggcatggcaacaccattgcggcatcttgcgaaaggttttggggaagagccactcgatgccgatggcaaaggtagaagaatgaaattgattcatgttcttaccttggaagaaatcgaccaatctcctgttgacgaagaacgtattcttggccttctatcgttaagtggaacaactaacgtgcgtgataacatgttagaagtaaagaactctagagatgaatgattcttgtatttacttttcacttgtacatggcattactggggaagggctctttagtctcggtttataaccccttttagtcccaggttgtaaaccgggacgaccaatccgggactaaagatactcaatggatttttagtcccattttagtccggttggttaggcttttttctttcctttatttttttttgcttcttgcatttattgtcaccctcatccccacaaatcatccccaaaccacacaaatcatcaccaaatcatgcacaacaaatcatccacagttcttagcccatccacaaaatcatccacatccacgagtcattcacaaaatcatcccaaaatctaaaataatctacaacaaaaattacaaatcattccaaaaataaaattttcacaaaacacgccgtccggccgnnnnnnnnnnnnnnnnnnnnnnnnnnnnnnnnnnnnnnnnnnnnnnnnnnnnnnnnn

SEQ ID NO: 51689 - DNA, 7686 bp, Oryza sativa
atccacagttcttagcccatccacaaaatcatccacatccacgagtcattcacaaaatcatcccaaaatctaaaataatctacaacaaaaattacaaatcattccaaaaataaaattttcacaaaacacgccgtccggccgtgtgccgcctctcggcctccgccgcccggccgtctccgccaggccgccttcgcccgtccgccgccacccggcctcccctcccaccggatctggcggagggtaggccgtcggccgtgtgctgctgccgctttggcgacccgacctctgccgcccgcctaccgcatcgtgcgccgccgggccgccacccgctgtcgccgtcgtcatcgtcagaggagggaggggagaggggaggagaggggaagggggaggagagggggagggggaggaggtgggggagatcgagaaaatgagaggggaggaggagaagaggaggggataaggacgaggcagcgcgcgtggctcggtgcaaggattttcgcaactttttttaactttagacccggttggtataaacaatcgggactaaagatggacaccaaccgggactaaaaataacagggctctgatatgtttttgaactaggagtaaaagtaatatttagttccggttggtgttactaacctggagtaatgatcaaaaaatacctgtgtgttttcaaaccgggactaaagatatttttaatcctggtttttactcaaaccaggactaatgtgatttttgagtgaaccaacaaagataattttttcagtagtgtgggatgattacatacatatatatagcccatgaaggggcatgaatcttgtacatgggatgattacatacatgtatatagcccatgcgtcccttgctaattgatcacatggagatttagttttaaccgaatgctaacgaaggaaatggaaaggtagcgaaaactactcccttgcatgaaccttccgaattactgctgggaggccaaagattataatgaaggaccagaagttcaaaaacaaattaacaaagacgttatagaacgtgagtcctaaagtccatgctacatgcattcgagttcccaatctagcacgggccatgtctgcgacacgaaggatctgccaggcttccgaattcccgtagagcgaagacacaaagataatcacacagaccgcagtcgcgatcgtgtgagcaactggagccagcaccaggtatagccccaacgcgaaggcgaccacaaagcttcttcccgaactccgcagcaagagggcagaaatttcgaagtacctgcagcgtatagagatgtccattgcagggaccccagcgaagatcaggctgaaggtcgccatacacgagcaaatgaatgccagcgtgtcagataaaatgaaggcgtcaaaggcatagctcccagcaagcagtggtgtgcctgccgcgttatccgacccggtttggtaacctccgggcaacgtgaatgctgacgcgaatgtcacggtcgcgacaagtacggacacaatgcccagcatttgcgatgcatttgttagatgcgccgagaccttgccgttgtctatctttgggatgtgtttttgggataagaggtccggtcgacttgcaccgcatggagctcccacaaattgcaatgataattgtatgagaccccttggattctgcgagaatgaacagttaatatactagtatcatttaagcaatgatcttgtataaaaatattactccctccattcaaaagtctaaaatctatttcaccttttggtttttccaaaagtttaaaccgtatttgtaatctctatatactaaattaaatggaattgctaaatatttgttgacagattttttatggctaaatctttcactttctaaaccgttgaatgtgtcctagattcatgctataacagtttaatacgcatcaagatatgtgcttttaggaagaaaaacaaaaccatatttaggggtcgatctttgacctcatgggatgaaggcgtgactgccccattgggctactatatttttatgatctagcttgaacttatatcttacttatactataattacacgtgagttacatgcaagttacatatgtaattatagtacaaatatagtgtaattataaaaattacatatgtaattatagtataaatatagtgtaattatgaaaattacattgtaattatgttacagttacatttgatagatttttaggctaattttcagttgaatgttgtatagatagtccctaaattaaattgttgaccagaatccgagaaaccatcttattacttatttgtttgtgtataatttaatggttttgttacgtagtggatgagttaattactctttagttttgatggtaaaatgaaataggtattaaacttttggatggagggataacttataaagtttgggtggagggaactgcctcttgaaataagaacaatagcactagtaacttaccgaatcataataaaacgatgaagggactgtaatccatgaaagatcaagaggcgtcaactcatacttgttcggtatgttcagatgtacatgcggattccgagttaggcagttaaaaaccggcagattccctagatggacagctcggtgtagggcggtgtccccattgttatcctgcatgttcagaacggacgaaaattcttttggcattcggcggcagacatattcaactactctgtatccctccgcctcaaccgcggaatggaggaacgtcctccctttggcatctcgcaaagtggcgcagtccgggcatttctgcagcatggtcctgactacgtcgaggctgtcagccaaggcagccacatgtatggggtataatccttcagcgtccggttgatacgctgcacatgtgttggcttctagcagcagcgcgactgctgatttcggccgcggccaaacatctgggaaccatttagaaagaatgcccacgtatggccacccttccagcgatgcagccaggtgaagaggcgtgctccccgtctgatggtccctttgctgcgccagatgcgatacaagaggcaccctgatagcacggtcgccttgttgcacgtccaccgtcacgtccttcagccactccaaaagcacaggcagcgctgcatgcatgtattatgtatatatgcagttgcagtttgtatttaattaattgtgataatctcgatcactcttaattagcccgcaaaataagatgcatgcatccagcaaaaattcgcctcctaccttaccacccgaaaagtgaaaagtgtgcaggattgagatggaaagcaattgacggtaagggtatatatagggttccaacacctctaacgggtcagtgtttgagcccatcagagatgagttaaactcacctttgacaggttagaacacaaggtttacacttttgattccggcagaaattttggtgatttcggtaggaccaaaatttcgggatttttttgcacttttttgaccgaaattttaactgaatttaaataaactttgaccaacttcaaccgaaattgcaatcattggctaaaatagtgagacccatcacatgtatatggttacttgtgttgggctgaaatttataccgataaagggccagaatttgcacccggcaaaggtagacctcagtcaggtgtaaattttggcccatcacaggtaaccaaataaatatgacaggcctcggccgatggcctcacctattatggccttattaatccattaaagatgaggccatccgtgacaagtacttttgacccatcacatgtgagccgatctagcgtagtgttaggctgtgtttagatcaggggtgaaaaattttaacgtgtcacatcaaatatatggacacatatttgaagtattaaacatagactataacaaaacaaattacagatttcgcatataaactgcgagatgaatttattaagcctaattaatctgtcattagcaaatgtttactgtagcaccacattgtcgaatcatggagcaatctattatattattaaaggaatagaaaaaggagcctccacgttcgctctcatagcctataaattctcaaattaatcggagaaaaagaaaaggtagagtccatatagaaatacaatttagaaatagctgaaattcggaattaaaaaataaggaatattagaagaggatactagagtccatatagaaatacaattaggaaatagttgaaattcggaattaaaaaataaggaatattagaagaggagactagagtccaatagaaatacaattaggaaataactgaaattcggaattaaaaataaggaatattagaagtagagtatagagtccatataaaaaagcagagtccatatagaaatacaattttgaaatagctgaaattcagaattaaaaaataagaaatattagaagaggagtctagagtccatatagaaatacaatttagaaatagttgaaattcggaattaaaaaataaggaatattagaagaggagactagagtccatatagaaatacaattagaaaatacctgaaatttggaattaaaaataaaaaatattagaattagagtatatagttcatatagaaatacaattaggaagtaatagaaattcggaattaaaaataaggaaaattagaagtagagtatagagtccatatagaaatacaattaagaaaaaaaatagaaattaagaattaaaaaataaggaatattagaagtagagtatagagtctatatagaaatttaaaactaggtaaaatttagaagaaacataataaaatgaaaagtagtgtttagccgtataaaaatacaattaacaaataactaaaattcgaaattaagaaaaacataggaagaagagtttaaagtcaatataggaatacaatttagaagtaaataaaatttgaaattaaaaattaaagaatattgaaagatgagtttagagtccacatagaaatacaattagaaataataaaaattcagaattaaaaaatatattaaaagacaagtctagagtccatatagaaatatatataatttacaaataactaaaatttgatattaaaaataattaataactaatacgtatataaaatataatatgaatattatacattagtagtttcgtaaagttattgtaaaatttaaaattatattgtcattataatatattttaataatataataaaaaaatatatatgctattatatgagagaaaatataatgatgttagccgcgcaatctgcgcgggccatcatgctagttaggcttaaaagatttgtctcgcaatttatacgcaatatgcataattagttatttttttcgtttatatttaatactctatacatgcgtccaaacattcgaagtggcagggtgaaaaattttgccagaagatttatacaggcccttagtatcattttcacgtaccttgaccacgagaaatagccgcatgcaacacgttttgtccgtcgagtccagagtaggacaactggccattagttttgtccaacagatggcgtgcgatatccagtttacccagtgaaaatgccaggtagaagggggaagcgccaccctccccctcctgtggaacggtggccagcatcggatccaccagcagcagctcgtctatgcaggccgtgcaggcagcgcggaccgcctggtgcagcgcggtctccccgcactggttccgcatcctgaggaactcctccacacctggcccgtctcccgcgggcgcggccaccacctcagccgtcttgagagcgacgaggcaggcgaccatgcgggcacccccagcgcgggcggcgcagtgcaggggcgtgtcgcccttgtggttgcgcgcggcgaggagggcgccgttgctgctgccgtgttagtagatcgtgttggcgcaggcgacgaaccggtcgccgtcgccgccgccgctgcgggtggcgaccacatggagtagggagtcaccctcgttgctggtcaccccatgatcatcaagttgttggagctgatgatgcgacgaccccgaggccgaggaggaggagggagcagcaggcacagggtcgacgtccacgatgactacctcgtcgtcgtcgtcgtcgtcgtcgtcgtctggcctaagaagttccttaagcccgttgatgtcaccgcggcgagcagccatgaacagcttcggatcaagcagtgtgcccaccggccgtgcatatgctgctgcggtacttatggaagcaacagctggtgcttgggtagcttcgtcggcggtttctacgacgccggccatcgatcgatcactagctatggcttattgttagtacggttgatcagtgatgcctggaattctcagtaagtcggtaaatacatagtccctcgtcgatcgatcgacgcgcttaaatcactggttcttttttacttcgtattttctggccgggacggcgaaagtgacgccatcagaatttttattacggaattgctggttcatttttattactactgtgaaagtgaggcctttccacgagcagcgcctatttccacgagcagaatttccgggtgcttacgaggagacgccttttctattaaaaacacgtactgaaatattctttttttgatgggacaccttactgaaataattggaatgggacattagtgcaattgtgcttaacctggccctctgccttgtataccaacgacagcgactgagcatatcttatccagtagggctgagtatttactgctccatccgtcctaaagaaatttttgttgaatgaaatatactctgcccgttctaaaatataagcatttttaatatagtattaagccaaatatttttaactttgactattaattagaaaaaagcttaatcatgtaaaattaaagttactaaatttatcattaaacaaatctctactattataaaattgaagatgtttttgccggtacattcgtacgtcattcgtgtatgagtcggtttttaacttcgttcacttttggaaatacatttacatatttgagttagtttttaagttcggtcgcttttggaaacacagaaggagtcatgtaagaagtctttttttaaaaaaaaacttgcatgctaacttgacatgatcggactcctaattacagcttaattatgactttctaaaaaatatatatatccaagcaaattcacacagtgaatttcaccttaattaaactgtataactgacggagcgtggggctcctcaccgggagaccgcgcaggcccccctttgccggttcggccgggggccctgggtgagattctaagctctcggtatgtagaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctggaccccccccccaaaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgagacatgaccagtgtc

SEQ ID NO: 51690 - DNA, 4457 bp, Oryza sativa
  unsure (1)..(4457): unsure at all n locations
nnnnnnnnnnnnnnnnnnnnnnnnnnnnnnnnnnnnnnnnnnnnnnnnnnnnnnnnntcttcatacaatgtctggcttgtaatggttaggatgaagcctggtatatatctgaccgggaccacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatatggttaggtgagccccgctatgctcacctaccccatatacgcggcgcaaaacccacaagtggtcggggcgcctcggccctcggggccgagacgggagcggtccgacctctcggggagacaaagagaagggcggccgtatcaccctcgggcccgacccccccccccccccccgagggggttaggccacgtgggtgatcatgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaatgcgcgcacgagatgttccatctcgactgccacagccgcttatccacctcatgcaccgcaaacgggcgaataggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcttgtgccctaccttcgccacacgcgctcgctctcaaacatctcttcttccggcatcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccagcgccacgctacccggggcggtccgtcttcttcctcccttttgcaatggcagggctggttccgccattttcttctttcttcatggatgttctggagttttacgatctccagatggcgcacctcacccccaacgcggtaatgacattggccatcttcacgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacaaagcgcgcctccgacttccgagccagcctccagcgcaggcctccagctggcgggcgccggtagatctgggagatggctatgacgccgttctcgaccgcttggcgggcctgcgatcccaggggctcacaggggccatggtgtacggcgactaccttcgtcgccggattgcgccgctccagcagcgcgcccggggcgcctgggagtacaccgggtccgaagactacatgaggacccaccagggggtcaaatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcctggggagcggccgccctgccgatgcccgggggaagaggaagcaggaaggaacccctcccccatctcctcgccgagggggcggggcggcgcgtgccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacaaaggcccggaggcgggaatctgaccggcgagaagccgcggatcgccttcgggaagccgaggaggccgctcgggaggccgcccgggctcgccagaccgaggaagccgctcgggaggaggccggactccgccaggccgaggcgacgacatcctccgaggcgacccgtgaaactgaccggcaagaggccgcagatcgccttcgagaagccgaggaagctgcccaggtggccgtccgagctcgccaagctgaagaagccgctcgggaggaggccagacttcgccaggccgaggcgacgacgacttccgaggcaactcacgacgaggccgcgggcgcatcgcttgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcagagctcgaaacccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaagaagctcgacgccgcccggggggtccttgacgctgccgctgcccgagaacggcgggcagcggagaccgaggtggcatcccggcggcgcgaagaagcccttgaggcccgtgccatggcgctggaagagcgtgcctgcgccgtggagagggacctggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagcgcgggaggagcaggcgcgccataatctggaaggtgcccgcgccgagagggccgcgctgaaccagcgggccgctgagctcgaggcgcgggagaaggagttggacgcgagggcgcgcagcagcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgcgccggccggcaagcgggcctctggggcgggcggactgcgaagtacgccgccaaccaggggggcctcacccagcgcctctcgaagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggacggcgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcgacccgagtgcatcggagtgagcccccaggcccccgccaatctttaaatagtttcttcttttcttcttccgaggccttcgggcccccttcttgtatagactaatttaatctgcaatcaaataaagaggaa

SEQ ID NO: 51691 - DNA, 2054 bp, Oryza sativa
  unsure (1)..(2054): unsure at all n locations
cgaggacggcgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcgacccgagtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccgcggtccttttgtgtcttggctttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcactcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcatggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagtttactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccctagacagcaaatggccatgaaagtggtatgatctacagggcctgggccggctgatggatttgcttggcgtggaattgacacgctctgcattgccggaccaggtcgaccgcatcattgagagctgttggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagtgtttggagatgcgctggacgcgttcactcccttcgcagtcctcgggtagagtnnnnnnnnnnnnnnnnnnnnnnnnnnnnnnnnnnnnnnnnnnnnnnnnnnnnnnnnn

SEQ ID NO: 51692 - DNA, 3278 bp, Oryza sativa
  unsure (1)..(3278): unsure at all n locations
aagctctatcccgtcaaaatggcgctccatacgccatacttggcgcacgtaagcgtccatctgcgggtcagagcaccggtactccttacagacatggttaacgaccagctgggagtcgcctaacaccaggaggcggcggatccccagtccagctgccaccctgagtcccgcaaggagtccctcgtactctgccatattattggtcgcccaaaagtcaaggcgaaccaaatatctgaggacgtctccgctcggcgaggtcaacgtgacccccgcaccggcgccctgaagagacagggagccgtcgaactgcatcacccagtgggcggtgtgaggcagctgcgaggggcccgagctggcctcgtggactgagacgggctcgggagctggggtccactctgccacaaaatcggcgagggcctggctcttgatagcgtggcgtggttcaaagtgcaaatcaaactcagaaagttcgattgtccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggtgcactcgtcttctgtgccgacgacctcggggtcggaggacgacaggggcagccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgcctgacaagcgggcagagggcctgctccggtcgtcgggggccttgggccaccgttcggctcgagggcctctcctccctgctctctcccgggccaagccagcacagggtgggggtgcgcggaatgaggattgtcctcatcgcgctccacaaccaacgccgtactaaccacttgcggggtcgccgctaagtagagtagcaaaggttcatttggctccggggcgaccagaactgggggagagctgagatacgccttcaactgagtgagggcacgttcagcttcctccgtccaagtaaacggcccggagcgtttgagaagcttaaataagggtagcgccttatctcccagcctcgatatgaaccgacttagggcggccttgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcaagtagtacgttgaaaagtaggacctgcattctttaacccgaagggcattgtcgtataacaataagttcctatgggggtaatgaacgcagttttttcctcatcctccctagccatgcaaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtctttctatttgccatccagaagaccaccgattcgtgtggtcttggacgggccgtcgcccagggcaactgatgaggacatcaacaccatcgatacatccacgtcccccatgtacagcatgatggtcctattacccgcgctcgtgcacgtcaactaaattatcaggtgagttctttcttgagttcatattcctcgtctttataccccggagacgcgtgcactcgtgttttactcaggaacgatggagatgatccaaagggaagaggattcgcgcggggtggattcggactgcagggcagcgccaacttctgacggccgccacgacttcatgcgaactccgatttgggcgtgcaagtacttcatggaaagcttatcaagtctactttcaaatggatccagccacatgtccatatctgttctggagcggccgcaattgtcattttactcccgactattttctgtccatggtgttgcgtcacctcttttggcccaatgggctgtgtatccaagttgggcccattaggggcgcgtcctagggttggagcacgaccctatggtagttcttcccctctttttatacctctagtcgtcgccaagaacagacgggttttgatgatagagatagcttcttgctaccagctcgcagcgcgcgtgttggctaaaccgcccgtctgcctgtaatcggaaccccaccatattgagtttgatagtgaaactttcatctttatctagcaatttcagtgcttgtcctacttgttcttgcttgttcttcgattgcttgcaggacgagtgccctcgtggccgggttgacgcgcaccacaagttcgcggcgaccattggagacggtgtatcggttgtaaggcgcagcgtctttggacagttgtagtcgggccgtgaacgtcgtcttcatctaatcgagttatcccttacctctcatcgaaagtcgggccacaaaccctagcgggttcgcatcagcannnnnnnnnnnnnnnnnnnnnnnnnnnnnnnnnnnnnnn

SEQ ID NO: 51693 - DNA, 14715 bp, Oryza sativa
  unsure (1)..(14715): unsure at all n locations
nnnnnnnnnnnnnnnnnnnnnnnnnnnnnnnnnnnnnnnnnnnnnnnnnnccgactattttctgtccgtggagttgcgtcacctcttttgcccaatgggctgtgtatccaagttgggcccattaggggcgcgtcctagggttggagcacgaccctatggtagttcttcccctcttttatacctctagtcgtcgccaagaacagacgggttttgatgatagagatagcttcttgctaccagctcgcagcgatccccttggctaaaccgcccgtctgcctgtaatcggaaccccaccatattgagtttgatagtgaaactttcatctttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgtcttcatctaatcgagttatcccttacctctcatcgaaagatcgggccacaaaccctagcgggttcgcatcagcaacctccttgaccgggacctcgtcgcacgtgactatccgctgcctcgggacggcggggacggaggtgccaagcctctcgtcgccaccctcgggcttggacgcagcggcgaggtggtccgcgcgctgctccatacaagcgagcgcgactttgaggtcgccatggacagagatggggccaccggggcccggcatcttcatctggaggtaggcgtaatggaccgccgccatgaacttcaccaacgcgggcctccctaggacagcgttgtagggcagactgaggtccgccacatcaaagttcacccgctccgtgcggaagttggcggatccaccgaaggtgaccgggaggtcgatatgacctagcggccaagtgtgacccgacgtcacaccgataatcggctgggacggccggagcaccatccccggggccttgatagcgtcaagggctgtgggggaaaggatgttgagggctgctcccccatcaatgaggacacgccccagcttcacgttgcaaacagtgggggaaaccaccattgcgatctatcctccccgggcaacgcacggtgggtggtcggtctggtcaaaggtgagggcaacctccgaccaccgcgcccggcgcgtcgcctcatgagtaggggtcgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagtcactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcgtatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccacgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggaaggggcggtggagtacgagctcgacggcgtgggttcggctccccgtcgtcaccgctaacactcggagagaggctgtgcgcctttgcttgttcggccattgggctgaacaggaaaagcttggcgcacacgaaagagtgcgagagcttagaagaacacacgcagaaccccctacctggcgcgccagatgacggagcgtggggctcctcaccgggagaccgcgcaggcccccctttgccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctggatccccccccccaaaaaatatcccccttctaagtgggcaaggtcctccttttatacctcaaggggataccacatgcaccatctctctcttttttgtggggacttatcctatattttcataaacagacggagacttgtatggttgccgtctgaatgaccttctgatgggacggcccatacctacctccacttccgccggaagcaggcgcgacgtgggaacatggctgtctgctgacgacatgaccaatgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggatgagtgcttggaggctctcatcctgacgggatggggcgaggcgtacgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccccccgagggggttagaccacgtgggtgatcatgtctgcctcaagtctctaagtcatgatactcccggtcccatgtcaccgacaataacaataataagattaaaataacaatcacccgttgcaacgcacatgcatttttctagttatcataatatgtaactctttttatttaaaaaaatcttagttttatatatattattggttaaattagcatctcgaagactatattgaagttcaaaaatacatatatttatcatattactaatacgatcatatccagatttatagtactaaaatatcatgttcaaatttacagtactaaaattctcttgtattttgaaacggaacgagtaagatatttaagttgttaatgtgacacaacactcatattttgctagatttattttaggatttaacagcatttttatttcgtgctagatgatataaccttgatagcgaggtgtctataataatggttcgtccacttcaaaaatctatcaagtttcttcgaaataaaatgtattactttgtccaaaaaatgataaactttagctacgaatctggacacgtatgatttgattatttttttttacggaggggtacgtgtttgcatccacatggtaagtgtaggtgggagtgcgtgagtactctgtatctctactattataaaaattgaagatatttttaccaataatttggtacgtcatttatgtatgagtcggtttatttttaagttcgttcgtttctagaaatacatatccatatccgtatttgagttagttttaagtttgttcgcttttgaaatacagaagaagtcgtataagaaatatctttaaaaaaacttaaatactaacttgagatgatcggactcttaattgcagttcataattttctaaaaagttatatatcaaaacgaatttttataatgaatttcattttaactaaacatataacgataataagattaaaatagccatttttttctaataaaggaaatgtatgtaacgacaaaggtcatcaagtgccggcctttttttatgataaagtcccgctacggttctggtacagtataacggtaaattagcgtgttcttagccttccgatttgctgtactgacgctgttgctggcttgctgctctgaccttcgccatccattcacaatccttatccaagccatgagatgccggagaagccccgtcgagctcgaattcgtgcatacgcgcgagaaacacacgccgcgcgcttttcctttttctttttctagttttctttagcctttttctttttctctatcccacacatatgcaaatatacgaaagggcacgtagcctagtggttgcagtgacctgagtagtacttcaaggtcttagagttcaaatcttcataggaacgaatttcagattggattgtttacggggctaagttccctatttcaatggccgtatatatagtacttcaaggtcttgagttcaaatctctatagtagcgaatttcagattgggttgtttgcggggctaagttccctatttcaatggccgtatatatccaggccgggtaaaaatacccttctctaaaaaaaacatatgcagatatagattttcatcccttaaagggattgtccacttattgtttacatatcatctaaatataattataattttttaaaaaaatttaacaatatagattagtacgaaatatcactattacagatcctctcatagacggcccctcacatgcctagattttgcgggccgtcacaacgaagtcatcaaacgggcccaaaaagaggccggcaaagatatactcacactgacatgttagatgtgcataaaaatcgagcccgtcacggatgacacctatcggtgacgagcccaacttgaagcccgataaagataaccgatgatatttttgtcgggccctaacagaaacccgtcaccgatatccatcatccgtgacggactccaacttgagacccgattgagataactattaggcccgtcacagatgaatgtcatctgtgacgggctccaacttgaggcccgattgagataactattagaccgttacagatatttattgcacagtataaattaccccgattgagataatgctttgactagggtttcacttttgctcatatctagatcaaaaatttttctaactgcacgtcctagcgtcgccgctgtcagctgccgtccccgagccctcgtgctgccgccgctgtctgggagcccagcgttgtcatccaccgagcctggcgccgtccccgagcccacatcagccggtgtcgacctcctccacgctgtccttgccgccgtcgcatcgacgtccactgccatgcccaagcccgccgtcctacaccaacctcctccacgccatcccaaagccggccgtcgtcctccaccgacctcctccacgccgtcctcgagccggccgccgtcctccactaacctcctccacgccgtcccccgctgtccccgagcacgcccgccgcctcaacctcttccttcgccagttagaaatttgttctaatttacaactctgttttgcaggttttgatgcttagcacttgaagatgttattgtgaaatatgtgaataatggatgtgtattccaatggatgtgtgaaatatgtgaataatggatatatgaaatatgtgaatagcatatgtgtatgtgaatgattgtatatgattggggatgctgggatattgtgaaatatatttgtttcttcattttacaacgggcatggctagtaaaggcctgaggctagcgaaaaaacagaatttattttttgggaggaaatactcatcggtgacgggctttaacttaaacccgtcacggatgactcatccgtaacgggcctcaactaaagcccgtttgagattgtggtcatccgtgacgggcattaattgaggcccaattgaaataaggtcatccgtgacgagcccttatttgactggtcgtctgggtcaaagctatcgatgacaggctttagttggggcccgattgagataacttcatccgtgacggctgtatgctcaatagagataacttctcacatcagtaacctttacgtcgtgacgggcgccatacccgacacatatggggtttgccgcctgattgagatgtggatgaccgttgtagtgtatattactctaaaaaatacaaggccaaatttaatttctactagttgcaataaaaagaacaaattaactaaaaatagttatagtacattcgcaattatatttgttttttttacaacttgtagaaattaaattctaacttgcatgtttgtgaagtgatatatttcatccttatctatcttgtcaatttattttaaatttgtttataactatttagatatatgtataaataagaggatatccctcgagcgatcaataaactttccctacagtggaattccatggtcttgactcttgtggaacctgctcttggcgtggaaaaacttggccatctccctccgcgtatagatattgaccccgaacagaggccagcgagcggtggcggggtctaggtggcgtacgtccaagaaggtgtagctgtccacgtcggagaagaactgcagagagagaaaggagaatgtgaaaaaaaaaaggtaatttcgacaatttctacgtttagatggaggtgcaaacattttttttagggcaatgttatggttggaattttgcaaacttccattgacacgtgacaaatttcacgaattgtaatgatggtattttccaatatagcaaattcgtaaccttcagcaatcaccaagtaacgacaaagtcctgctatgcaaaatgagaaattacgctatgttcttttgggctattgaatttggatgattagctacacgtaaaactagaaacacaattaacatatgattaattaaatattgatcattaaaaaattgaaaaataaatttatttgatttttaaagcattttttattaaaaaaatttcacacaaaacacacagtttattagtttgaaaaagcacaccttgccggttgggccacggtaacatcctgacacaattaagatgaggcatgtgtggcccatgagagttgggtgcgcatgtttagtaccaacttgctagtttagcaagagtaaaactaacttataagggtttattcctctaaccataaccacttccggattaaccattttacacgaaacgagaatgctatctggttctggaggaaatactgtggctatctacttctggaggaagtactgtcaaccaccctgtggctaactggctatctggttctggaggaagttgacagtttggtgttggtgctatcttgcatcgccggccgcctgatcctgcacacccaccgtcgaccattcgtcgcagggttcgcaacctctacgagtctacggctctaccaatagctgctcaccctcccagcagtccagcaccgtgtgtgctgtctgaatcccttgccttactctcctgacagaatgggcgttgaagcgaacgcatataggccgatcgagttctcgccacgccacctgcagggaggccctggtgagctttcctcccccgctcccctcagctagttcttctgttcttgtccagtgcgctaacccaccattgttcgttatccacagagccgtccgaagatgttccatcgccggcccacattaattctacttccggccgccgcggcactgccaccgtcggtgaggcaccgctgcccttcttcctcgctgttctggttatctagactcccagccactgccttagtttcttgcacgagaacgaactcgagttcgcactcaagcgtgtgccccgccgcattagcgtaggctatgttgctgttgttccccacggacagtttagtctgggtagagtagagagcggcagggtagcgcatatcagtttccgccacgccatgtcgcagtccagcggccgcgctctgctcctgcaggccacgctttaatttgctctcgactcggttccaacttcttccaagtggagtggtcggattcaacttggccaagcgccatgtaaaccccacgcagtatattttgcattctttcatctcttgctccacgttgaatcgtctcccctcaccgtaaaaccaggtatgacatctctcacatctttaaatctttcgtctcttgctacacatctttaaaaccagtgcaaattggctccctatataattatgcaaatcgacatggtgcttagcattcatcgccctgacgtcctcgctccctttcttgtacacccccgatccagtgactccagcgagctcgcgccaccacggtcatgccgcagccggcggttgcttagggttacagcggtcctcgcttcccctttcccctacatcgaccacaacgcctccttgtcgtctcctttcttacgcaactgtgagcacgtcaagaaccttaccagccaccatgactagctcttcgctgatgatgcggcgctccccttcacccaacacgtcgcggcgcaggccgccctcaccacgcttcatgttcgccttccctccgttgaggaattccttcggttcacggaatcgagggaagcagagagaaagaggagtgatggtgcttgtttgtgaagtggcgcgatggatgtggcggagcagagggtggcctcggcctccttagccttatcggtctttggtggttctgccatcctcggtactacttttacaattttataaattagctagtccataatttttttatattatataatagtttaatatttatttgaatcaagtggatatcatacataaaaacaagaaaataaataatactatcatatttgataaaagctatattctatatatgatatattattattattattttacccatatcaaagcatgggtattttgctagtaaatatataagttccgtacaacaaatttctatatttcaatgatatactctataaatttatgtgtttcttcatacaaaaggacaactctcttttttaagaatttaacggtcaactaacgagaaggttatgaaaaggataaattcaggagtattgaagaaaatgagaaaaatacatgagagattggacaattttttagggatacacggtgaattttccctagtagttatttggagacaagagaagcaggagctcaagatgcttcatgctacggccggaagaagcagggaggttatacaatcgtctcgaggcctcatatgttttatgagacataaggttttaaagtccaactcgaactcggagggcatgtttggttcgatttcggaagcttgcggctggcgatgcttccttaggcggcgagctgcctgccaggaaccaaccaggagaacaactctagtcagaccatatatttgataaagaaatctttgatatatagtatttgatatatgtgtgtgtcccgaaggaaaattcacctccttgggggagaagcgcctccgttggttaggcactccacggtcagggtgaagatcgcatccagctcttcaacgtcgatccaccgttgtgggccgtcatcatcatggttgtccaacacgagcacatgcatctcaccattttcgcagaatcgatatgcgaagcagacgacagcgtgcgagcccacctgatttctgtagcgctctttgctatcgtccctatcaagtttgtcccggccgcacccaagataaacccagccattatcggtatcgaagtaatggtaccagggacaaacccacagtctcccaatgcaggggccgaggtctatgagctcagccacgcgctcccgggtaagcccggcgctgtgcttctcccaactgagcagtggcatcaacaatccggggacactggtcaccacgcccgcaagctcctgaatcttgattagcacatcgcccacattggctccctcgcgcgccttccagacgcctttgcgctcgcacgcgagccgcagctgctcgttccaactccccgcggcctgccaagcgacagggaacgtcccaacgccgttggactcctcgtacaccttccggtgcatcccctccagggccacggtgcaggccacaatcgcacaggtatctgcacgccatcaccatgcatgcatggcagcacaagaaacaataatagtaattcccttagcacgaacaaatcaaaaagcctatgagagaggtgattacagtgccatccgatagaatagtaaatacttcctccatttcataatataagtctttctagcattgtccacattcatatatagcattgtccacattcatatagatgttatctagctgggtggcccgcgcaattgcacggctagcacccgtacaaaattatatatttttaatataattttacttaaaaatttattaaatagctatctcgttgtcttaaaactttgaaagactaaactttatcatccccgtgtttttaattttatagtttttaaaagttacaccagttgctaccccttacttctgtcatctccttatttatttgcttgttcgatctaccactttctattcattctccttagaacctttaaaagtaggatcttatagtttttagagtttattttcttgttggatttcgtctttataattttcctagaagtcatgtcaaacgctgccactatactcctctacgataaaaaaattaatcgtagaggataaggttgagtaaaaattaatcgtcattggaattctactaagggtttttattaattgtttttagatgtcccatcaaccgtcatcactctactcatttacaggcatgttgcttagaagtcccgtcaaacgctgttactgtactcctccatggcccgttcgctgtctcatctctttattatcatcgggattttaaaagttgaacacaattatcgtttgagttcatttttttttaatttctagaagtcccgccaaaccgtcagcggctttgtcgctgtactcctatatggctcgctcattgcctcccctctttattgtcattgagattttaaaattgaacatgattaccattggggtttttttttttttaatttttagaagtcccgccaaccgttgcgaccatgttgtccatcattcctgcttttaatcgtcgttgaaattctatttgggggtttttttaatagtttttagatgccccatcaactgtcaccactctactctttttcagacatgttgcttataagtcccatcaaacgctaccactatactactctacggcccgttcgctactttctctttattgtcatcggaatttcaaaaatcaaacataattgtcatttgtgttcattttttactttctagaagtcccgccaaaccgtcagtggtgacggctttaccactgtactcctctacggctcgcctgttgcttcccctctttattgccattgtgattttaaaattgaatatgattatcattggggtttactttttactttttagatgtctcgccaaccgccgagatcgtgcttcttaactgcctgtccgtcatccatctttttaatcatcattgaattctctttagggttttgttaatagtttttagatgccccttcaaccgtcatcactttacttctttacaggcttatggcttctcccatctttattgtcatttatcatcgttgagtttgaaaatttcatatttttcattccgatgtattttatttataaattatattcctacttaaactcttattattatttttaaattttcataattttaattaatctcatcatgggttctagatggtcccttctttcaatagtctttgttattacaaattttagttatttatacattgtattcctagttgaaattctatttttctttttctaatttcaaaatttattttatttttattttgaattttaattaatctcgtattgtgttctatatgcactattcttttaatattttttattctttttccaacttcagttgtttcaaaattgtattcctacttgaactctttttattttattttattttttattttgaattttaattgatctcgtattgggtcttatatggacttctctttcaatattacttattctaatttttgaatttcagttatttttaaattatattactactaatttatatggatttttttaatagttttagtcatatgcatccttaaagattaagagctgtgttttatggattaccggacgatgggtggtttttttttgccagccaatagtcgttgaccggccggaacgtaccttaataaagctctttttttggctggcatatgaccagtggtattaataacaatctatttgcttcggtatgacaactagagtcggaaacaaagagcaagatatatctttctatatctgtcaagaaacatctcgaccgttataatttggacccactataatctaatggcgtgtatttttttttctttttctccgattaatgttggaatttctagcctctacagtgaacgtgttgcctcctttcaaggctgttttaaaaatataacagacagacagatagatagatagatagatagagagatagagagtgatgaatctaaacatatatatatatatatatatatatatatatatatatatatatatatatatatatatatatatatatatatatatatatatatatatatatgtctagatttattaacatttatatgaatatgggtaatgctagaaagtattatgttatgaaacagggggagtattagattatatgaaaaagtccatgtcaccccgctaaactttggttgaaagttcatctaacaactaaaatttacaatactgttcatataacccgttatggtggttttcatctaatttgcatatacaccctccattatagaaaaaaccaatttctgataatgaacttagataattgtccatactcatcttcaggagttaatcttttttttatagaggaagtatgttgcatgggcttgactatgtggtatacacattgaaatatatgttgaaatcttcagttaaatatatcctctaacaatctttttttctctcagtatttcacttactaagtaccaacataataatactattatagcattactatagagtataacctgaggtctagaaattaacgacatgtaatataatatgttatattagctatcaaaaccgcttatttaaacatctacgcaaaacaaccatccaaaaatatcactttaggggtaatatgaaaatatgaatggattgtaaagtttagaagattgggtgtccgatttcaaaattaaaagtgcacaccccacgcgggaggaggggggggaggggatggacttttcatgcaatatgtgcagtgcgagtgtctcactcaccgctcgtcgtctgcttcatgggccgcagacaactcccccagctgttcgacctcactgggccggcaggctgctgcccccgcgactcccaatccagtcggaagggactacctatacatttgtcgacaaatttttccccaaaaatttgacagatgtaattatagtacaatcgtagtgtaattacactgtaacttatatgtaattacactgtaacttgcatgtaactacagtgtaacttatatgtaagtttcacataattttgaatcgttggatctattacaagatttgttttggtgaggaagaaaacaaatcatagcacacacatatgtgaaagaatttgttcccacgacctccattttaccgaa

SEQ ID NO: 51694 - DNA, 7660 bp, Oryza sativa
gccgcgccgacctgtccgttccaccccgcgctgatctcacctccatccccgccaccaccgagctccccgccgccgccagcccttccccaaacccaccgccgcccatggagctcccttcgccttcctccccttcattgccggtgccacgtcgccgcgccaaactgcctccgtacgccgcgcctggctgtgccgctccctcctctcccgccggcagccggcccccgcgtgccgctgcctctccgtcgccgggagagaggagaggagagatagatgaataggggagatggggagagaggagggtgagttggactgacatgtggggcccacgtgggtcccactatttttttttattattttatgtgtgagactgacatgcgggtcccacgtgggtcccacattttttattattttctatgtgagactgacatgtgggtcccactggttttattattttttcgaattgaattgccacataagcgccacgtcaatgccacgtcagatgaagaccgagtcaaattagccacgtaggcgccacgtcagccaaaaccgccgagggacctaatctgcactggttttgatagttgagagactcgttgtgtctggttttcaggttgagggacgaaaatcggattcgttgacaagttaaatgaacttattcctttaaggggtgatatcgtgccagcccaaaaaaaaaagcgaaatgggttatctgttatcctattttacagtttgtttttgttcatttgaattagcatatgttacatctgattctacattactatattttggaaaggaggtaatatagatttggaaagaaaaactgacttgatgagagcaacttaagtagtacgtgctgatgttaaagacggaagagacaaaagaaaaagaaaaaaaagaaagaaagggagggagtatacaggctaacaggcatactgcaatggcgatacctggcgctgtctgccccatgggccggcccagataagcttcgcacctctcctgctgcgtcactggaacgatgggctgctccaacaccaatcgggatgtattccgcgaaatggacctagtatagattgcgctggcaaatgccacgggtttcctgcctcgctggagcaacaccccccgaactatctgtcggaatgcaacccagatgtttaggaaatcaaaagaagcacactgagttcatggacatggagatgattaatgtggaggaaccactgtgcaggaaaagatttgctagaagagtgagataatgggtaatgaaaactatcagcaggggaacttttgtatcaacatcagcgagagggaggcggggggataataggggtttgaaatgggggtgctaattcctgctgttgtttgatttggctgcagattgtcttgcttatatgatggataaagctaaacaaggaggtctgataaaggggtaatttctcattgcagatgacatgttatgatgacctaaggataaggaatttggatgtttgggcatcatcaacactaatgaggcattacttataagtgggtgtggaggatctacgatgctgatgatcaggatatttcctgcagcttgttgagaaagaagtattcgaacaacagagctttgtcttatattgctatgataatagagggtctcagatctggagaagtaacatgaaattaggcatcagtttggattgggggctatgcatttggtgccaagaataaggagggaaagctaagtttacctcgacaataacaccaaggaggaggaggaggaggaggttgtttccgttgtctctgccgtgatcaagcagaggcgttggcctgcggtgccagtttcggaagccaaactccaggatgacgaggaagataatggcctcccacttgacacggatcgaggcgcaaaatatcccaacccttatagcctgtcccataataacaacagagctactacgggaatggcgcccgatcggctcagcggaggcggcagcgcgaggcgtaagagaagatcacaatgttgatgccatacctgacttgaggaagttgtaggagccgatgggatcgcagaatcgtctccagtgaagaaagtgaagaagagcaccgaattgtggcttatattgggagaaaaccttagctttgggttttttagcctggctttaggtttttgtgcattgaaggtgagtttctctcacttactttccctcctttagtgtaggtctctgacgtattggatcatctgggcccgcccagcatatcagtgatccatgtcagaaagaagtaatcgagtgaaggtacctggacttatcagcgggagatatcagttatcactatcggtatcactatggtaggtaactcgtggaatatggactcaaactttcaaagcttttgcattttggatatctcaggtccaacggtacaagacgagatggaagaaaattaggtaggacctaggtccttccgagattagaaagactttgcttctctatatgacacgtgtataacacaagcagccaacctccgactcctttcgtctcagactctcaggctaaatttctcgctcttggctgctaagccagggaacagcggcaagccggcgtgctctggccggggcgatgcacaggcaaccccaacgcgccgcgcagtcggcttagataagcacattgcacgtggctgtggaagttctgtgggaatcaatcttgtgcgccacagtgtcgtcctcgatttccagcagatccagctcttagttcttgcaattgatcatgtccatggcataagattgaaccagccaattaattgctgtgctttgagatggaaagcacggccgccggccggtgtacaagccaactcagtggccttggcttttgggcttctggttgttgataagcaggttatgccgttcaagaaccgtccctcgtcagcgaacttcatggcccaaatcgaatcgaatcaaatgcccagattgattccccttcaaatcaaatcgaatcaaatgcaatccaagatgtatagcccaatgatccattaatcgtaagaagagggattcatggcggacagtcccccgtggagctttggcggcaacctcgtagaagaggagagaggaaaatttggccagacgaaggagatgaagtacttgcattgagattggtgttatacacgcgtcagatagggagcgaagtctttttgatataggaaggactagggtactgtttgattcaacttaggattattataatctagattattaggagtaaactgaaacaaacagatagctttagattattataatctataagctagattactataaaggtgcttttttagattattgggtggctaacaactaacaaacagataataatatagagaaacaaatagctagcagcttattttatattgtcttattataatacagtttataataatctaattttataatttagattataataatcttaatctgaaacaaataggtccttgagtcacttgtaattttcttcgagatgggagctgttagttgcactgaattgagaggcagccagctgggattttagtcagatggggtatttgactaggttttacgagtaaagacccctcccgccgccagctacattgatttgatccctcgttccctcgccggagtctcctgccttcttccgtcctcaacagcggcgccgcctgagatcccgctctccaccacgccattgctcgccgtcgtggcggcgggcaggagtggtcggatgatgccgaagatggagggcggtcggcggccggatgacggccaagactggaggcgcgtgcaatgtgcatcgccggaatcgcgttcaacagcaaccgacgctccagaggcatcaggcctagaagtgacaacaggttcgcgaatcgtaaaccctcgtctcgggtgtgcttgctgtattcaatttgagggggtaactgggaatcacatagtcaggaaatgtatgaattattaaattttgtacagccttagaaagttctgacctttatggctgaaattacaggaagtttaagttgattatggtggattttcgatgaaatcacatagatgggattgaaaggtagcaaatgcagtaggttatagccgactcgtttttgcttaatttcgatccacttctctagattatgcttaagtttataatataagctttactgttgttagttttcatgtttcacggtgcacaggacagtatgacacacactctcttttcaaaggttcttagcttcataatcaatctgtccagtcatctgttctcttgaattgtttgatacatgtgcagtgaaaaatctttatggctatgagaatgtgcatacggatgttgtaatcttcagaaatgttcagatagatgacctgatgtgtttcaaaaatcatgtgctttgtaaagaactggtttactgtttgcctgtatcattgaaagaaactgacttcctctagtctggtttacttagtagcgccccatccttctttttttttttaattttcaccaggggggagagtttccccacctgaattttcattgaaagggattgttaaagttacatgggagtaagaagaataaaagcagttacagggatgaaagggcagaagcgaagcaacgcttccactgtgaaactatgggacatacatcgcttttcattcgttctgaccagagggacgcatcttgaatacatcggcgaaggatccgctggagggaggggggttcttttctgaataccacatcgtgccggtgattccacaaacaccaaaagcaaaggaggtagaagcacttgaattctaccattgggattatcggaggcggcttgagctgaaataagagttgtgctgaggggatatttggttgaattcggaccgcagaccagaaagttgaagcaaaaggacagtgtaagaagaggtgatcttcgtcttcatcctagcagaggcacagctcgcatgtagcagttgacaatattgttttcttgtagaggtttgcacatgtgggcagcctgttttttcccatgagccaggtgaagaactgcactcttggcggagctgcattgttccagatgaaatcccagttggcacagttaggtagatcggaggaggaaaggaattgatatagggagctggaggacaagatctctgaatggccatttggggagtagatccgctgatccataccatctgagagctccagttgttggatgatattctgcactactgctaagtcttcttgggcagctgaggagagacgaggggtgagtcccaggggggcaattctgtacattggcaattctaatatgatcaacatgctgcagtgcctgtgcttccatgaggggctgtatccctggcaggctgcccctggcttgtgagcatctggcggtccggccatctgggcaagcggcaacaggaaagacagtaatcaagcaaaataaggtatgcaatgcaatgcaacatgttacttttgaatgtttgattgatgattcaacctattagcatagagaagaaagcaccttaaggtatctaaattttacactaaaatttttggtaccttgaggtacttagtacttattaaacctttaatattgtttgtctattaaatatgatccctagctcacaagatgtcagaaaaaacattgttcaactattactcaagctgcaacagtactcctactccagagaaagattagaaggcaaggctaccaaaattgcccacaccaatgtgctgtgaaacattgtgcaggactaataggaaaaccaaataattgaacctgtcctgtacagcaccaaaacaaaaaacatggtttggtatacatactaaaagaacaaatatcagaagtgtagacacaaaaatatgaaacaggatataaaaagggtaatcacatgacaatgttatattgttttttcttcaaccatgtaactatatgtaccttttaaaattgtacatatacagttttccatcttgattaaattattctatattagcagccttgttctcattagtgacacagagatcatggaaatacaaacaaaacatataatttcttctacttcatagtatccttttaactgatgtcgagcccatggatgtttttagtaattacttggtatactgtgtcctagatgaacctttggcatggaagccgaagcacctgcggatcacacaaaggtagtcctgggcaaaaagcaagaggcaggtgctcaaggatatgcacaaagagcagcttcaggcgcagatcaatggaagggcctgtttggtacagctccaactcctaaaattaactccaggagttgagtctggagtggagttgtggagctacctaaacccagctccacaactctagcacattttgtgaaagagctccacctaactccactcccagttttgatggagctgaaactggagctgtgccaaacaggcccgaattatccctgtaactgtaaagggtcattgtcagcttgtaccggtggctagtaattacaggaatcaaagtatctgcaaaatgcctgattacaggatgcaaatgcatttttccaatcagtacatgatggctaatatgtgtaagcattcttagtttatttggttaaaattgaaactgaacaatgaccttctaatttagcaggtagacatgtctttcgatttttgttttcagttcatataaggaacctggtactgcccaagaattacctcatcagctgctccacaagagcaaggctatggacatgtttgcacaaatgttacaggtagacacataaaaaatggagccatgggctaaggaagcgcatatcaggctgttacactcctaaaatggagccatgggctaaggatgtgcatatcagggctgttgcactcctctctgatcagatttgtggaggagtggataggttctcatctagcttgacttctccctagtaagttagttcttccttttggatggtctgtgaactatatacatgggtcgtgttgtctaatatgtgaatcatattattccttgcggctagcaacatgaacacattttgtgatcaactttggtggtttggttgatcacccaagtgctggtcattttgtcattaatcattatggggcaccaacatcttttggatggcctgtgctagttgagggtgagaaagtcacagcatgcaggtgtggagttcatctgattgcctcttacaaaaatgcttttgtgaatgatgctaaaacttttttttttacatgtgcaggtcaagtggatgtggtgctattattgggtgatgttgctttgtgatgccctgggttccagttgttgctgctgatctacgggatgcagcttggggttgtatgctgtgagtaaatgatgccgtgtgcatgttgccatagccctgaagtgatgttgctagtggaaatgcactgtatgatgttggctagacataaaactaaaccttcagtttaatgtgtgttgtatcgatgaatggtaaaatttgggctgagaatgaggccatgtggtcgcccgatgttgctagcctggagagatgtgtgattgtgagatatttaagaatctcttagttattgctgaaaatttgtgtcaatgtgttgatgaatctgtgagaacatatttatgaaactgtgatttgtgcttgtgaatctgatgtaggaatctgtgctacttgttgaaatttcagaccatctgcgcctttatttcagaccatgtctgt

SEQ ID NO: 51695 - DNA, 1450 bp, Oryza sativa
ccccttgatcacacatatttcacatcctggtacaaccgattctaaacgctgaaatgccacttgctcacaagagaaatcacataataaccatagcatgcccaggatgttttagctttggtcaaaatcaaaatgtttcaaatttgactaagtttataaacaaatatagtaatataccaaattagtttttattaaactaatgatgaaatatatttttataagaaatttatcttgggtcaaagatattactatttttttctataaatttgattaaacttaaaacagtttgactttaaccaaagtcaaaagtcaaagcatcttgtaacctgaaacggagggagtaccaaaagcaaaagcatgaacttatttacaataaaagaacttgttctacaattgcaagtttcaaaattgtcatgcattttgcatgcaccaagttcagttccccatatttcaccatcaggttctattggcattatagagatcatatcttctgccccttgaagatgctctccctagccgattcaccatacaggcatagtgcttcaggttaggctcaagggagtattcctccattctagtgaacaacttcttaccctcatcaaccctcatcaacaagtccttcatcgcaacaagcagacagaatggcaagaaaagtgaggctattgggcttaatttgcagaagctgaaatgacagtgaccaaaattgctgagttgggtttaaaataccttcagtgagcttctggtcatacagtaccaaagttgtgagtgtgacaacatatgtttttgttttgaccgaaccaaatattttcggtgcaagatcataatttccactctttccgtacatgatgattaatgcatttgcatctgatgaattttcaccgattaagtgttcggttaaataacaatgtgctggttgacctaatcgtagtctgcccaaaccttaacaagaagaaattatggaaaacaaactgttggtatcacattcaacagcctctcgggcatttcgtcgaacagcctcacggcgcgtcgcggacgctgcggtgcctggcgtacatgaagaccagcgacgacgccaccgcgagggaaccagcaccctccaggatgacgaacttgaagtggaatccccgcgtggacggaggctcctgcagcctatagctaggtagggggccgagctcggagctccgcggcggcaaggactgggcgcccggcggaggagtaggcggggaagagattggcggcgaagtcggggcgcgtggagagaccggaggtgacggcgatggctctcagcgacgcagtgatcgctgcgcgcgcggtggcgtcgccggtggcttggtctccaggatcgttcaggtccttgattccagcttccatgtttgggatccgcgccgccgccgttttttcgccaggtcccgaggatgccgccgccactcggcgttggggcaagcggtgagga

SEQ ID NO: 51696 - DNA, 6553 bp, Oryza sativa
gagggcggggcgaggatgcgccacgccgcccgccatgaccgctccgaggacgacgaccacgagcacgagcacgaggacgcgcacgccgctccactccagaatccgcgccgccgccgtggtcctctcgcgccgccgccgttgtcctcccacgccgccgctccagattcgcgccaccgccgtcctcctcgctccgctttctcattgccgccgagagattcgcggggacgacgcgcgccgccgtgggcgacgacgacgacgccgcgtcggtggcgacgacggcgacctgtgccgccgcgcgctccggctgtgtcgggtgggtgggagtgaaagtaggagagggaaaggggaaaggagagaaaggggaaagtggaagagagaataggttggggtagttgttttgggatcacccgtagtaccctgcactgtaagatgtgtggattcgttgtgtatctatcctatgtggcatacgaggtaacgcaaatgaggtgctgtgaatggcctaatctcccacatctgggtctcccgtctccgacgagcaccactagagaggtgccacctccttgtcggcgctagccacagcaagtgtccaatgcggcaatgctagccgcggagggggactctaagatggtctgggcttcttggggggtgtgaggcaacatatgtcatagctgggacggtcgacccaccctgcctaatgggtagatctgcccctgattctctctctaccacgatctccgagtgcatttggcgggtccaaatttgattggaatccgtgaaatttgctgaaagtttattgcaaatgtaaatagtttgtcgaaaaatctccgtgagacatcagcatccagcaggatatcagcaaaacactgggcagcggtcggaggacctgctttgccttcctagcaagccacaacgcgtgcacacatataacatcagggatccagaatcagaaggcatcagctcctactttgtaaagagacgagaacagcatggcctgatgatagccatcaatctggccaattgtacatccacagccatccaataacacagagcatgccaaaaacagttgcaatagatggtgaaaagagaagaacaaatatgatgggtgaggctagatcgccagagaacacattgcaatgttcaccagtaactagcatttccatccgaaccatcacgacgtatatattcatagagagtgataaaagttcatccccaagaaagtaactttcagcagtggtttcttgagcatgtcacagccatgcttcttcaaaactaccattagcatggagaaaaagggtgatcaaagattcaaagttcgtaatccaacaggaaaacattaaactaatagctagggctgaagttaaaacttcgatgtgataataactgcagttctatgatgctaagacatctcaaaaaaaaaaactgatgaaccgtttcgttcgcttttccatccccacggttcatctggagtacctatcaaagaatggtggaatcaatacgttttgttcacttctccatcccacttttccgttttaggttacaagatattttaactttggtcaaagtcaaactgtttcaaatttgattaagtttgtagaataaaataataatattttcaaccaaagataaatttattatgaaaatatattcaattattgatttaatgaaactaatttggtattataaatattactatatttatcaataaacttaatcaaatttgaagcagtttgacttgaacgaaagtcaaaacgtcttataacctgaaacggagagaaacggagagagtacctatttactaaggagtactagctttttcttacgcctcagctgaaaaggtgatgcaccaagtaagctctatttcgcatttcataccaccgcaaatctgcaaccaagaaattagttaatttgcaaccaaaagctgctactttcgtttgcacgcggcgaactacggccccatcttttcgcttatacttatacttatcaaccaaaatttgaattttcaatcttaaatttgaagttgattttgaagttttttttatcaagcttattttccaagcttaacttttagatcggtaagaacacatttataaaaattttgttcacaaattatttttaatttgtaaatatgccgtttggattattccccgaaaaaacgaaacaatggggccgccgcagattctcaaatcaaggagagtgactcccctaagggcaagggcaatagaagagccgattgcttactctaattcttatccaactcatttagaacttgttttacagttgatgtatacaataatagtctctacaaggctcaacaatccaggcttggccaaccaatgaaattggttttgcctggcccatcaagcataccgggccatatgcatgctgcgcttaggccatgtgggtcccactgattgcatggtagcctgtgcaaaacgggcgctcatgcaagcgccggctcacacccttctcctcgcatagcgcgcctccacgtcaaatcacgctgaggtggacaggctaatagtagattattgtacttgccctaattgggtttttggatggaaatgcgcaaattaaaggacgtacctgcgacagatcatcttcttctcattgtgcttgagcgcgagtgtgaggaggttggccgcggcggcggagacgaatggcgaggcgaagcgtgtgctccgtctggatgccgtagtcggccagcgtccgtcgatcatccagctgcctcccggcgtgcatcagccgctggtcgtccgccgggatgcctgccgtacaactcaaaccaaattaacccccaaattcatggtacaaactggtaaatggtaatcaaattggaatgtccagcgatttggcaagaaatacaccaatccccccatacaattcttgctctgaagaaacacaagtggaagcaaactaatccaataaccttatcgatcgttcactacccaatcggataattttttttttaagagaaaggaaagctatgattttcataccctgaaatcctcgaatcgggacggttaaagaaaaggcggagctggactattccgataagcgcgagaggaaatgcagttggctttgccggccaccgacgagcagggcgaaggggaggagctcagctaagcgagttaatcaattatataccgttcttgtcgtggatcttgaccttgacgtcgccgatggtgtcgctgccctcgacctccagcgtgatgcactcgtccagcgtcctcacgaagatctgcatctctcgccgccggtcgtggtgctcgccggggtagagtgcagtgcagtgcagtggcagcgaccgcggcggacgtcgtggtcgggactcgggtctccactagtggcaacgctccttatagggaggcggagccctagttctccagtctctccgcgtcgctggttctgatggaccagatgacatgtgggccgtccgttaaagcccaacccattttcaacccatccgttaaagaccaccccattgcctcgcctctccgccgtcagaaaaaaaaaaaagagtacctatacatctctcgaaagatttttatgattgtatcacacagatttttaatctttgaattaaaatccgatagatataataaaaaacaaaaaacaattaagaaacaccataatggacactaaattaccatatccttaagaaaaagaccaaatccaatacaaaatttaaaatttacatgcgaagattcaaaaattacaatgtaacttacaaaatttacagtgtaagttccataaattacattgtaacttataagaaaatgcactgtaaatttgagtgagaaaatcgagtaagagataagaaaaaatctttcgagtgagatatagcaaaatcgaaaaaaaagtccaatttaatctatactactctctccgtattataagttactccatccgtcttaaaatataagtatttttagctataaatctgatattcatagctaaaaatatttatattttaggacggagggacgagggagtaagtcattttgacaatttttttttctatttaaacttctttacatttgactaattttatcgagtatcatttcatcacaaaacaacacatattatcaaaatatatttcatactatatttcatgaaactaatttggtgtttaaaatacttctactttttttataaactcagtcaaacatataaaagtttaacttggaaaaaaaatcaaaacaccttataatatgaaacatatagagtacttaaaatgttaatagtaggggtggtgttcttccacatcacccttacagctgatatctaatgaccacaatctatactattacatcatttttcaacaagttttctcctatatcactattgactcccccaaaattcaaaataacttatttgttcaataagaataatcataacattacttagactaaataagtgtttattaattgatttaataataagtaagaatttcagtttgttttccgttgtaacgtacgagctctaggctagcttgagaaatgcccaggggtcttccgactagctccacaaggtggtgggctagacgacttgggttcaaagcctcacccctcctaattatttgatattaggtccttctctaatattctagttttacgagctctaggctagttctcttaaagtaaatataaatcggatctgattcatatcgcttaactatgaaacaaggtataaagaatcatctaactgttgaaactggtgaaaagtgactcctattcagagtggtatcggttgaggtgatgtccacatgcagaattcacttatatgttgtaccgttcttttgcatggatgcatactaaaaacgtgtttttatcagttcaataactttgttcatatttttcaacactctcaatattaaccttttaacattctcaatgtgcacatcccccatatcctcttacgcttaaattcttgtagcaacatattggatattatatcccttatattatacgaaagaaagttaaaagcccatcaattgtaattcacgcaactggttggtacatactccttccgtcaaaaaaagtgaatataggacgggatgtgacacatgacaaatgtatgttcagattcgtagtactagaatgtgtcacatccagtactaggttggttttttatgggacggagggagtattgatcgaaacgtactccctccattacatactataacacccttctacccgatatgatataatataataaattttgatatgcaacaaattttggttgtcattgcagcctagtaaatatttagaggtacactttttagaaaacggattatcattgaggtacactttttagaaaacggattatcattttggtatattcgttttctatacatgacaacgaatccgttgtcattgcagcgggggaggaggcatatcaaaatttggtttttttatcattgaggttgaagagaaaagagatgcactttttttttacaaacaaagagagatgcccttgattaatagtgtagtaataaggggtgtattgtttcaagaaaacacgctgagtatttcttcttaaaaaaataccgacacacataaattttcctttttcgtaaatcggtctattttttccttcgtttgaaaaacacaacgcttcggcgaagccctccctcccctcccgcccgagaaaatggggattataccatcctcaaaacagggcttcgctgaaatgccatcctacaattgggattcgcccaaataccactttcaactgagcccaacccgctgaaatgccattctcttcctgtgtagtaaatcaaaatcattttctctcttttctcacaactttgatgaccaaaatacccctggttcattcgatttagaggatatagagtaccatgtacacaggatgtgatgaacatatgaaaaaaggacctttacatcctaggaactacccggtgatgagctcatgccaactgcaatccatctgcatcactcctgcaagtagatccgggacggcgacacaccgacgtggagaggggccgcagtacggccgagcgcagggtggcgtgaggggaggccgccggccgagcggcagcgctaggggagggcgccggtcgagcgtcggcgcgaggggagggcgccggccgagacgcggcgctcggggagacctcgtcggggagacctcgtcggcgccagggacggccgcaacgcggcgtggcggcgcgagggagaggtcggcgccacgggacggccgcaacgcggcgcggcggcgcgaggggaggcgcgccgcgtcatctctaggggaggcggtggcgcgaggggagggaagggtagggcggcgcggcggcgctagggaggtcgcgcggcggcgcccagatcggcgtggcggacggaaaccctaaccctatgcgtctcgctttcccagccgatttatttctaacaatgaaattgactgaggggtaatttcgtcaaatcatgtgaaaaatagagtaaaatcttttattttgatgaaaatgatttgggatggcatttcagcgggttgggctcagttgaaagtggtatttgcccgaatcccaattgtaggatgg

SEQ ID NO: 51697 - DNA, 5755 bp, Oryza sativa
agcccccattttctcctcccgcccacacgcaccaacctccacccaaaaaacccccccaaaccctcgccgcaccgccgtcgatcgccgcggcggtcgctggggggcaatgtcgcgctggaaggagaacgcctcccctctccccctccaccccggcggctcctcctccctcctcccccgcaagcgccctcccccatccccgccccctccgcagcccccgtgcccgccgccgcgccgcccgctcgccgacgtcaccggcaacgccctgcggcagcggggatccggagggggaggatgcgggtacgggtacagcacccccgccccgaaggcgcccaggccctcctgcaggttccttctcgacgacgacgaaggcatggacgaggcgttcctgcgggaggtggacgccatttgcgaggagcacgagcggtcctcggccaggaaggataaggaggccggcgaagcgccgccatcgatcccctccgaaccggagagcggagtggtatttttttttttgctgctctctcgtttcattctaaactggggtttagggatctaagggcgcatttgtggatttaggaatcttgtaattgggagggaagtggcgaggcgtaagggattctgaaacttgttgtttcatgaaatgggattgctttaggatcgagaaggatttggggggcagaattagtttatcagtgtgatattattatgaatctgtgactgctggcagttcaactgtatactggcgattttttttctttttgaactagaaagcaaaacttccgccatttcgatatatcagaaatgaaatgtgctgtaccagatcctgaagtggctacttttaatagggaactaatttggattgttctttctttgtggggaatccagtctggagatgcattccggaaggaggagaatgccattggtgaggagggtgatgctcagcctttagccacgagccaggaagaaatggaggatgcggatgaagaagaaatctgtgaactgtggtttggtgatgattcacttccaccggccatttcaattgccacagggggtggagaggtatgtcaaacggtggaaaactctgtaaggtcctgatgaatagttattggttggagcaatctggctcactcaactttgagagtctaattgtggttttcctcatccctaacactgataggagagtgtgatatattctttgaaattagaagagaattaggatggtctgtgaagtattggaaattttctttttgttgcacttcgataagaaaagttgggcaaatgaatgccgacctgtttttttccccttgaaatgccgttgtgtatgaagtgcatattttttaagacattatcatgttagttgttaggtgtcaagtggctaaaggaacttaggatgttttgtttgcttgggcggcagtttgaggatgcattctggaacatcagtgacattactgaggaggtgcaccatacaggctcttctgccaagtgccaggaggatatggacggaaaaaatagcgatggtccttcagttccctcagtaatttgccatgaagagcgggaaggagaggtatggcttatttgcttcatttcttaactttcgacaaataaatgatgaacagttgttcggtggtggctaattcatgtttcctcattctcggaaggtgaactgggaaactaaaaattgaattactaggtttgctttggaatcaagaaaaatgtgtttaattccttttctcttggggaatatttagcttgtcgatgcattcttggaggatcttgatgctatccatcagggtgatgctaccaagggccaggaggagccacaggaaacggaactagaaattgaggaaaatgaagggtgtgttccaaagaagtactacgaatatttgcagtccctgaatgacaggcagagggaagctgcatgtagtgatgtgactattccactaatgatagttgctggtccaggaagtggaaaggtatgtacaaacatcctttctctgcgaattgcatatataaccagtgtgttttgtttcaatgtcttaatcttcagtattatggacatatgttgttgagttaaccgctgtcataaattattggccccagcttcgatgtgaaaccaactgagaccaatttcgtcagatgctcaggtccttttagaccaacatcatgcatgatttagcctgtttgactaataaaaataatagtcatttatcgatatgcattaattttgtagcttttgttcttgtagctgatacagttaatgattgtttctgaatgaaatccatctgaccattcaagccaaatatattccgtagattatatcctttcaaacgttaaacggtgcaagtgccatccattttatcgtatttttcatatcggtcacacataacatattgcagattccataaactttgttgtgattgaaaaaagttaattgtactaaaaaataatgtctatttgagctttattgaacatatcaaaggtcctgtcatgccatattaaattccatgctggtgtatatactgaaaatttccttcccataattggcatgattcaagacatcaacaatggttggtcgggtgctcacactgctcaaagaggtaaggttcactggttgatataatcagagtgaaattgtatggattttttttttcttgaagctcacatattcacatatctccttgcctgatgattaggaatttccaccatcaaacattcttgctatgacattcacaactgctgctgcttctgaaatgcgggatcgaattgggacagtggtggggaaggcagttgccaaggagattgtaataagcacatttcactcattctgcttgcagctttgcaggacccatgctgaaaagtatgtcttttctgttggtggataatacttaaaatacaatgcaacaatggatatcgacatgcttctgctcagcatactacacttgcacatttatctttgaagtgcatatcaatgaacttagtgttgtagaccatttggttctgagaaagtaatatctgaataagatgcagcctggaaaagaatgaagctgaaaataaattcttgttttctattttaacttatgatttttatgatcacgctattcattgtgataaaagtcagaaatgcattaaaatacccattacatagagataccagcacaatctgatttagtacatcaaatcagtcatcatcttcaattgtagtttaatgtttctaaattcactgactgacaatttgttatggtgtatcatatttgctagtaggatgagcacattttccctgcttaatctgatttagtacatcaaagcagtcatcatcttcaattgtagtttaatgtctctaaattcaccgactgacaatttgttatggtgtatcatatttgctagtatgatgagcacattttccctgctttcagtgcgctcttatttcctacatcttagcaagtgtaggaatcattttagatgattggaatcttatcttatttattgttttattgtatgattctgatgttctaataaatcctttaaaggctaggccgcacatctgaattcataatctatggaaatgggcagcagaggagggctgttattgaggcagagcgtctattggaaagtgacaaaaataatggtctaggagatgcaaataagaattgcgatggagatattaaaaattctttcaaggacaaagctaagaaatggcagaagtttgttacacaggtgccttctacttttgaagaattcatcatttaagcatttttgtttttattcccttctctattttggtgcatagggagcttctgaaaggaactgggtacatgttatattgtatgcatcctgtaaagtgaggtgcactgttgcatctacctaaagtgtgtgtggaatgctagattctctctagattggatatgctagttccaccttactgttacatatcacagcagaatgtagaacgcataaaggaaatgatttaaggttcttcctagatgctgggcttaggggatttaaagctacagacagtaatcgacaactccacgtacctcataaatacataacacatgatttaattcaaattctcagtataatgttaaaagttgtgctaattatagaaaagaacattgccaagattctttgcaatagactggactaaagctatctccaggctaggtctgaacaaagataccagaacttgtagacaataataaatatgatatcaatgaatacaactaacggtagaaccaggaaattgtgtgaagctctcggttcatatgagaaagaagcattagtcctagttgcatctacctcagaattatagctagtatgttatgctaaattctggatcatgttaattctgaatgtaggccagtaggatactcaatgcatgtttagaatggtagtcctgtcttacactgtatatggtgcatgaacttcatattacaaacacactcttcatggtttgaggcatgtgcttgctagccagggcatctaggcttaaggagttcctttataggtcgataacactggggaggtgaggtttttgcgtgtgttgtgaaggtttcagcctgtttccaatcgggtttttgggcattgctcccttcctattctctccttctcttaatgaaatgatatgcacttctcttgcgtattcaaaaaaaaaatattaaaatgtctagagcaatataatgtgttagatcaaaactttgtatatgtggaaattgtgccaaactggtaatgtccctgaaaaactattacaagctgttgctgtatcaagttgaccttatgggtagtttgattttatcttttccctaaatttagcatcctcctttacaggcaaaagcttctggtaggactcccgaggagtatgaaaagaagggggatttgacaggagtaagctgtccttttagtataaccccctgtattcttatatgtctaactattgaccttcgttacctctcacttttttgaataggcttcaattcttcggcactacaatgaaatattaaggtcttgtaatgctcttgattaccatgattttattaattcatcgataacccttctcacaaagtttcctgaaggtaatttcagtcctgatctcacaatattatctattgtgataaatttttaaataatatgattgtgatatgatatctctcatgcagtatacgacgagtgccgaaatacatggcaggcaatagtagttgatgagtttcaggatacaagtgctatgcaatattatcttttaaagacactagcatcccacaaccgcataactattgttggtgacgaagatcaggtgcacaaattatggttcatccatcatcctataatttgaacttgtgatatctgtttatttactagtgttttcagatgcaatatgaatttattttcattctattcttctcattttcagtccatcttcagtttcaatggtgctgatgtctctggctttgattcatttcgtagagattttccaaatcacaaagaggtaattacggcatctctgtaggagtttcctaacatgcactttgtctttgatgcacaatcttgattctcagcttgatgtctgttaattgtgttttcgtgctgatgagtttaggtcagattgagcaagaactatcgctctacacgggcaattgttgaagcagcaacagctttaattcacaacaacactaaacggcaaagccacaaacttgctgagaccgacaatccctctgggaataaggtgtccttaaagatgccacatattgcttcttcttgcatcatt

SEQ ID NO: 51698 - DNA, 12943 bp, Oryza sativa
  unsure (1)..(12943): unsure at all n locations
cccttactgccaaattatcaatttataatccttggttctattaacattttaaaacatgaaaattactggtaccttttcaaattaatactttagttgttgctgaccataatttttctgtgtatatgatatgaagcattgatttggtaaacacaagtgcactatcatctataattattcaagaaaccaaccatgcaggctgattttgtttttttcaccaaattattttgggaatgttctgtgttattatatggtgtattgtgggggccaagggtcttattagtttttgaccataaagtttgtttggttgctgatcgtagtttccttcttttctagttttttcttcgttgtgtttaaccctggcccttaagggcctgtacgagtctttctagactcactcccctatcttcttaatataatgatgcacagctctcttgcacgttcgagaaaaaaaaggtggtattatggaccggatagggtaagggtcaaaagactgagggataactcaccctctaatagtgccagcaaggcttctccttgctgagttaagagaggctttgaggcttagagctaacttaagaatttatatattgattgattcataatggagtacatgtggtccctttatatataggtaggactcaggactgacttgacatctaaggagctaatctctaatattgtatgaaccaatccatctctatctcttgtttacaaacctcgccactttcctaactagataatctcctatctttatttgacctattccttatttataatgcctaaactgtttcagggcctggccaatgcccataacataacatgtggactgagcttcttgacattatttcttttagggtttagcaaaaatacatgtttgccttgtgaacaaaaggagcattctgattattttactcattgtttacaattacttggaacttggtagaaagtaacaaccctcttcatgctgttagttctgtaagtgcaacaatttaagtgctttaccatgtaactatttcaggttatcaaagcaattatggccatacttaaaactacattaccaggctgtgatgatgatgccccatggcatcaagccttcaaggccattcttcctggtgacaaggaagaaaaaaagaaggttcagttttacctgattatattctattttttgtatttgttacattacatttgcttatatttaataaattatcgtaattcccagattatacatcatattgaaaagatttcattggctagaaagtgtagcttcatatcggctgctactgacatcttcagtgcaaaggtctctggtaccttcaaaaggttgttatcttccgtgtttacttaccgttctacagtccatgtttattttttgtttctgcagggttctttattgctatcttccaatgctcatggtgcaaatataatgtgatgctatgctgagtgtcccattctgttggttgtagggcccagattactcaaggaagaaaggttttatcagccttggatagcctatcaaaacttgttgaaagggtatgacaaatggtctggccattatatctgtatttctgcaaactaatgaacatgtttcaaacttttaatttatttgatatatacaataatgtttaggaataatattatcacaaataccatctttggaaagggtgcaatactcacatacatagacaaaagtgttaagataataaatttatgaaactttgatctcgtttaccttgtctgtcaacagaaaataggattctaatttctgtgtatgactattgactcatcccctagtatacatcaatcataccatttctgttttctgcactggtagttagtcattaactagtaaataggattctaatttctgcatatcacccacaacctactgacaatacatcactggtacaattttttgctttccaaaatgagttgctaatagccttgagctatcttgtgtcatcaattcaataaatatatttggtaagctatgctttttgtacgatcaattgagcaatgatatagtattacttttacaattttctgtatctctcattgaacctcaagagctacaatttattacttctttgtgatacaggaacaatcagtttcagtggtcatttcttctgctggagatatgctacctcaggttcaattaatttgttgcagttgtatttaatgagctttgccttcatgtatgatctgttagaagtagatttagaaacgcgccatttttttttcttatggtgcaagtgctgcactattcactgttctctggttcacttcaaggtattttgtttcatcctagaaaataaatcaacaatttatcggcgccatacatttgtatgtgcatcatgacttcttgaggtcctattagcatgttgtggtcataaaaagtattaatatccctgatgaccatctaagcagtattctgttgtatggttcatggcaagaaaagctacaaagccatgctttaggccctaatgcacttttgcagtacaaactacaaagatatgctatattttacgtattttggatcaaaatagtgatgcacattcaaacttattgagtctgttaggtttactagtactgagcttcattaaacgtttaatatcactgtgcttgattctgttcaatttctttaattacagctactttatcattttttgacagaaatacctacttgaaaagcgtgcgattgttgatgctgatgggggtaaattattaaatgaagataatgacatcagatcagtaagtacagttcatacacctttgatgctcttagtgttttgcacattgatcctcgagaaagactaaactttgaatgcaccaagaatcaattttggattatactgtctcaagcattcagaacttgaagaaattatggcaacagagcttgaaggatacaaagatgcatttatatttacatatttgtactgtagtagcctgctgctttgggtcagtcagaagcatccatcggaagacacttattcttgataaaaatgacttaaaattgcttttttttttgtcaatcaccatggttggacactcaatgtcaattgtctatttccaggacttaaaaccatggactatgtctaatttaccataccatcaccaattttattgatgaaacaatagtgtgttacacaaggttatgaatagttaattctagcttagtttcccatattgtttggactccttgttgattatgtttataacttcctgtcccctattacttgactcggtgttttggcgataattaaaatggttgctttggtatgtattaagaaccagtacatgtagatggaaatcataatcttcgtctgcagcaacttgcacgaggtgtttggtttgcatgtgcagctccacctaaggttttcagtagggaatacttaagaataaaatgcaccctaacatgacataagaggataggagaggtcggggggcgggggagctatattccaccaaagttcttttttgttctgattgggcgttgcaatatatatcaaacccaagtacgctaattgttgttgatattaccgatatttgatttggtttgttagactcatatgaggtctctttatgaactttcttttttggattttgaacattttttgtttggatggtttatatttgacatacattttgtatacagagaggtggtgttaacttatcctaaatcaaactgcaggtccttcagtttttaatggatgatgtgtctgacttcttatcaacacatttttctagttcagtggatacaagcaagactgaggagaaaggctgtgcttctacacttaaagcctttattgattatatctctttgagagaaactgaaaacttcagatcacgaaaggaggaaaataaaaactctatcacattaacaactatccaccaggttctttattcccttaactgcaataaatttatttgtgccatttggcaattctgacactaaaagatgtatattcccttctatgattcgcagtcaaaaggtttagagtgggatgttgtgtttatcgtgcaggtattgtactttaatcagtagggaatttacggtttgttcatctttctatgtgttataaaatcatagaatttagccgtaatgttttctcattttttatcagaagtatgctgttttatgttgtgacgataaaaaaatgtgcaagctgggaatggtatatggtagacatacattaaaattcagaaaggttatgatatatagagctgtggataatgaattatgaggaatttgaaatattgacttgattcagagtaactttgtactattcttgcctgtgacaacatgagtgccatcatagaggactggtcttgttatatgcctttgtttttctttgatttgtaatggagagtctaaacactgcaaaatttatggatgggtaacatattttggttcatgtgtttgttttattctgatattatgcaactacgttaatttttccaaaggagtattttcttgcttttgttcacttcagtccttttgctcaggcaaatgattcagaaattcctttgttgcatgagtacaatggcactgtgaaagaagctggaagcacactggaggtttgttcaaattttttttctttccctgaggtggttttctgtatgtattctgcaacttggttgtaattacaggaggagagaaggctattctatgttgcaatgacacgagctcgaaagaaactgtacatcttacatgtcacggttgactctaatcgccaggcaggtgattttatattgtattcatccttataaagtatctagatttcactgacttaaactattactggcgtctagctgctgcaaccttcacgcttcctcagggagattcctgctcaccttcttgaggtacaggtgagcactattttgagatcctgttttgaatggtatcgagacctgaagaatggtatctctatcccatattgttgtgtattccaccatacaatctgcttggagcattttaaaaaattgtaaattttagatggtatacagctatatatcaatctagaaagtcatttatatgagtaatataatctattatagcaatagtagcttaacataattttctcttttcaataatgtgaagggtgagggaactgtgagaagaactcctgaacagccggtgaacattccatttgatcaacctgaaggagatacatcagttgaaaggcctatggtggtacggaatgaaacttcacctttcccagaaatggatcagccatgtcttgctaatgatttcttgaagaggtaaatcagcgtgatatgatctatttcccttgtgagttgtttttgtgcaagcagttatttttcctgcacaatgtatttaaagaacagataatttgcatctataacaaacacttgctattttatgttatgtcatttgctgtattttgtttctcccctgaccaaaacaaattcgttcttctctttttgcaggtttgaaattgaggatagagcaataatttcacatatatttcatcaatgggcgaagaaacaggcatttcaaaatccaaaaaggctgcttgataaggtactgaatatttcattttacattggatggatgccatatgccattgattcgttcctataaggagaagtagttttttttttttgtacaaggaaaatatggtcagcagctcactggcggactgaatgaagtcggtagtatcagcaaattacatttatgccatgtctgttgctgtattatttttgctaggagtcaggatctgagacatgttagttctgaaacagtcattggtattgcattgctactgtacatttcatgttcagtctatctatgcttgccttttcagattggttttgttattgatgaacgtttacgaggtaaaggatacaagcgcaaggttggttgctttgttccattgattccactatctccctttctgtcacatcttttatttcatgattgtttattatattgatgttctttatatcatcttgttcgtagtcagtgttatacataggtaatcagtgatattttgatcatacaaattgttatttctcattcaggagattttaccctgacatattaacatgtgagttctttttttccaggatgtattgtgcaagctgaaatcattcttaagtggtgatgaagcgtttggttatgcacaatatgtgagttaagctaaaacgatgaaaattttggcagtctcttgaccttgagcgttgattctctttaataaattatttttttgagaactttaataaattattaatttcatattgtgaactcttaggttatcaagtgggaacagattcctatcgacaagcggagccatttgatgagagagagacaggcaagttcctgaattacgatctgttatgaattaacttagaatttcttttctttttaatattaacaaggcatctacatgatggacacctgtccccaagattctcacatgtttgtgatcttccaggaacatttccaaaagcagaggatagagaactccatgggttcctcagaacctacacctaagcaggtcagttatctttgccaatgctctcatatctttacctactttgactagctggttcatctgacaatcacattgccattatggtgcccgttattgacaatagaaagcccatagttttttttttggcagaaaatagttttactggtttccttcgctttatatgctattcccacctgaatggattatcattcaaacactttgctcatcctttggtgcagatatcgtacctccggaacctggggtgcaccatcacacccacgtctcgcctgcacgcgtcgcatcttatcgagaagtacaaatctctatgacttttcactgcttgaacctgcaggggacacatgatttcaagctcagtctcagaattgggaccatatatacagcaacgctggtgaaagttcctcatattaactgtacatgctgtacatatcgatgtacttttcccgtggacatggtgtggttagagcaaacgtcttgttacattaccaggctgttcttgggccacaagggccaaccaagaaacgaaccgggccttctctttggggaatctggctcggcccacaaaataaccagctatgggagactcagtcacatccctcatgcaacgtacatcctccgtcttgtaaaaaaaatatcaacttctagctatgtactttatgggatggattgagtacgggttatgtgatcattgcctcttgtttttgcgatgatccttgtacgctagtgcctagtggtataaaatgagctttgtatataatttggtccattttttttaaaaaaataaacctgcaataaaacgttttctagaaactggacctacaatatggggccgtgatattcaatgtgatgtgcatacagcatggtgttgtataatttggacgtcgatgtaggatattttgtgagaccattatacgcggttgcctacatagcctcaaattatgtgacacggtgccaatgtgccataaacatctctatctctaaaatgctaccgacggtctagaatatatatgatgtttaggagaaccaaaattgacttaaatgttgttatatttttctgtcctaaacgtcgtatatgatcatgattggatggagtattttattagaggcccacatgtaaaagatatttaagaaaaaaaaagactaaattaccaaaactaccccgctatgtactcctatactgcccagtctgccctacaagaaactcgtgcgtgaacttctactgtcactgcactcttcctctgcacacacgtttcagtctctcatcagcccgacgtttctgctgcaaaaccacggcctgattccgattcacgcaaatcgcggccaaatctcgcaaaccaaaaccaaaatcgccacctgtaatgtaaagaaaagaaaaacaaaaacaaacaaaagtgaaaaacagccaaaccgacggcccaaaaagaagccgcagcggtgcgtttccatgtggcgaatatttccaggatgattccaatcggcgcacggcacctcagcacatcacaccagatatataattaaccaccccgtctctttcacgacccactccgcctcgcctccactcctctcctctccgcatcctcctcatcgcctccgcttctgcttttttttttcttttttctcgttgatcggtttgttcgatcagatcggttctttggagagatggagcagtccttcatcatgatcaagcctgacggcgtccagagaggcctggtaatctgacttctttttttcttttaatgttcttcttgtcgttttggccatcgattttcgagaggaattttgcggtttcggatcggttaaatagcgtagttgattggtgtttgtttgtgagattttgagttgttttggtaactttttgtaccgttttgcgtggtttttaatggggaattttgattttctgttctgcagattggagacatcatcagcaggttcgagaagaaaggattctacctgaggggtatggctgatccttttcccctctcgatttgatcgtatggattcatttttcataactttcttttgtatttttattgatctaattttgggttgacctacccgtttttttcaacacatattatgaaaagcagaggctgacgatatcataatactctgtttcatatgggtaggttggggttgtgagttgtgacatggagaatttgatgggtttaatacatgattcaaaagcaagatttttttatataatttatatgttgatgattggccatttttaactggggacaacagactgacacagtaatattcaatttagtatatcaactgattcgttgtcaagtctaattttgcattacatgacatgggcaacttatttattattatagcagagatcgtcaaagcctcaaagatgtagtctactatttgtacttgtaatcatggaaatatctttctgaaaagaaaacatcatttgtacttgcaatagagttcaactaatatctttggcatgcatttaacgtgctcttttccattttttgttccttattaaaagttgttgtactttagtggaaaccaaaatgttttataaagcattacagaacaacaaaaacagctgtcttaaggaacagcaacaaagaacagaagtaaaggactttcatttaacttcccctgtttataacaactgtgtagccatgtattggttgatgtggcgattataacaactgtgaagcccatttttatgagaattattcgaaatgcacgcaaaacatcatccaaaaacttaatttcatttaacttcccctgtttaagaaatatacttcctccattccaaactataagcatttatgcgtgttattcacaatgaatctcgatcttgagattcattctgaaaaacaagtataaatgctttttattttggaacggaggtaatattcggttgagggatgatggtgcttacgaattactttttgaactgcaatgatccagggatgaagttcatgaatgtggagaggtcctttgcacagcagcactatgccgacctttccgacaagcccttcttccctgggttggtggagtacatcatctctggccccgtcgttgcgatggtttgggaagggaaggatgttgttgccactggccgcaggatcattggggccaccaggccctgggaggcagcccccggcaccatccgtgctgactatgccgtggaagttggcaggtgagtcattcttgtctgtcttggtcatcagctcattattgcttgaattttcagtcagttcttgtgatccttttaatcatgtaaggatcctgagcgatggatggttctttatttgttttgctgctagcatcaaacgatgattttgtttgaaaatgggtggttaagtggcttttattttgatctatataaatgtgtgaacctctgttttttaccagtcagaaggtatcagatagtgaatgtgctgtgatatgatttacaaaaacttttgcatgcattatgatgttcatcttttctatatgttacgatgttagtgtatttagacataataactacttggattatgttaaactatgttcaattctagcttttgtttttgaaaataaaaatcataatgcttcctgcttatcgatgcctaagctcaagctgttgtttcttgtgtaggaatgtcatccatgggagcgactccgtggacaacgggaagaaggagatcgctctctggttccctgaaggtttagctgagtggaggagcaaccttcacccttggatctatgagtcttagagcttcgcgcctataatcgatcacctcttggtggctagttctcgttaaatatttgagttttgtttcagagttgtcatctggctgcctcctgagtcaccattataattctgctgtgatacaatcacagttatatgttgcctgaacttatatggctttttaagtttctggattggatgtgatgggaaaataatactagcagtcagtttttgcttataaatgtcgtaatatcttaatcatgctctttccctaggttcatccaagataagcagatggtgttgcctgattttcttgtggcacataaagctcttagatttgcaagcaacctgctgttctggactttgttggaaaatttactagaactaaccaaatacccgtgctttgctatgtattaaaacaaattaacagtaagatttttagcacaattttgtcatgtagagatgtggagatgaaatatgatagaatcctatatatagagggattattttataacaacatgatagagtaggtgataaataaataaataaaaacttggtgagctgttggtaggttcattatcaccagcattgttctcttttaaaaggagtatagataatgttgaatgcttcaagtttaaaatggcaaaataacacagctgattcttacatgagaaccttatctattcaaatgtacagatgattttgcttagaattggggagaaaatgaatattgcaaatgaagtctggtactctgattggcattgatgagttgattcacaagtttcctgaagaatttctagtcgtgaagtttctgaaatgacaggagagtttcagcctgtctagcaggattgttttttcaattaaaaaaacataaaacagaaccattcttaaaactttcgaaataaatttgaaaactttttctgtgggaaattattttgatgcattgaggggatgttttctcttatttgcatgtcactaaaattgttacgaaaaaaatttaaaaaaaattgagaagatgtattaacatgtgatatattattacacaaacatacaagctcaaaatcaatttctacatcttgcaacgaaaaaacaattaatcgttgcaagatgtagaagttgaatttaaacttacacatgtttgtatagtgatatattaaatgttaatatatattcttaattttttttataaccatatgtaaacaacgagaatccactcacactgtctgctttggtgagtgactctcaaccaggtgcggacgtgtcctgtgcatcatcttcaaggtaagtgtggctcccgatcgtccacctctccaaaccatccatcgcacaaaaaccaccaccacactgtccgcgcatggcgcccagctctccatctcgtgtcgtgtccaagaaacgcttccggctgccatcgccatggcgctcgccaccacctcctctcacgcgctcagctgctacctgcatccccgacggcgccgccgcggcaatgtcgccgtgtcgccgcggtctgagggcggcggtgcccggaggaaggaggaggtggagatcgtcatcgtgggcgccggcgtggcgggcctcgccacggcagcctcgctgcgccggctcggcgtgggcgccaccgtgcttgagcagggcgcgtcgctgcgcgccgggggcacgtcgctgacgcttttcaagaacgggtggcgcgtgctcgacgccatcggcgtcgccgacgagctccgcgccaagcacctccgcatccaagggtacgtctctctcgctccctcccctgtatctccatggatgatctccgagcttctcccgtcgcgttctgagctccgttggtgacgttccagctgaccggccgcaggatgaagatgcggtcggcgtcgtctccggcgtcggcggcgggcggcgtcctccgcgagttctccttcgaggaggaggccccgggtcaggaggtccgcgcggtggagcggcgcgcgctcctcgaggcgctggcgtccaagctgccgccgggcgccatctccttctcgtcgaaggtgcggcgcgtcgccgtcgccgggcagcagcaggggcccggcggcgccaccgagctggagctcgaggacgggaggcggatcgtcgccaaggtggtggtcggctgcgacggcgtgaactcgccgatcgcgcggtggatgggcttctccgagccgaggtacgtcggccacatggcgttccgcgggctcgcgcgctacgacggcgacggcgggcagccgttcgaggcgaaggtgaactacatctacggccgcggcatgcgcgccggtttcgtccccgtctcacccacccgtgtctactggttcatctgcttcaatcgaccaagcccaggttcgcgaaatttgcttagtttataaaaacaaataaatatcatatgtagatttgctttcgaaagtattatcataataccatgaaattaaaacacgaatgttagggaagaactaatatcaaataattagaaagggcaaggcttcgaatccagatcatctagcccaccaccttgtgaagttagccggaagactcctaggagtttcatgaaattaattattagattttatgaacttattttgatataaaatcgattaacatcattgacttaggattcaagtttcaaaagtttaaccaaatgttatcctaaacatcgcgcatttacgnnnnnnnnnnnnnnnnnnnnnnnnnnnnnnnnnnnnnnnnnnnnnnnnnnnnnnnnnnn

SEQ ID NO: 51699 - DNA, 4074 bp, Oryza sativa
gtctcacccacccgtgtctactggttcatctgcttcaatcgaccaagcccaggttcgcgaaatttgcttagtttataaaaacaaataaatatcatatgtagatttgctttcgaaagtattatcataataccatgaaattaaaacacgaatgttagggaagaactaatatcaaataattagaaagggcaaggcttcgaatccagatcatctagcccaccaccttgtgaagttagccggaagactcctaggagtttcatgaaattaattattagattttatgaacttattttgatataaaatcgattaacatcattgacttaggattcaagtttcaaaagtttaaccaaatgttatcctaaacatcgcgcatttacgaccaaacagattaacaagggaaacaagtgaaattttacatttgaaagttttttttaagaaaaaaactgttcaatgttgtatagcactctctaaatttgttagttattcttgcttgaaatcttagcatttttcgtagctgatgtgtttgaataatctttgactctactaacttagggccaaagatcacggacccggcggcgctcaagagggaggcgctggagctcgtccgcgggtggccggaggacctcctcgccgtgatgcgcgacaccccggacgacgccgtggtgaggacgccgctggtggaccggtggctgtggccggtccttgccccaccggcgtcgaggggcggcgtggtgctggccggagacgcgtggcaccccatgacgcccaacctcggccagggcgcctgttgcgcgctcgaggacgccgtcgtcctggcgcgccgcctcgccaccgccgccgcgagcgagggcggcgaggcgagctcgtacggcgaggctatgcgggcgtacgagcgagagcggtgggggcgggtgttcccgctgacggcgagggcggggctcgtcggcgcgctggtgcagtgggggaacccggcggtgtgcgcggcgcgcgacggcgtggtgatcccgaggctggtcaggctcggccccttcctcgagcacaccaacttcgactgtggcctgctcgagccgtcggcggcggcggcggcaccgtcgccatgacagagccaaagctgttgtctgaacagtggcgcaactgcagctttctcccacactcactctctcgcttcaatgtaactactgtattggatagtggatacaaatttcaatgctagcattttctaactattgttagacaaacatttgcaataatgtgagaaaagacattaccaaaattttgcaattgatacgaatgaatcaatatataaattgaacgtaaccccatatactaatgatgtttaaggactatctactgctcaactctttgctttatctaaaatacattctccaacttcaaaaccagatattatacgctccaaattatgaatacccgaaacatataaccattaaagtcagatttagtacaattggaagccatataagatgctacttataaaaatatttcaaaaaattagtagaccccacatgtcaggggtcaccctcttctttttctctatcttttctctccttcctcttcttcctctataaagactgagcaacaaaggagggaggagggtttatacgtcggcgctccggggagggaatgacggtgatggctgtggtaggacatgtccaacgtcacggagcagccagcagtggtggaggccgaaacgaaaactacgagagtagcggaacacatgcaacaagagcgcagagtttcaaaggagagattttaccaatattttaaaatatattttagccgtgacacgttttttaatgtctactaataaattacacttattttgggtgttttgtagtaaaatttacttttggacaaagctaagagttgagagggttgtaaaataggcttatccctgtagagtcatagatattttagcgcatggtaataggaaacgtataaacttaaactttgtgggggcaacatctcgtggcgggccagacgctgatatgcacgaggttgggctcaacgtgttggcgtcaccaattaaacccagccagctaagttccttcagggggattttgggtgacacgcgaaacaagaaaaaatatcgagtattagttatgataaatatatatatataatttaattatttttaattctttcaataaactttcatatagaatagagcttttttttaaatggaactgctagaaagctttcgcaagttttttgccgtccaaattttcggatttgtggccatcgcatcgtttaagtgtacatgaaagaaagaaaaatttctagaaacaaatttgtacagttttgctataagttacaatgcagttacagtacaactataatacatttacatctcaattatattatagttatattaagaaaacttgcgggaagcgtcgtaattatactataactaaatctgaaaaaaaaagaaaaaaaaacttgggggaagcaccataacagatacggaggaagaggaagcgtgataacggatggtgcggcttagcagagaggagcgatgtggtcgagctcgacggggaggccgtcgtgcggcgtcggcatcgggtccctgagaaacgtgttcttctcctccccgaggcagagcttccacctgaaatgcctcaccgggtagtgcgccgtcaccagcgtctccaccctcgcgagctccatcccggggcagatccgcggcccgccgccgaacggcacgaacgagtacgccgccgccgccgccgcgccgtcgaaccgcgacggctcgaacttggtcggctcgtggaagatggccggatccatgtgcgtcacgctcggcgaccagaagatctgccaccctctcgggatcgtgtagccctcgaactcgacgtcgacgggcgctctcctgaagctgcccaacaccggaggcaccatgcgcagcgtctcctgcgcgacgcgccacgacagcttcatcttggcaacgtcctcgcatgtcagcgcctcgccgtctcgcttgcccctggcgatctcctcatgctctgagtgttcgtcaggggaggggagagttgggtttcttgggcgagaggagaggaaagttagtgctactactacttgccttgggccatggcggcgagggtggccgggtcgttggcgaggtggcggagcatgaaggtgaggaggacggcggaggtgtcgtggccggcaacgagggcgagcacggagttgtcgacgatctcctcctcggtgagcagctgccggccgccgtctcggaggctgaggaggcagctgatgagatcgtcggatggggaagactcgccgtgctccagcttcgccgccttctctctcacggtcgcctcgaccagccggcgagccctcgcgctcgccatgaggcctctgcggaacggggtgaacggcaggtccaccggcaccgtccacaagccctcgtgcatgccgtcgaacgcgtcggcgagctgctcccggatggcgccgcggtcgaggccgaacagcagggtggcgatgacgtcgaacgccagcgtcttcatcagcgggaacacggcgacggtgcggcggccggcccacctggcggcgaggtggcgcctcacctcgctgtcgatcttgccgacgtaccgccgcaccatgtccggcctgaggaactgcaggatggcgccgcggacgcgccggtggtcgtcgccgacgagctccagtatgttcctcctcccgatgatcgccgccaggctccggggctgcttgggcgccagcgcctcgtggtggaacaccaccttgttcgccgccgggccggcgacgagcaccgtcggcgcgccgaacagcgacagcttggacaccgggccgtacctgtcgatcctgtcctgcagccaccggtcggcggtgttgcgccgcatggcgcgcagcagggaaaggctctgcccgatgagcggcaggccgagggagcccggcggcaggttgcgccgcggcggcggcggcggcgacgccctcctcgccaggtacacggccagcggcgtcaggaaggcggcgaggagcgcgatgacgacggcgacggcgacgactgccattgcaacaatagccaaaaagagtgta

SEQ ID NO: 51700 - DNA, 771 bp, Oryza sativa
  unsure (1)..(771): unsure at all n locations
caggtatagccccaacgcgaaggcgaccacaaagcttcttcccgaactccgcagcaagagggcagaaatttcgaagtacctgcagcgtatagagatgtccattgcagggaccccagcgaagatcaggctgaaggtcgccatacacgagcaaatgaatgccagcgtgtcagataaaatgaaggcgtcaaaggcatagctcccagcaagcagtggtgtgcctgccgcgttatccgacccggtttggtaacctccgggcaacgtgaatgctgacgcgaatgtcacggtcgcgacaagtacggacacaatgcccagcatttgcgatgcatttgttagatgcgccgagaccttgccgttgtctatctttgggatgtgtttttgggataagaggtccggtcgacttgcaccgcatggagctcccacaaattgcaatgataattgtatgagaccccttggattctgcgagaatgaacagttaatatactagtatcatttaagcaatgatcttgtataaaaatattactccctccattcaaaagtctaaaatctatttcaccttttggtttttccaaaagtttaaaccgtatttgtaatctctatatactaaattaaatggaattgctaaatatttgttgacagattttttatggctaaatctttcactttctaaaccgttgaatgtgtcctagattcatgctataacagtttaatacgcatcaannnnnnnnnnnnnnnnnnnnnnnnnnnnnnnnnnnnnnnnnnnnnnnnnnnnnn

SEQ ID NO: 51701 - DNA, 945 bp, Oryza sativa
  unsure (1)..(945): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacacctaacaactaacatgataatgtcttaaaaaatatgcacttcatacacaacggcatttcaaggggaaaaaaacaggtcggcattcatttgcccaacttttcttatcgaagtgcaacaaaaagaaaatttccaatacttcacagaccatcctaattctcttctaatttcaaagaatatatcacactctcctatcagtgttagggatgaggaaaaccacaattagactctcaaagttgagtgagccagattgctccaaccaataactattcatcaggaccttacagagttttccaccgtttgacatacctctccaccccctgtggcaattgaaatggccggtggaagtgaatcatcaccaaaccacagttcacagatttcttcttcatccgcatcctccatttcttcctggctcgtggctaaaggctgagcatcaccctcctcaccaatggcattctcctccttccggaatgcatctccagactggattccccacaaagaaagaacaatcaaaattagttccctattaaaagtagccacttcaggatctggtacagcacatttcatttctgatatatcgaaatggcggaagttttgctttcctagttcaaaaagaaaaaaaatcgccagtatacagttgaactgccagcagtcacagattcataataatatcacactgataaactaattctgccccccaaatccttctcgatcctaaagcaatcccatttcatgaaacaacaagtttcagaatcccttaggcctcgccacttccctcccaattacaagattcctaaatccacaaatgcgcccttagatccctaaaccccagtttagaatgaaacg

SEQ ID NO: 51702 - DNA, 949 bp, Oryza sativa
  unsure (1)..(949): unsure at all n locations
tagttgattttatcttttccntaaatttagcatcctcctttacaggcaaaagcttctggtggactcccgaggagtatgaaaagaagggggatttgacaggagtaagctgtccttttagtataaccccctgtattcttatatgtctaactattgaccttcgttacctctcacttttttgaataggcttcaattcttcggcactacaatgaaatattaaggtcttgtaatgctcttgattaccatgattttattaattcatcgataacccttctcacaaagtttcctgaaggtaatttcagtcctgatctcacaatattatctattgtgataaatttttaaataatatgattgtgatatgatatctctcatgcagtatacgacgagtgccgaaatacatggcaggcaatagtagttgatgagtttcaggatacaagtgctatgcaatattatcttttaaagacactagcatcccacaaccgcataactattgttggtgacgaagatcaggtgcacaaattatggttcatccatcatcctataatttgaacttgtgatatctgtttatttactagtgttttcagatgcaatatgaatttattttcattctattcttctcattttcagtccatcttcagtttcaatggtgctgatgtctctggctttgattcatttcgtagagattttccaaatcacaaagaggtaattacggcatctctgtaggagtttcctaacatgcactttgtctttgatgcacaatcttgattctcagcttgatgtctgttaattgtgttttcgtgctgatgagtttaggtcagattgagcaagaactatcgctctacacgggcaattgttgaagcagcaacagctttaattcacaacaacactaaacggcaaagnnnnnnnnnnnnnnnnnnnnnnnnnnnnnnnnnnnnnnnnnnnnnnnnnnnnn

SEQ ID NO: 51703 - DNA, 720 bp, Oryza sativa
accgtcaattgctttccatctcaatcctgcacacttttcactttcgggtggtaaggtaggaggcgaatttttgctggatgcatgcatcttattttgcgggctaattaagagtgatcgagattatcacaattaattaaatacaaactgcaactgcatatatacataatacatgcatgcagcgctgcctgtgcttttggagtggctgaaggacgtgacggtggacgtgcaacaaggcgaccgtgctatcagggtgcctcttgtatcgcatctggcgcagcaaagggaccatcagacggggagcacgcctcttcacctggctgcatcgctggaagggtggccatacgtgggcattctttctaaatggttcccagatgtttggccgcggccgaaatcagcagtcgcgctgctgctagaagccaacacatgtgcagcgtatcaaccggacgctgaaggattataccccatacatgtggctgccttggctgacagcctcgacgtagtcaggaccatgctgcagaaatgcccggactgcgccactttgcgagatgccaaagggaggacgtcctccattccgcggttgaggcggagggatacagagtagttgaatatgtctgccgccgaatgccaaaagaattttcgtccgttctgaacatgcaggataacaatggggacaccgccctacaccgagctgtccatctaaggaatctgccggttttaact

SEQ ID NO: 51704 - DNA, 791 bp, Oryza sativa
agaagatcacaatgttgatgccatacctgacttgaggaagttgtaggagccgatgggatcgcagaatcgtctccagtgaagaaagtgaagaagagcaccgaattgtggcttatattgggagaaaaccttagctttgggttttttagcctggctttaggtttttgtgcattgaaggtgagtttctctcacttactttccctcctttagtgtaggtctctgacgtattggatcatctgggcccgcccagcatatcagtgatccatgtcagaaagaagtaatcgagtgaaggtacctggacttatcagcgggagatatcagttatcactatcggtatcactatggtaggtaactcgtggaatatggactcaaactttcaaagcttttgcattttggatatctcaggtccaacggtacaagacgagatggaagaaaattaggtaggacctaggtccttccgagattagaaagactttgcttctctatatgacacgtgtataacacaagcagccaacctccgactcctttcgtctcagactctcaggctaaatttctcgctcttggctgctaagccagggaacagcggcaagccggcgtgctctggccggggcgatgcacaggcaaccccaacgcgccgcgcagtcggcttagataagcacattgcacgtggctgtggaagttctgtgggaatcaatcttgtgcgccacagtgtcgtcctcgatttccagcagatccagctcttagttcttgcaattgatcagtccatggcataagattgaaccagccaattaatt

SEQ ID NO: 51705 - DNA, 949 bp, Oryza sativa
acatggcaggcaatagtagttgatgagtttcaggatacaagtggtatgcaatattatcttttaaagacactagcatcccacaaccgcataactattgttggtgacgaagatcaggtgcacaaattatggttcatccatcatcctataatttgaacttgtgatatctgtttatttactagtgttttcagatgcaatatgaatttattttcattctattcttctcattttcagtccatcttcagtttcaatggtgctgatgtctctggctttgattcatttcgtagagattttccaaatcacaaagaggtaattacggcatctctgtaggagtttcctaacatgcactttgtctttgatgcacaatcttgattctcagcttgatgtctgttaattgtgttttcgtgctgatgagtttaggtcagattgagcaagaactatcgctctacacgggcaattgttgaagcagcaacagctttaattcacaacaacactaaacggcaaagccacaaacttgctgagaccgacaatccctctgggaataaggtgtccttaaagatgccacatattgcttcttcttgcatcattccagttacttattctatccatcattttgtatagatcattgttaaggagtgccacagtgaagattcacaatgtgcatttgttattgacaagattattgaaaccacatctagttcagttgaaggatgtcattttggcaaaattgctgtcctatatcgcagacaggttgagaaatcttccacttattgctgaaccatattttttggttgtgtttatggtctaagttacctgtacacagatcactggcaaagcattccaggcgtcattccgcaacagaaaaattccttttaatattcatggtgtggctttctacaggaaaaaggtgcttggattaatttttactcccaatattatcgcggactagcaa

SEQ ID NO: 51706 - DNA, 1109 bp, Oryza sativa
  unsure (1)..(1109): unsure at all n locations
actctcttcattattgatcttaattccttgtcnntaattaantatttcctactacttctctggcgtttnttatcccanncccccncccatgggatgatgcgtgcacanccccngncagncgacnctagaggaaccccngaaacncgaagaaggaagaaggaagcaaaccccnggcaaacagcancagggaaaggaggaaaaaggaacccccgcaaagagggccaggaataaaacatggccccacgttttatccagttggcttatcctacagtcgagatatctctgataccagcttgtcgcgcccggaaaaataccttttccataacactagtgtattaatccccgtcccaggaaaagcacatcaggcctgacaaacatgatataaaagacacatctttattatatcgataatatttacattattacaaaggcacttcaggcctgacaaacaaaaataaatagcagcggactagtgggcctatggctccatcttcacaggcgctcaactagggtataagccagggctccacctaagacttcttctccaaagcttctcttactgaagggggggaaagatagagcaagaatgagtacaaccacagtactcagcaagtcacaccgggatatgcatgattaatgcaagggagtacaaagggtaataatataggggttaagttttgcagtaaacagcatttaagagtcacttagttgcccaaagctattttataaagacaatcctagagctacacagtattattaatcaaggccctgaacccacacgaacctggcttaacccaaggcctatgatgattcagaccaaacttgcaacccgacctatgtcccaactcgtcccaagcaaacctagccaaccattcacattttaggtgttaaagcaagtttaaaaattaaaccactaacttgngtacattgctaggctttgccataaccgaaggcgcggctattcaatagaatatactctgatcagaggttacatctttaccacaagacaaattttactttgcatttcacgggccgggacccgtggtaaggatgtgaattacccctttaccattctaagcggacaaaaggacgaaccaaactcgctacgg

SEQ ID NO: 51707 - DNA, 2593 bp, Oryza sativa
  unsure (1)..(2593): unsure at all n locations
ggcatatcggtgtggcacccacccgtcaacgatgttgggggtggggcctgcccgtcaatggcgcgcggttagggtaaagtccggatggcccgcgggaaatggacaagaagaaaggggggtaaagatggcccgggccggcccaagagagggaagggggactttttagggttttttgttttttataaaacctttttaactttgtttatttcttaacacttattatttgagctctgaaaattccactaaaatttatttacgtattttaggcttttaggaaatatacaaaaatcctctaagtattatttgacttttaactttgcacattttaattgttggaggctttcacccggattttaattattctaggcataatttagagaatatattttagggtcgttttgggacgtgacaccaatctttcattctctttcttaagagcttgcatagcatcaacattagtagcataagagttcaaatcaatattgtaacacctagcacaaccattgctagtagatgggttggaagaattagaaaccacatttggttgagaagtgctattccaaagagtgtcaaattgaacttcaagatctttatgacttttgtctaaactagcaaatttctcttgaagagtttcattgacatccctacggctagctagagaaccattagccaaattaagctcattagctagttgttcatttttagcacattctttagctaggctctcctctaaggcaaggtttcttttcttctcaagaataagtaattcttcttgcctttcgagagattgttctttactatccaaagctctcattaacatagccaaatgttgcatagcgggtttgctaaagctcttaagcacatcatctaattcattatcactttccgcatcactagaatcaacatcaagagagatgtgagaggacttttgagtcatcaccttgcggccttgggccatgaaacaagagtagtggtaggagtcgtcgtcgtcatcactccagttgttgaagagacgctccttgattgaagaggatgacttgaaggcgacagtagcaacaccaccttctccttcaaccttgtcttgaggcttggacttgggcttgacctcgagatcttcttcatcttcggaggaccacaccttcgccatgtgtgccttcgccacatgagcatgcttcggcttcttcttggcttccttagacttagcttcatttgacttgggacaatcggcaatgaagtggccatgttcaccacaattgaagcaagctctctttgattgcctctttcccttgtcatcatcattcctccctttgccatagccactcatgcgaagaaagtgcttgaatctcgtgacaataaaagccatctcatcatcttcactttcttcacaacatgactcttcttcttgttttgccttcaaagcaacttcttgatttttgatcatggcggcattcttcaccatttgcctcacttcacgagcttcctcttcttgcatctcatgagacacaattcttccaagaatgtcacttggggtgagactcttcaattctttcctttcccgtatcattgatacaagagtaggatttcttggaccaaatgcacggagaagtctcttgaccacaaagtgatttgtcatgtcctcactcccaagtcctttaatcttgttgacaaggatcatcatcctatcatacatctcttgtggtgtctccatgtcatccatcacaaatcttccaagccttccttccaataattcaatcttggcctcacgaacggggggtgatccctcatgagccaattgcaaagtatcccatatctccttggcctcctcaagcccatcaaccttgttgaactcctccagactcaaggcggagagaattgcattggaagcttgagcattgcggtggatgagttgttcttgctccgaagtgagctccatgttatcatggggtacatcaacatctgtacaaacaactttccaaatacttggatgcaaagagattagatgcaacttcatcttgtgcttccaagcggcattatgtgtcccatcaaattgaggagcatgcccagaaggcacggagacaaagttgtgagggggaatggtaagtttgctgtaatcaaaaggtatagtagctcccttgggtgatggagttcccttgctgctcgctccatcttcatttccattttccccgttctttccccctaagtccgacattgtggatcactcaaagcagggaaagcttgaatcaagagcaccttgctctaataccaattgaacgtgctgatgaagcctagaggggggtgaataggctgtccctgaaaacttaaaacaaaatcgcagcggtaaaattcaaacagacccggaacttcctggtaaggaactccagaacttatggcctgccaggcccggaactaccggtgttcttaggacaggaacttccgggttacagaacaaggatgaaattcaaatttcgaatcaggagaataaaacaatcatcacaagatgatgcacaggtattctaagtaggagatagatcacannnnnnnnnnnnnnnnnnnnnnnnnnnnnnnnnnnnatggattgtacttcatggcgcgc

SEQ ID NO: 51708 - DNA, 3809 bp, Oryza sativa
  unsure (1)..(3809): unsure at all n locations
agcctcttgtgtttaataattatggaggcgctttactacctcataaaagaatggctatatattataagtgtctcctcncntactaanaaaanaaaagttancctggatnactattcgcatacacccaagncgacnctagaggaaccccttagctccagtgaacacttggcgattggcatgtctgcttcttgtaaattggcgaaaatgtggaggccgattttttttccttggttagggacagtccctggagtaatgtcgtggttctttgcagttgtaacaaaccataacttttttacactcgagttctccaccttgtacttgatttcttggctgttgttgaacgtgctgatgaagcctagagggggggttaataggctgtccctgaaaacttaaaaacaaatcgcagcgttaaaattcaaacagacccggaacatcgtggtaaggaactccggaacttccggcctgccaggcccaaaacttccggtgttcttaggacaggaacttccgggttacaaaacaaggatgaaattcatatttcgaatcaggagactaagccaatcttcacaagatgatgcacaggtattctaagtagaagatagatcacagaaacattccaaaaaacatcacagaaagaaacaagagcaattcttttcctgaagttcaaatctgcgatcctactctccgttgaggagctccaaagagctgggtctcgattaacccctttgcctgacttgtgcaaaaactccagaggaaatccacagccttcaactacaaacacccctaggcaagtttctagaattgagtgaccaccaagatccaactcaaactacttctagaaattcgccacaagtatacgttgctctacttggaaaacctctagaatctcagcacaagaacttaattaacttacctcgttcccttttggaggagaggagatccttcacaaacttacccgggacatccacaatatgcaacggattctcgcgggcgacacctaaccatctaggagatcatctccaagagtaataagcaccgagatgacagcccacaagatattccaagtgctcacccaagatcctagtcttcacacatctccaaatcttcttctcttcctctcaatctctctttctcataagaattaggctctagattgagtggagaaggcaagaaacacttgggagaggctagcaacagctctaggttcaaaaagtgaaagtggaatggccaatgaacaagctggaaacgagctgtatatgtgacgtcatctagccgttactcacaaatttgaactgaaaactagacaggaagttccggacctagaagacaggaacttccggataatacttaggaaaatttctttcatcatactggaacttccggacctggaaacaggaagttccggacttgcatttttggaccaatggagcatttgcaaaaatgactcctagggaaacttgacacttggttcacactaagagcacttgagatatctcagagcatcacctagaaccccacttaatagtacggtttttcctaaaaactcgattgcaaaaaataaactatcctatgcacttctcgagttccggtccgctttgattttatacttttggggggtctccaagcatccatcttccacaccttgaactaatgcacctaaaagatactcaatgaactcattagtcccttaaccacatttgtcattaatcaccaaaacccactagggggattaatgcactttcagttgtgctggaacatccaaaggtacaacgcggatactggcctctatcttgtcaactggtggctggggctgaaattgagcattgacaccttgtggtagtgcactcattggagtgggagctattgcatcttgggctatacgactgcttcaggacgcatggatgacaattcgctgaggagcaagcttctgattgaggggagttgcatggactgatgtgctggcaaatatgtttctcggtttcgggcacatgtcggcgaaatgacccacttcttgacaattgaagcaacatatatctttccagacttggcattttcttttcccattttgattcctctgtcttggcactggagttaggctgaaactgtagtcttgtcgaggatttgggttgccttgatgcttctctccattgtaactggcgggttggttggccatcttcttcgtcagcagaaaactgaattgacaatcttttggtacatgattagttccttcacacaagaaacaagtgatcctgctcgttggacactcgtcgggtggatggtcttcctcacaaggaacgcaagtggtgacacatgagctggcaaagtgaccgatttctccacaacgagagcatgccttatgttcctttttattctgattgaaaccttggagagacttctcatcttcatcccgtgaggagacttgatctgaatcttcgctatcagacactctacctccattagccaaaagatgttctgtcaactgtggtgcacctcggaagaaatttcttctctgacgttttgtcattcctggtggaggccattctgtgccggtaatggtcatcttacggacctcatcttcggttcgcattggtgcttttcttttctgctgaggacggttccttgcatagtgcccttgttcaacacagataaaacaaatgattcttgcttcttttgagtccacaagtggcatggcacgatgggcctgttgggatgctggcggagcgctgacttgtggtgtgagtgcttggactgcctccaactgcacttgaggttgcatctgactcgggttcagaattggcgtctgatgctgctgtagtatctctataagcaatttgttctggttaatcaggtgttggaccactgccatacaactggtgtctggtgcttcattcactcgggagcttgaggtacccacgtcctgatttctgaccatactgccttttttattgtcagccatctgttactaggtttggagagggagagagggaaaacaaaaggggagagacagattagaaactaaggataggaccttaacagatctattttttttctgttatgatgtatgttaggtttattctgcaagttgattaagcaaacaatctagcatggttacatcacaccccactgatgcaaaccacgcgctacacacacaagcaaggaaacacacgactaacgactctaccctagagggtggcttaggttctgcaacaggttctccaagatcttcacccctgcttcacagctggcttcattgcttccttcgcttcgctagcggatccaacagtcttctggagcttcggcaaacgattgacgatctcttcttcttcacaaagctgaccatctagtactagttgaaattcgaagaaggaagaaggaagtaaaccttttgcaaatagcattagggaaaggaggaaaaaggaactttcgcaaatagtttcatttataaaatatgtccttacgttttatccagttggcttatcctacagtcgagatatctctgataccagcttgtcgcgcccggaaaaataccttttccataacactagtgtattaatccccgtcccaggaaaagcacatcaggcctgacaaacatgatataaaagacacatctttattatatcgataatatttacattattacaaaggcacttcaggcctgacaaacaaaaataaatagcagcggactagtgggcctatggatccatcttcacaggcgctcaactagggtataagccagggctccacctaagacttcttctccaaaggggtaccgagctcgaattcgccctataatagtgcgtttctcacccacg

SEQ ID NO: 51709 - DNA, 5175 bp, Oryza sativa
  unsure (1)..(5175): unsure at all n locations
attatggttgtgaaggccaacttttggctgaaaccccgtccttcacaaaatcaaacaagggaaccggctcccgtgccccacattgccaaaggtgcaggcggtggtgaacaccatcccgccggggaactccctgattttcatcaaactcaacatccggtgttcactcgctccaataacccacttgattgtcgcgcccggaaaaataccttttccagaacgctagtgtattaatccccgtcccaggaaaagctggggtacaccacacaaacatgatataaaagacacatctttattatatcgataatatttacattattacaaaggcacttcaggcctatggctccatcttcacaggcgctcaactggggtataagccatggctccacctaaacttcttctccaaagctttactgaagggggtgaaagatagagcaagaatgagtacaaccacagtactcagcaagtcacaccgggagatgcatgattaatgcaagggagtacaaagggtgataatataggggttaagttttgcaataaacagcatttaagagtcacttagttgcccaaagctattttataaagacaatcctagagctacacagtattattaatcaaggccctgaacccacacgaacctggcttaacccaaggcctatgatgattcagaccaaactggcaacccgacctaggtcccagctcgtcccaagccaacctaggccaaccattccacattttagttgttaagcaagttttaagaattaaaccactaacttgggtacattgctaggcttgcccataaccgagggcgcggctattcgaatagattatactctgatcagaggtgtacatctttacccacaagacacatctttactctgcattccacggccgtggaacccgtggtaaaggatgtgacataacccctttacccatcctagccgtgacaaaagcaccgacccaacctcgcctacggccggaatcccgagacaggtaggtaagattgagcccctagcagcaggacaccggccctgtgccatgacatcttgaataccgagccgcagcccgtgtagccttcatttgccctagagatgtccatcgagccccgacttcgtccatctccatccgtgtactcttgcaaggactagactgagcaccgagttaagccttacccattagacatgtggttagtacggtagtgctttgcaacagaggcccgaagaccggtccttatagtggctgaggtgctactagcagaaccatgcacctcgagcccagcctaaaaccattttgggagttttgaatagagggggggaggtgtgtgttcaattccaccacaagccaaccattccacagtgtccaaatgatatgagaactcccaaagtctaaagttataaaaccacctagtgttgcctaattaatcagcgaagcatctacctaaattcatactagtggaaccgttaatagagtacccactagttggggttttgtttatcctagggtgaacaaggtaataataacaatagcaataataataaggtcataacaaaggtaaataggcatggctaaataaaacagtgataatgcgggaatttatgtaaagcggtaatgcaataatttaaatcaaaataattttataaactgggattcaatatgctaaagggtgatgcaacttgccttgctcagagagaacggccttccaaaccttcgacgacgaccgcgaaccacactttgggaacctccggaacgacagaagctacgcgaagcacacaagcaaagctacaagcctataaagaagcaataataaaacataaaaagaaagcacagggttctttaggttataacaaacattaggagacttgaacaggtcgattcggagctcgtatgaccaagatatggtcatccgaagtttaatgctgtcacgtggagatttacgaattattgtaattaggctttgcaactataaaacatgtgtaagcgctagcctggaaaagacaggaaggctgcgccgttgacatgcggaccccacatgtcaatctaagggaccacggtggaccgggtacacagagacggtccacgggtcgaaggaagcagaccccgtgtgtcaaccgaggcgagtggccgacaaacggactccaccagacaccacgcgggctgcacacgtggaaaccacgcggctaccgagcgggcacacaaacacggtcaccacacgcacccacgaacactactgacaccggtacacgggtaccggggttgacaaccgcacaacgggcacggggcaacaccgaaaggacgaggacggggcagcgagaggaggcaccgttaccaccacccgaaaaggcgcggcacgacgacgacgaacgggcgcggcggagacggctcggggacgacagaggcaaacgacttcggcggcgatccttggacgaaggcgagacgcggccggcacgaggcttgacgacgcggagccgaggacgaagacgacaatagggctgcagcggctcgcttgacgaaccacaggcggcgaacgcgatcggcttgacggagggacgaacgccacgacgaccgggtacgatgggaggatgacgaccggaaccggtgaggaggcgatgagggcagccggcagcagctgcacggatgcgaggacggcgcggaacacgtcgctgtgatgacgacgatggttgcggcgcagcaagacgacgagcggggcgaccgacgggacatcgacgacgaggacgaacggagacgacgacgatggactgcagaggggtttgaatgaagggaaggcgatcccgaggacgatgtcgccggctcgccgctgcgatgccggaggttgtggtggcgcggccgccagcgcacgggtgaaggaagggccgaccgggaaaattccgtcgaggcggatggagaggccggcgctgcacggcggtgttccggcgaaattctgtaacatacccaaattctagaccttaaaaatttcctatcaaaatagttggaagctaacttttccatttttgagagctaaaaatttccatttttaacctaggtgtggtcaatctaacttgaacctaagtaaaatttgagaacaaattaaaactttttcatttataacctaggacataaatgcaaacacgagtaaaagcatgcatacttgcataaaacatgttttgacttgagtccttcatgtgcatttgaatatttgatttgcatttcataataggtctgatgaatattaactaagatctagataaacaactaaaccattatggcctagtgctagctagaggaagttaaaatagaaaccatacaccttaaaatatatcaacatggctaatgtcaagcctcacaaaactaatttggacatccatctgaagacatgtcatgaacatgaaagtgaacaaataaattatatcatatagggtatattctatcttaatcatctctaagcattctcttaatttaatactaaagtaaacttatgcataaataagtaaggagcttatgacatgtgtaaggtaaactgtaattctatcatatcaatatcacctcaggttaatgagagtccaaatataacttttataaacatttacatgcatttaggaaagggaaacacatataagacataagtcttgcgaattatctaaaataattcgtgcaagataaaatcatgggaaaattcctgtaggctctactcaactcatacaactcactgtaattttggtataatttaataactaaatttggtacctcaaataaatcagtcaaactaataaaaactagattaaccgtagttcttaatcggctaaaaccatactttatctaaaagtgcatttaactgcataaaagtgtataagtaaaataatttattcaaatactaggtcatttatcatgaataaaaataatttttccagaatttatcttctctgtttaaattactaaagtgggagagagaaataatcctgaaaatcattcaaaacttttgttcacccacgtttctgcccaaccctctcaccctagcttagtttgccacgacctggacccacttggcagccactctggctcgtcctcaccttgtgcaaatcttccagccgaccagagacagccgagagagagagagagattggcgccggctgtgtacgacgcgtggccacaatgtgtcgacgccatcaaactcctattctagccttctcctcctcccagctgcatctccacacatcattctccacctctaagccgaagaaaccgagggaggaggctctcaacttctccgtcgccctcatccttgctgccggccgcgaagaagacgactatcgtacttgtaaataagccagggtaatccccatctctttcgcgttccatactcttctcaccatgccgatgatttatccttttaatttcatcctctatcgtgcagcggatcgacgggaacgccgtcgtgcccacggcactccggagcgcgctccaagcgccaacgcagccgacatcgtcgtcgttccgaccattgtagaccaaacaaagccgagccgtcgcgccaacgtcttctccttgaagtcttcctcaaaaaccctcaaaaatcctaggcaatggcgcagcaagtgcggagatcggctaccgtcttcttcacctccggtcgccgtcgccattgtcgattccgccacctccggtgagccattgaccgattcttcgcgtatacaccatccctgggacctcactaaccccatgaaaacacatggatgtcaattcgatgagtggatcgagccgttgccgtctccccggagctctacaccgtcgccggaccatcttcttcaccgctgccgctgtccagactttcccgcgcctcgttcaaggttcggtgagcacacttgagcccataggattgcattcatgcatttcattcacttagaatcgagcaccaactcaacatgcagtagcagcctaagcacagccgccgctcggactcgccgccggcgttactccgatgtccactgaccgagaaaagtagaggaatggaatcacaatagcatgatcgtcattttgtcttttggtcgcaccctcaaccgagccaccgtttgccgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51710 - DNA, 828 bp, Oryza sativa
  unsure (1)..(828): unsure at all n locations
aggaacaaaggcgaaaagggaaacgggaaaagccatcccggaacggcggatgaggcaacggaaaggaaaagggcaatggacacccccaccccacccnnccggggatgatggccaccccagcaccagccngcggnngacncnagaggagccccaggagcaaaacagcggagcaacnaaccagaaaccnnaaccaacacggaacagcacacccaggccgcacaggcccgaccaaccagaacaaccaaacccggcgggacagaacaaacnccaaaccaggagcgaagcaaaacagcaccagaaacaacaaccacaaacaccgagagaggcgngagaccaaccacgaaaaacaacgcgcaacccgcccaaaaccgcgggcacgggcaaacgaaaaaacaaacccgggccagaggggaaccaccggacccacaagacacagcccccccaaaaggacgaccaggcggcgcgaaaccggaaaggacccgaaaagaggcggggacaaaacccggagcacaacacaacncaccacagggcaccangccgggaacaaaaacaccccccccagaaacaaaaccagaggcagggaccccccagcgacccccacggaccgcncgccgcgacncagaccggagccccgcaaagaaacacgccanacagaagggaaagccgncgcccaagccggcnagaggcaggaaccggaaaagaaccacaacagaagcacgagaaccggncccaaagcggcaagagcacgacccacaaaaccaggngcccacaacccaacaggggcagggnggaggaagcaaagaagagcacaacacgagnaaccagcgc

SEQ ID NO: 51711 - DNA, 3001 bp, Oryza sativa
aataattgtttgtcttttgctgggaatgttttgtttgccagatttttaaataatcattgcagttaattgaagacattgttttgcttgcttaatgtgatatttagacatgagccaaatacccgtgcattgtacaaatctagcataaatatatgatttcaaattgaatagttcacacttaattctaatacaaacgacggtgcaaatgatcaagttatgcagagaagattgttcagataaaagaaaaatgaacacagttatgcatagtatggtggtggtgcaaactcatttccatcactgctagcttcttttacaatatactagtaaatatcaccctgtagttttggttcgttacatgttcttatggtctcaatatgacaaatgcttagccaatagccacttaggtagttggtgttgttctccatttgttccacaatctaaattacaaaaagtttcttgtctggtgtttatgctccttttcttttggcttcaaacttatgtacttgagtgctcaaattcgtgttgtgttgggttgcaatctaattctggagaatatgcgtctggtgtggcattgtactgaacaggaagggtcctgttcccatctgagttaacatcctgtgttcgcatacatctcttccttctaatgcatggaattataagcatacatcctgttttcaattctttgaaccatatagtttggtgatggtggatatcttgaatatggtatagtttggcataaaaaaaaacacagtaaggtacctacatatgtttttccaagcgattgacaatattgtggctgcgagtggcagatgtagatccaactatcagaatgaacaatgcaaccacaaccttataatagggaaatactgaaacagacatcatgacatgtttcttatgccttgcatgaatttttttttggttagtttatatgtgatgtagtagatcagccaccaggaagaaatttatcatagtaatttactataatttcattattgtgaatttatatgtttgtcatggtttgctttgtagaatgtgaattcggttaatatgattgttgtaattttagtaagtcacgtatgagttaatattcattgttattagctggtatggtttgtgcaccattagtgtgttcttgcttgtttctgattcatggacctcacatggaggaagtcttcgcaagcctgcaactgtacccctattgccttggccccttctagttcagtttaatttttgcatgtcatctcttattgaaagaaggaaaaattgtaaatatactttgcatttgtccacttaggttgaagaatcttgtttggcttatgtctcttattgaaagaaggaaaatgtaccatttttctaggttgataaagctgcgttgttagcattctctactatagggttattgttgttttcacaaagttcatgttgttcttccattgtcatatcacttgaatcatatttcagtgtttgtcttctttcatgttccctctatctgctgaacattatttcattgcaggtctgatgctaccaaagagactgctgcagcaaactaatctatgccggtacttgcgaacccaaggattgcagatctcttctgctaaatagcctttctattatttttttgctacttgtgtgctacagttgtaacactgagtcaattttgcgtccatgtttcttatcttttcttaacacctggtaatcgtgatttatggtattgagaattttgatctggaacttaggtcttaatcatagtgggtagaagctattcattctattgtgactgctagccgtcatgctatgtcgacatggtgataatgtctcgaagaaagaaatagtgcttctttaaccttgttagctgtagaaatgtggagtagcatttgtttagaattttgcatttacaatgcggctgaggtttgcgccaacaagtgtgaccgcacctatgatttctgcgcttccttgaatcacggggaacgcttggctgaagtcctgttcgcgaaaagaattttttgtcacatctgatctttgaccgaatatctaagatatcagaaggggtttttggacacgaataaaaaaaattaatctcataactcgtatggaaaccgcgagacgaatttatgttttagcctaattaagctgtcataagcacttgtgtgttactatagtatttatggctaatcatggactaattaggtttgaaagatttgtctcgtgatttccatacaaactgtgcaattaatttttatttttatctatatttaatgcttcaagcatgtatcaaagattcgatacgatgtttttgagaaaaaaaaatttatggctaatcatggactaattaggtttgaaagatttgtctcgtgattttcatataaactgtgcagttaatttttatttttatctatatttaatgtttcaagcatgtatcaaagattcgattagatgtttttgattcgatacgatgtttttgagaaaaaaaaatttagtaactaaactaggcctcatttcgatgcctatggctatgtggcctgtttgacatgcatagccggtccaatgaatcactgcgaacgttcggctcatttggcttgttggaataaactagataaaacagccccctacgtatgtctgtaacatttgataaagcagccccctacgcatgtctgtaaaaaaaaaagttaagtggggtttcatgcggccttccatgatccactagtcgttctcatgctagattagcccctttgtttgacattcatatggattttacaatctgttgggaatgcataattttttattcaacgaagaccttcagttataccatcatttggctcgtacgttaaaccgatgctagcctagtgtctagggtcctccagtgtggtttgtaatatgagataccaaacctagtttgatgaacatctgcatgtgtctcttcatgatactcaaagtgacacatgcagatgtcctcgggggatcctctagagtcgacgtgctggcgtattgtatggtcatacaactt

SEQ ID NO: 51712 - DNA, 5269 bp, Oryza sativa
  unsure (1)..(5269): unsure at all n locations
ctggcgcnattgatttgctangtagatacanctcggcacccancaagacttataatatgaaacggagaaagtaatcaaaaagcttctcctggtggagttgattgattgatgcctatttagatttcctccagtattctcaacgcagattccgcatagatgcgttgtctgaaaattgaaaaccacattacaggagcataaagttaaaacaaaatttagccaaaatttatagaattggagggagatagggaatgaaaggtttttctttcttggcgtacttctcttgggtgtgtctagggccagccggccagggcgattgtgtttcatgtatccatcccatggaaccttcttaaggccaacctgagcagcgatcatatccctcaccccatcaaagtattggaaaatgatgtgagcaattgtatattttattcatttattttaaatgaagagccaattcaattgcggtctctcctggcataatttgctgagggtccaagaaccaaacatcacacacaacaccccatgatgtcataagtcgaaacaattcaactgcaaaagaatgtctgacaaagcgttggatgtttagtttatacttcgtactcaaataaccaagacggccaaattaagcagatctgcacaattattttttgcatttcctcacttcttactgtcccaaaaagtgtcagtaaactctttgttgtatttgatagctattgggcatacaatgcagccaagctcaaaagcagcctgaaaaatcacagtgcagacaaatatgcaagccgtggttagtctggcaagaaagatgaccaaatatatcttatggaagaggatggctgattctattcgaccgtcttgtgtatgctttctggggtacccgatatacactgccagattgctactaccatatttggttactgctcaaaaagagtttaacgcgggtactctgatacagttttgtttgaagaaattgagtcttgaattttgtcttgtagaaactctgtacaacttaacaatttgaaatatcatttgtatgggcatatcacatatccatatatgattttttttcaacaaaaaggaaatgcttaccttcttgaacatgactgtataccgattgttaacgcaagttccttctgggaatatcataagaggattgttgtctggaagttggacatgctcttgtaggttgtagcctggtaatgaaatttcttcgagtaaaagtaagattaccaaatataggattgctaaggatagcatttcttacttttcttccaccatgttgaagcagaaggagcggctgcttgtccttggcgttggcgcgggtgtgtggttgggtgatgacgatctgctagccattgtcaataataacgaaattagggccctcctgtgtgtctcctggtagaaggcatcccatgcgcaccacctgaagtagtcaacaatgcagggaacttcttgttagagtggagccagaaggtcttaaggtaggacttggatatgacaactttgccggtgatggcggtgaaggggtcgaactccacggtgtcgatgacgagcacgtggtcgaaagatgtggtgtgcgtgtccgcgccgccccagcgccgctattaacacagagctggagcgtgccagcgctctgaaagctagatcagaacgtgccctcgtttagcaggaggaaaacgacatacgcgtcaccgccaccaccatccattaaattcgcaccttggaggagaatttgaaagacttgggccctcttcactgcaagctctccacgtggtgtgctaaatttggattgtcgcacccgaatgcttgccctttgtgcgattaagatggggagacaatgcaacacatcttcatatcttatcttgtgtctctgccggtcaagtatggttctctagtcctagaaaatatcagattgacgatggcagcacctcaactttaggcaacctgtttttttagtgggtgatccaaggtagtcgagcattatactaaggagacaaagaaatgattaagttccttaatcagcctagtggcacaagaaatttaaaagtactggaataattgtgtgttcattaatatcacaccaacggcacagttgtcttgcaagcattagcaatagagtgttcgtattggctgatgccacataggtcgctttcttttgatggttagctgctcatgggaggtttttgtgtgtcacgtgttttttaatgtctttttcctagagagttccttttttgtggaccactctattgtacaaatttctgcttcttgaagcacaagcctctcgcattttcttgaaagaaaaaagaaatgttctagggtaggactagtgatccttgtattgtaaaagcataaaggaccgatgcaaacgacgacccccaatacagtcctatggaagaggcagtacaccatcatgcgcgccacattttgcagcaacatttgaatccgatcttccaatgcaaccatatagatcgatggcaatacacattgccagtatatcacgaagatccctcgtgcttcaaagtaaaaaaagatagatatatactggtttaccgcaccatatcttggtttcatttaacaatgacctatttattcttcattcagatccaacatgcaacccgcatgttgaactatagtaaataaacgcatatgagaaacaaaacagtattttgtcctgagccactaaaattcttggcaacatttgctacagtacatttaaagtttgtggcctttgcggtgagacacctagagaacgtgtatcttctcgtggacactgtaaaaaatatggtaatcagctgctggacacccgcctcattattttattatttttggtggaaacggagagagaaacaatggttaaagataagtttgcccatgggcccacttgtcaatcacacatctggctttctacgttcctcttcttgctgctgggccgactcgccgcgtggacggaggacaaagaacgacgtgcccacgaggagggtgagggcattgtctctcgcggtggcgtcgggcaaccgactgcgtcgactggccttgaaggtgagggccccccatgggccgacagtgggacggatagagatgatcgggaggctcgactggcggaagatggcagcagcggcatgcgtcgggtcccccgtgggccgacagtgggacggatagagatgatcgggaggctcgactggcgaaagatggcagcagagcggcatgcgggaggctcgactggcgaaagatggcagcagcggcatgcgtcgatggtgggacagacggagtcgaccgggaggctcaattagcagaaggcggcagcagcagcatcctggggagggctcgaagcgacaaggggcatccacccctaggcacggagctctaggctggcatcgacggagtcagggtgtcggtggagacgaccctagggcgcgaaggacggtgattgcggcgggcagaggtggtgtactgctgatcgatggcagtggcagtgaggcgccgctagccttgacgtggtactcacgacggcatccaccgagaggctggccagtgacgaggagtccaagacacacggtgtggagggccacccgacaaggagggtgagggtgctgcttctcccgccgcctctctgccggtcgccgccccacccatcgtctaccccctccgccgcccactgttgcgctcacttgccaccactcggtcctctattgccagcagcctcccaagctcgctaagaaaagagaaggaaaagagaatataagcaggaagaatagtgtccaggggcatttcagtactttcaacactctttctctattttcaccaaaaataataaaataatacatcgagagtcctacaggtaattaccacattttttaatgttcacaagaagatatacgttttttagtgtctcacagcaaaggctacaaaatttaagtgtcctgtagcaaaatttgccaaaaatctttggataaaataaggtaccgacatcacagtacaataaaaaaaaataccgattctacagcaaactgtactgcgctatcaatccgaatcctgatacagccacacataacaagagaaaaatcttattacaattgcaggaaaacgagttaggcagagagattatcaaagaacttcatgtagtcatcaaatgactctccacgccgaatcttagcaatggacccatcatcttctacctgcattacaaataacagggcatattggatgggaaccaacaattataaacattgcataaagggagcattttgaaaacctatcaacaaatgatttcggatgaaaaatatataggtcagtttgtacccaatattcaggtggtcgcaacttcaagttgtaggttgaagccatgctcatgcagtaggctcctgcgtcatgaaccaccaaaccagctccctacaagcgcaatatgtttgtagggtaccaacaaggatatcaaaaagaaaacacaagatatggtcaaaccttatcaggtgttggaagttccctgtctttgccaaggaaatctgcagattcacaaactggtccaacaatatcgaatgttgctacttctgcatctggggaaggagaaaccagttcgatatgctgcaccatgtggatagagatgacaggtaaataacatgataaaacaacatagtacgaaataactgaatgtatatttcatgtttattttgaacatttgttggaaaaactgtatgcaagaaaaaaattgttggaaagatgttatttatatataggtcagatggagatgtaaagatcagagctaaacctgagaccaacgttacaatcatcatatatttatgaatggtgagcatcttatccaaacgaactcagctattatgaacaatggacaaaaccaacactctgcttgcaaccactatcagttgtatcactaaacaaacctggtatgctccatatagacttggtctgataagctctgccatgctgccatcaactacaatgaaattctttgtaccattagatttaacaccagtgaccctattgacgaagcagcaagtgttagctatgagggatctcccaggttcaatgatgagtgtaagatctcgtgacagaactaattctcgcacctacaaaaaatcacaggggcacatataagaatcacgccatatgccaaattttaacagtgcaaaaatccaaagtaggaagtgatctatttaaataaataatgtgcctacgaagnnnnnnnnnnnnnnnnnnnnnnnnnnnnnnnnnnnnnnnnnnnnnnnnnnnnnnnnnnnnnnnnnngtcaatcaatcgcgcg

SEQ ID NO: 51713 - DNA, 1433 bp, Oryza sativa
  unsure (1)..(1433): unsure at all n locations
ctggtctgaagaaaaaaaagttatttagcgaataagcataagcccacatctttacaaggggcttgtccctggaataacaagaaacaaacacattaagtttgatgaagtttcaaagtcagcataataagtctttttgaatggacacactgctgcacagaaatagtatacacacaagaaaggaattatccctttctcctaatttcttcagtaagctttattcacataagctgcaagttcacaagcaatggagaatgggagaggagagaagagaagagcacgggttctttgatgctgtccatacccggtgctgcatccctgatttccattccccgaactgatcattatactacttgtcaagagaaaaacattacagcgtccaaaacacgaacacgatgctttccatcaccgttgctccacatccactgaaacaaaatcacgtcggacatgctcaccgatgtctcacccgatatcacatgcgagagccctcttctaagttaataagtcttccaattttaaatatttgtgatgaaccttagttcgttatgggataaacattacaaggtggacggctggaaatggatagactagagactatcagctgtacttaattctttaataatcaaccaatagtcagagattttaaaatttcagaggacttcatttagtcccagctgtactattgatttacaaggtggcacttagtttatctcagaggactgggactcagataaattcagctgtacttgcttgttaataatcaatcaatagtttcctgactatatagtgagcctcataacaaccattgttacattatgatgcaccgatacaacagaaaacagcatattcctgtacacagatatgtatccgagacaggagtacgcagtcaatacagtattgcagaaatattgatcatataatggcgaaccaaatcaaacttattagcaatgcttcctcgattcaaattagatgctcagatatgcagtcaagccaaccctcattcgaaagcccacagatggtagtctaacccaagaccactaacctttgttcgcacttgtgtgcgactgtgagtgctgttcccctcattctccacttccattatagcatcaccctgcttacatcaccttcagtgagcaacctgctcgcttcaactacaccatgtgtgcaggaggcttttctatgacaattgaaagttaacaaattggaaagatgtgtcttgatttaaatgtttcttatcaaacttaaaatgttttggataaaaaaaaaacttagggtgtgttcgttagtttggggttgggaacccatctccccacacggaaaacagaacagtccattagcgcgtgattaattaagtattnnnnnnnnnnnnnnnnnnnnnnnnnnnnnnnnnnnnnnnnnnnnnnnnnnnnnnnnnnnnnnnnnngggagtcaatggg

SEQ ID NO: 51714 - DNA, 4467 bp, Oryza sativa
  unsure (1)..(4467): unsure at all n locations
cgctcagggggtcccctttggctcggtctggttttatcaaaggtcccggttggagttgatctagttcgggggtcgatggccatcttttgggcaatgggggctccacgatctgcggcccgggtagtcgggatgtcttggcacaggcccggtgtcctgtttttaggggctcagtcctgcctacctgtcttgggggttccgcccgtaggtggggttgggtcggtcttcttgtttttggttaggatgggttggaaattatgtcacgtcttccgtccgtataccgtggtggtatgtggcacgtggttccatctaaggagaatatgtcttgtgggtaaagatgtacacctctgatcagagtataatctatttgaatagccgtgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcatggccttgattaataatattgtttagctctagaatcgtgtatacaaaatagctttgagcaactaagtgtcttttaatgctgtttactgcaaaccctaaccctttatattttaacccccttgtactcccttgcatttattctgcacttgtgggtgtgtcttgttgggtacggtggttgtactcagtcttgctcaattttgcccaaacccagaagaggagcccctggaagatgaaggctttggtgtctagctcgtgcctgccgtcaagcgcctgtggtcatcgccctagtcttccgctgtttttcgtttgtcttcttgtgtgctgggtcttcgccgcccatgtaataaattaattaattacgcttccgcttgttaaactctgaattgtatcaacttttggtgtaccttgcctcctgggacaagaaataatgcacgcacgtaaggaacgcccgttgggttatttccggtcgtgacaattgggcacattggtgaaatatggatgcgtgaagacatatcattcaaaagatgccctttacaagaccatcaccgctcatcctaacaaggatggacatgggctcgggttttctggtggaagtcatgtgtctaagcgtgtgatggtaaatgggaaagaatgcttgatgtttgtgagagaaggaaaagctccacaagcaagtgaggtgacttgtcccctcactggttagacaccgggaagttcgagcaaaatgaccggaagttcctgccctgtaagacaggaagttccggacattttgtcaggaagttccgggcttctgataggccgaacggactaaccggaagttccgggtataatggcaggaagttctggctagagggtctttactatgattcatatgtaattttcaaaaattcagagggcaaagtggttgcttatttcaatgggaattacaatgatgagtaccgtacttgtgtgtgggtgccaaaggctttggtgactaacatcaagggacccaaacttagacaagtttgggttcctaaatcccaagcttgatttcttttgtaggcatactcctccagtggctcaagttgggttgtggacagtggctgcaccaatcatatgatgggagagaggagtatgtttacaagtcttaatgaggagggtggaagtcgtgaaaatattgtctttggacatgatggtaaaggaaaggtaatgggtctcgatcgtgtgtgtagtgcttgccaagccgggaagcaagttggcagtccacatcctataaaaaacatcatgactacaacaagaccactcgagcttcttcatgtggatttatttgggcccgtggcctacataagcattggaggtaacaagtatggtttcgtcattgttgatgatttttcacgcttcacttgggtgtactttctccatgacaaaagagaagctcaagatgtcttcaagcgcttcgcaaagcaagcccaaaacctctatgatctcactatcaagagggtgcgaagtgacaatggaggagaattcaagaacactcaagtggaggaatttcttgatgaagaaggaatcaagcacgagttctccgccccctatgatcctccccaaaacggcattgttgagaggaagaaccgaacccttattgaagccgcaagggcaatgcttgatgagtacaagacttcggatgtcttttgggcggaggccgtaagtaccacatgtcatgccatcaaccgcttgtacctccacaagatcctaaaaaaaacttcatatgagctcttgagtggtaagaagcctaatgtttcatattttcgtgtcattgggagcaaatgttttattttaagtaagaggcctcgctcatctaagttctcacctaaggtggatgagggattcttacttggctatgaatcaaatgcacatgcctatcgtgtcttcaacaaaacctccggtattgttgaagtcactagggatgtgacatttgatgaatctaatggctcccaaggagcgtaagttgttgtacatgttgtaggtgatgtggatccaagtaaagctataggcactaaggctattggagacatacgaccagtcgagacgcaggatgaccaacaagatagggatcaaccttcgtcatcgacatccaatagccctacaagtgctgtctttgctgagctgaaagttccgggtcctattgatcagaacctccggaagttccgggttctacagtctggaacctccggaccagtggcagtgaaaacgtgccaacggcacaagtggatgggatcgatgctgcgggcactttagagcatactgatcaggctcaggtcccccagtgcaccatccaaggatacatcacactgtccaaagagatcatcccgtcgacaacatacttggtgacataagaaaaggggtaactactcgctctcgtgtcccaagtttttgtcaacacttctcgtttgtctcttctttggaaccaaccagggtggaagatgcgcttggtgatccggattgggtgatggccatgcaaggggagttaaataacttcactcgcaaccaagtatggactttggtggagagacccaagcaaaatgtcatcggcaccaagtggatcattcgcaacaagaaagatgaacatgaggtggttgtaaggaacaaagcccggttagttgcgcaagggttcacccaagtcgagggccacgatgttggtgaaaccttcgcacctgtcgctcgccttgagccaattagaattcttttagcctatgccgctcaccatgatttcaggttattccaaatggatgtcaagagtgcctttctcaatggacctatctctgagttggtctatgtggagcaaccaccggggttcgaggatccaaagttgccaaaccatttgtacaagctccacaaggcgctctacgggcttaatcaagcccctagagcttggtatgaatgtctccgagattttcttttgaagaatggttttaaaattggaaaggcggacactactctcttcactaaaaaatataagagtgatttattcatatgccaaatttaagtcgatgacataatatttggttctactaatgcctctttttgtgaagaatttagtagtatcatgactaaaaggttcgagatgtctatgatgggcgagttgaccttcttcctcgggctacaagtgaagcaagcacaagagggcaccttcatctctcaaaccaagtatgtgaaagacatactcaagaagtttgggatggaggatgccaaacctatcaagacgcccatgcctactaatggccacctagaccacaacgataatggtaaatgtgtggaccaaaaggtatatcgctccatgataggatctttgctttacttatgtgcatctcgtcccgtgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttcttttactgaaggggggagaaagatagagcaagaatgagtacaaccacaggtctcagcaagccacaccggcagatgcacgactaatgcaagggggtacaaggggtaatgatatatgggttaagttatgccgaaaacacgctttaaaagtcacttaatttgccaaagccatattataagaccgatcttgagctacacagtttattaataaaggcgtgaaccctacgaccttgcttaacccaggcttcattgtcacaccgactggnaacccaccttggtccaaattgtccaagt

SEQ ID NO: 51715 - DNA, 1491 bp, Oryza sativa
  unsure (1)..(1491): unsure at all n locations
aagtttagtgctgtaatatgaaatttgcgaatattataattaactttccaacaataaacattgtggagccctaacctgaaaanacaggaagtctgccttgtgacatccgaaccgaccatgtcaacttaaaggaccccggtagtccaggtacccagagacggtccccgggtcgacgtaagcgacccccgtgtgtcaccgagggcgagtagccgacaaacggactccactagacaccacgcgggctgcacacgttgaaaccactcggctaccgagcgatcacactaacacggacactacacggttaccacccgcacacgtgaacgactaccgacaccgggacacgggttccggggttgacgaccgcacatcgggtacggggcgacaccaaaaggacgaggacggggcagcgagaggacggattcttaccaccacgcgacgaggcgtgggaacgacaacgacgaacgggcgcggtggacgccaagggaacgacttcggcagcgatcctgggacgaaggcgagacacggccggcacgaggcttgacgacgcggaggcgaggacgaagacgacgacggggctgctgcacacttgacgaaacgcgggcggcagacgagaacggctttgacggagggacgaacgccacaacgaccgggaacgacgagaggacgacgacgacgacgaccggggccagcgaggagacgacgagggcagccggcagcggctgcacgaaggcgaggatggcgtggaacacaccgctgcgatgccgacgacggaggcggcgccgcgagacggcgagccggcgaggatgaacggtgaagacgacgacggacaccgncggtgttcggtcggagggaaggcgaggccgaggacgacgtcgcggctgcgatgccgaagatggtagaggtgcagcaagccgacgagccggggaggtgaaaggggcggccgaaaggacactggcgatgaagaggatggagaggccggcgctgcgacggcgttccggcgaaaccgaggagcagccggggtggagggcgatgcggcgacgccgagggaggggacggcagcgccggctgatgcacgggcgcggtggaaggggctgccggaggagacgtcgacgaggaggaaggagaggccggcgcgggcgatctcggctccatcaatgacgccggcgaagtttgcgggaggatttccaaacgaatccgagagagagagcgagagggaaaagtgggggggaaagagggagggaatcacggggagtgatttctgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaatttgggtaccgagctcgaattcgcgcatagtagacgagtcccacgcgcg

SEQ ID NO: 51716 - DNA, 12850 bp, Oryza sativa
  unsure (1)..(12850): unsure at all n locations
aagaagatgacannctactcgcaancaccaagatggatcattaagtacacacggaacacgcgaggaaataggtagtcccataatcccatgtactcctaattagcaaaacgtgcaattttagttgcaaagagtaaaacatttgtaaattagcaaggagggctaccggtttgaggaagaactggggagtgaagctcattagctgcaaacttgagggggatcaatcaataaaacatcacgcaccaacagaaaagagaaggtgagaatttcccccatactaccaccacaaccacatcctctagtaaattaaacttaaaacaatccatcaccactgtgtagtttttccctagcaccttagttcagcttttaatagaaaagaaggagcggtagcaggctagcagcagataaaatggaggaggaaagaataggagcacttacctaggggatgattgctcggtgaagtcgagctccatggggcgctggtcatggcgtctgggtctagagctccatgcgtgaccctattctagccatgggggggtccacttcttggagctgtgggttggagagcatagagagaaggattaagaggggaggtcttgctggtagcctgggcattgaggtcgccgagagcaacatggtggtagcagcagcagtactagagtagtagagtgaggatttgagggaaaagatatccactgctaatggcaaatggaggaaggaagaaggggattagctagctgatgcttttacctgcaggagtgataagaggggagagacggggagaggtttctgcaggtgagagaatagagaagaaaggaaaatgtggactgattgctagatgtacattagtaggctacacagaacaccaacctgagcatagtgacccaattctgtagtccaagtatagtttgataaattatctagcacatcacaactggagtttcggtacaataaaaaggttacaaatttgtaagcacatttgtatttgtaaattattgtatttctattagtatagtttaattaaatctcgacgcatttgacggaatacaacaagggaactagaggcggagtctggtcagttgggagcgccagctatttttgatttgaactacgagaattcaggcaagcgaacctttgatcttgatgatttgaattattttgcataaaccttattttgcttcatgaaactgtcaccttgcataaaatagatttaccaaactataagtcggatatataaggatgatgatagatactgggaggggcagttgatggagaaactgatcaccttcggaccttccaacacttattagggtgtccacagatggggattgactggaaacgggaccctttacatatggctataatataaggactaaaatcactctcacatgcatatgtgtgctgtataaaaatcatgtcaaccatatccttgttgcaaggcgagcaacgctttgtatcttatcaagttcttacactccgcatggtgtgtaatgatagatagtgctaagatgggagaccctataaaccccatagaacattagtacttggatgggagatgatataaaccccatcaagatagtagcacgtggtggagtggagtgtaatgtgctgaaataagagaagagcatctagctatctattagtccattaaattttctataaacgcttctaaaccgccacgtggcgctcctacaaatgttcttatatcgccacgtggcaggtggacccaatattttataaatcattaaattatactaattttcaccactacatcttatctccaagaatgaaaatatgtacacgctccactttctgttcgcatattcatcacgtaatatatttgaaaagaaaaatagaacgtgcacatatatgtacgtactctccctccctccctgtctgaccctcttcccttccgtctcttctctctcctaatttctacctctaacaaccatacattataaaaattaattatatattaaacttcctacaaacgcttttaaaccgccacgtagcgctcctacaaacgctcctatatcgccacgtggtaggtggacctaatattttataaaccattaaattatactaattttcaccattacatcttatctccaagaaagaaaatatgtacacgctccactttccgttcgcatattcatcacgtaatatatttgaaaagaaaaatagaacgtgcacatatatgtacgtactctccctccctccctctctgacctccacccttccgtctcttctctctcctattttctacctctaacaaccatacatagtataaaaattaattagttagctaaataatctattagtacatatgtttttatataaaaattataatatatatacccttaattttcggtgacaaacccagaaaaaaatattgggacatcacttggatatataccctttcttttcaatgtcaaaccaagaaaaatattattatgacactgcacatataaattatttaattattaattgatattattaattaatatggcatgaattagttaaaatcgaataatctaccttgaaggtgaatgtagttacgccactatatattttgtatagcaaccaaatagcaataagatattatagaaatgaacatatattttgacatctggaaccattcgacaaacatgaaccatgaataaattttcatataaaagaataatttatctagcggccacaaagaaacattaaagagtaaattgcatcgtcggtacacgaacttgtcaggtgggtgcaatatagtgcacaaacttgtaaaatgttcgttttggtgcatgaacttgcgtggtgcgtgcgggagaagtcaaaaaggacactatatgactaatcctattgatttaggggctgattaggatgctatgtaaacatatatatatatatatatatatatatgagaaggttgccactagacttacacctattcaataaaatatagaataggatttagtgatagtagaaaaagatttaaaatatcgagcactgatataagggttagaaacatataaaattcatcatttcaatgatgaaggataaagtagagactaaatttataaatattgcatgtcctatgcatacttgctacaggtatacacgtcgcatcctaatcaacgtcaacttcataaaattgacattgccaagttattttggtcctcattcgcacgaaccagacaagttcgtgtactgaaacgagcattttataagtttatatactaaattgcacccacctaacaagtttgtgtaccaccaatgcaatttactcaacattaaaataaatgaacatgtattatgtaatcttaaatcagtgattccacaaaatttcatagcgaaattagatcgacggtattaggataagaatttataaactcactggctaaaggagtaatttatctagggaccacactattacactttgcatataatccaaattaccgtacaaaattgtaaaacaatttaacaatatatgttgcttcatcatacattaattactttgtaagcacgcatagaaaaattggatatataatatgtaggtgaaaaagaactaacttaactttgactaacataacaattatgaaaaaaatattttacctttagtcagatgcaacaatatccaaataattatgtcttttgaaatatgcacaattgataagacaaattaaatcagttgatcctttacataagcgctctaaaatataatatatggtgccatttaatggacttacaggtccttttaacaaccagatgaatattgctttggcttccataccttctatatataaagataattttgtctattttatatgcgtaggctattgaaaatgtgaatactcctataataagtagtagtagagaagaagaagttatgtttgttattcgtacacatgcataaccaactttaaaatccatttagattttataacatacttattataaacacgctatactgacaactcagacaaaattgcagccatggaacacatataatgattaacttatttcgattttctatgtaccaagaaaaatcaaggtatatcaaatgttagcaaactatgatacgcatatatttatatgtattgtttcacatagggaatatcaataatctatgtaccatgataattttaagccactttgtcagttctacatattggcaataagaaaaaggtggtgtacgagatcgaaagtggataggtagaaagcaaaaggtttagacaagttcagaccctcttgacaaagaggtaatacccctactcctgtttcggcgattgaattcgtcgagtgttgtattgatctaacgatcttggctgtggttatgccttcaaaacaccccgtgtccttgtataggttggtgcaaggttagaagggtagaaacctaaccgaatccggcatcggtttccttatatattacataaccgtatatgagtaagacttatgagacttgccgtaggaaacaaggcaataataaatccccagtcctaattattacataattcctagactcgacccacctcctatcttcaatcgaatatccaagcgagtgggtatgtggtatccataatatccacacacttatccattatttttcattacactattacataaatgtttttttacatatgcggctaaaatgttaagccgcttgtattgatgccttagctgcctcaacctcagtggccacttttgcaaataacatttgtagtttacacgggtggagaaacctttattagttccggatggtaacccccttagtcccggttctcaaaccggaactaccaatccgggactaaagatcgctatcattagtcctgggtggaataaccgggactaaagatcgatctttagttaccggtaccaaccgagactaaagatcgatctacctttttttttatttgcatggccctgttgctgcatggtttatatatatatatatatgtgtgtgtgtgtgtgtgtgtgtgtgtacacatatgtatatatatatatacatgtatatatatacatgtatatataaatgtatgtatatatatatatatattacatatatacatgaataatatatatatgtatttatacatatttatatgtatgcaaatgcatatggatatgtgtacaaaatagacatatatgtatatattaaagcacttaacattttatgtgcatatatgaccaaaatatatatttacagtaaagtaaatgtgtacatatataaatatagacatgtattacaattcattatgtcctagctacgacttcgacgtagtcgttatctcagaagataacgtcttatgaattgtagatttgtcgtagtagaattcaccctcgggattaaggacttgttctttgatgaatcccatgagttgttcttgaaccgccgtgataaagtccttgtgtgtgaggttgtccctcatgtgaataacctatgaatgtatgaagttatattaattagtaaacaagaaatcgatacgtatgcaatgaaattttgaatggtttatttatacgtacatcgagctctcttgtggtgatgatttgagttgcaaagcagtggcaatactcacatacgtagtagccacacaagttagttccctcttcctgctttgcacactatatacatgacaaacgacgagagatttaatatacacttatatttgaattagagattcaatataaatttagatcatgtactcactggaaatttgaacctctggctaagtttttctttccaagtgccgcggaccaaatgacagaaccgataccaagccctacatggagtttaaagctacgatttgtactagcaatagcaaaattcataataataacactggaacatatgacattacctatctataagttcaaaaacctggtcaaaagtagactcatctttattcattgagtcatagacattaactctgcatgcctccaagtcgaagagtaaaaggacccagtggaatatgcaatttgtgttagatgatatatgaaacactgtacatgtatatgtacgggaatgaaatttgttcggtagacaataaaaactaacgctgtgttgtacggcagtagtatgaacgtcttgaaatgctgctccttgaggagatggacgagattttcctcagtggcctgtggatacttggtgaccatttcgacgtttacattccgagggtcgatgaatccagtatcgaaaaccccccgccgtcgggcccattgaatctccattttacaacaataaaggaattgttatttatggtgtacatatatacaaggagctaattaaaggaacgtaagaaatataactctcaacgatacgtacaaaatccatgcgctcagaagagagacgtcgacgacgtctagctggtatagttcgtagatatccttaaaattgatccagagaacatcttctccttgtaagaagtcggcgttcttgatcctcgctccgataatctccctaccgctggtgctcatctctatgtaccgttcatggaattggtacgtctgtgtcggtagggactgtagctgctcaggtgatgaggacacaactaagcttggatataaccatgactaccttatgtattaatcaaccaaaggtgcatatgctctacattagatttacttgttatatatttgaacaaacgttgcaacacaatgagtttcgtgtgtttttgtttgcagaggtacttgcttgggcgaaagaaaagagaccgagcgtaaggaatgcatggatgattgaagaagttgattggggaccaaaccaagaccttctccaagtccacttccatctcaccacatcacttttggtccatacaagattagagattaagttctacacgttttggattctgattcgggcctcctagcagcatcaacttcaaatggatctaggcgctgatctaaaaggaattttggggtccatgagtacttgttgaaaagcttatggagtctactttcagatggttttggtcctgcatcaaaattcctactgagctgccgggaatctgcaaaacaagccatgtatctcatccagtccgaatctgatttgggttttgggccttgtaattgtgtcgtgggcttagcccaagggggtgtgcgccctagtgcaaccctaggacgtccctaatcacatttattcagtagccgtcatcgtttagagttgggttttacttagattattctgttaagaacagtttcgtcgctagatcggtttgtggaaccccaaattcgagtgcttaatcattcatatgcaatttggttgcaatctatcttgttctttcttgtgttcttcgattcgcatgcagggattagccttctcggcgaggtcaaccgggtttcagcacggttgataaccagaggagacgtagtgctgcgattgcggggctcagtagcgtgttcgttcagaagccggatcgagttgtgtctcgactccgtccaaatcaattgtttatcaatacctatcggaagatcaggacctaacatccctcatcagtaggtatcagagcccggttgcccgttaggtaatttaaattcccataaccagaaaattgccacacaaaaatatttattctttacctagacaatttgaactgttgcattgttctattagattttgcttcgttgaattttagattgcatcgtcgtgtcgagtgctggtttagttttagatttaattttagttttgagtaatgcatctgttcatcactttggtccagggttcatcactcaagtgtgtgagttgtacgtcagttttgggtccattttttcatctcgttggttgttgccgggacattgaaaaattgaatcgtctcgtcatcgggtttccatttttgtgatttggagaaattttttatgagttgccgtactgtgcacgtgaggagagtactgcgcgcgtgaggagagactccggatcaaatccgatctatccgtgaccgtccatattttcctctttatagaagtgttaagtaacggatttgagatattttttataaaaacagaacatacatgacatgagcaatccatttttgagatgatccaattttagttttgcactttatgtttgagtccttgtaatatttatatttacatttgagtccctgttcgaggtcagtggtcagtttctgttgaaaacaaaaacacacgaaactcattgtgtagcaacgtttgttcaaatatataacaagtaaatctaatgtagaacatatgcacctttggttgattaatacataaggtagtcacggttatatccgagctagttgtgccctcatcatcaggcttgacaagcggtttaccgagttcgtactggtgtctcacttctgccttagggattggtgcgctttaagcaactgagccctagttagcccggtgtcagaaatgaatttttttattccaaattcttgcccggtcactaacaactcgacctcctggtttggttgctctccaagctgagggacttttttggactttccagaatgtgctttcctaagtgttcgctcatagtccgttagctttaaggcctccttgagtggtcccgacatcttctggaagaacttcttggcactcgggtctataggaatcttcttttttggactctgaggcttcaattgcctcttcacttattctgccacgtaagcgtcgagctcctcttgcgtgcaatcgtacggtggctccttgttcttggcagcgtcaactttcgccttcttcgttgcccttgtgcgggcaagcggtggagcttggtgagttcttgacttggaaggtgccggaggacatggcagaggagcctgaggagaagtcgatgcaggagcctgaggaggagacggtgcaggagcctgatcagtaggagacggtgcaggagcctgaggaggagatggtggagccggaggggatggtgcacgagacaccgcttgtcgcccagggaggatgatgtagcgcttgcgccatagtataatggcgtggcttgtgtcgcgtagatacgtcttaccgtctcctccagggtagtccaactcgagttcctcgtacgcggcttccaccagttcaacttcgaccctcgagtatcctgctggaatcagcctgcagtggtaagtccctgaagggtccgttgggatggtcattcccgacgtaaccttcacgtgatgagaggttatctattagtaatcaacctaagcagaaacttgcggaatgtacaagtccaaaaaaacataaaactacgggcataccttgattgataagttcttgaagggaatatgcagctcacatggtgtccgctgcgtgatctcatcaatggggcaagtggtttcgtcctgagtttgcacggcgtccatgctctgtgatcctacctgccccgttgaggcgcagctgctacgattgcctgaggggctgaccattacaggaggaatgtatggctgggcatcatggcaccgatgtgcggccatgcgttcatccaccttccttgccacctcctcttgcatgctgagctcgtagctcgataccctgtactcaagatctgcaatcttcgcctcggtatctctcttgctcctcatccgactcttgtacgtgtggatgtcctccttgaatccaatcttccaaggaaccacgcctttccctcgtgttcgtccaggatgctcgggagtctgcagggcgagtgacagctcgtccttatctctgttgggtcagaacgtgccctgacaagaggcttccactacatccgttagtcgactggcagcctcgcgtatctgatcgctgaacaccagggagccgtcaacagggttaagcgttccaccgtgagcatagtaccagaacttcgatcgatccagccatttagcggtggccggttcgacacccctctcaatcaagccggcctccatctcctcccacttcagcattgtgacgctatagccatctgaccccaagaggtgatggtacttcttggcggcattttctttgtttctgtccatcatcgcttgcccttgttgccctgtcttgtaagcgacgaactcgtcccaatgatcccttagcttcgggaatacgtcgaagttcggtgtcagccccttcaggatgtatttcttgtagagatctcccttgaagctctggaattgttctaccattttcttaagagtccactgtttcactatgttctccgtacccgcagggagcgtgaacgtctcgagcattgtgatccacatcgtatctttctctgattccgggacaaagctgtcataatccccgcgtgcccttgttctgcgccagtacaccttgctgacaggcacgttatccttcacaacccaaccgctgtgtcgtacaaaattcttggctgcttcagccggggcactaggtcgatcgtcttcgtccacctcagttatgatgtgccgaccctctatcttcttcgcggcacctcgttgtccgcgtgccctcttctgtccagcggaggattgacttccactagcctccgcctccttgttcccctcctcagtcccctctgcatcactctccacgttcccctcctcgttcaggtactggtttggatcctcgttcccctcttcttcgttccagtactggctgcttccctctgcgattgtatcgtatagtatatgtttgtcatcgcgatcagccatctgttcatacaagaaatatttgcagccgtttgttatttacgtatataatatttgattagaactctaataatcatatattaaaactctaataatcatatatgctaagtctaataatcatatatgctaactctaataatcatatattaaaactataataatcatatatgctaactctgataatcatatattaatactctaataatcatatatgctaactctgataatcttatattaaaacgataaatattaatacatgctaagtctaataatcatatatgctaagtctaatattcatatatgctaactctaataatcatatatgctaagtcgaataatcatatatgctaagtcgaataattaatcatatattaaaactctaataatcttatgtgaaaactctaataatcatatatgctaagtcgaataatcatatatgctaagtctaataattaatcatatattaaaactctaataatcttatatgaaaactataataatcatatatgctgagtgtaataaccgtatatgctaagtctaagtttctaatattaaaactctaataatcatatatgctaagtctaaataatcatatattaatactctaataatcatatatgctaactctaataatcatatattaatactctaataatcatatattaatactctaataatcatatattaaaattcgtaataatcatatattaatactctaataatcatatattaaaactctaataatcatatatgctaagtctaagtttcatatattaaaactctaatagtcatatatgctaagtctaaataatcatatattaaaactctaatactcttgtattaaaattctaataatcatatattaatactctaatactcatatataattacatcacttgcctgcgcaaattcctactagggctagctaccactttggcttaagggacgacgacgacgtctttcctacaacatggaaaaaaatgtgttagtctaaacacaaaggaacatattttgattagtgcgctgcatgattaaactaggacggaggggagtagaagtttaggttcatggattaatttgtgagacatgtaactttgcgttcattcgcgttttattcccgttcgttcgcggttcgttcacattcgttcgcgttcattcacgtttcgttcttgttcattcgcggtccgttcacattcgttcgtgtttcgttcccgttcgttcgtgtttcattcccgttcattcaaggttcgtttacattcgtttgcatttcattcccgttcgtacacgtttcgttcccgttcgttccagttcgttcacgtgtcgttcgcgttcggcagtggcggccacggcgtcggcaaaggcggcggtggcaaaggtggtggcgttgcacggcactggtggcgtggcacagcggcgtcgtcggcgttggcatcggcagtggctttggcacggcggcggtggcatggtgcggcggcggcggcggcgtcggcgtaggcgttggcatcagcggtggcgtggcgcggtggcggcggcggcggcgttggcgtcggcgtcgagagtggcggcggcgtcgggagcggcgcgaggacgacgacgacgagcgaggcggccggtttagagagagagagagagaaagattgagatcgcggagcctctcaccccaatgcggcggcggcgtcgacggcgacgacgacgacagcgagatgactgcggcgtcggagcaagggatgccctaggcgcggcggcgaaggtgatgcagctgagatcggagaaaaacatctaagtgttggtggagaagacgagtgcgccttgggcatatatataccccatgatctttagtcccggttagtgagaacaaccgggactaaagatatctttagtccctattcatgacaacaaccgggactaaagatcttatcttaacatctttagtcccggttgttcttacgaaccgggactaaagatatctttagtcggactaaagatatctntagtcccggttgttatcaccaaccgggccaaaagatcttttcccgctatttccaaattctttattaacacggctagggttcagaaccgggactaaagataatagccatgcatattaaatttcattacatatgggtttctaaaatagtaaataatgcattaaaatgatttaaagtcacaaaattaatgacaaaaccttgaaaatatattggtgtctatagtaaactaaagtggatantatatttataagcacatgaatgattnaa

SEQ ID NO: 51717 - DNA, 1314 bp, Oryza sativa
  unsure (1)..(1314): unsure at all n locations
aaaatgacgttctcttgttcccaaccccttgggcgatgattgcctctagacgagcacggttacgaacatacttcttcagaacgcccatgtacctctcgaaaggaaacatgttgtgtaggtacacaggcctgagaataccaatctctttgacaaggtgacaaagcagatgcgtcattatattgaaaaatgaaggtggaaatatcaactcaaagctgacaagacattgcaccacatcattttgaagggcttctaatctatccagatcgatgaccttctgcgaaattgcgttcatgaaagcacatagctttgttattgttgcccggacattgtctggaaggataccccgaattataactagtagcagctatgtcatcaacacgtgacagtcatgagactttaggtttgtgaacttcttctccttcgtgcttattattcgctttatattcgtggagtatccagacggtaccttaatgctctctaagcattcaaacatactttccttctctgccttgctaagagtgtagctggctggactaaagtaatggcttcctttatcctttggttccgggtgaaggtcgccgcattgttccatatgcttcagatcattacgtgcttccagtgtatctttcgactttccatatacacccagaaagacaagcaggtttacgcaaaggttcttagtgaggagcatcacgtcgattgcatggcagacatccaagaattcccaataggttaagtcccaaaatatagagttctttttccacatcgccgcatgaccatcttcgctctctataggctggctgccaggcccctttccaaacactactttaagatctttcaccatagcaaacactgttttcccgctgcgatatttaggcttcgtacggtggtccgccttatgttcaaagtgcttgcctttcttccgtaccgggtggtttgctgcaaggaatcgatgatgacccatgtatacaaccttcttatagtgcttaaaatacgaactttctgtttcatccatatagtgagtgcaagccttgtaccccttgttagattgcccgaataggttgctaagtgcaggccaataattgatggttacgaacagcagcgctcgtaggttaaactcctcctgtttgtcctcgtcccacacggggacaccttccttcttccacaactgtttaagatcttcgaccagtgatcttaggtacacattgatgtcgttaccaggttggtnnnnnnnnnnnnnnnnnnnnnnnnnnnnnnnnnnnnnnnnnnnnnnnnnnnnnnnnnnnnnngagacgntcgttcattcctccagcg

SEQ ID NO: 51718 - DNA, 840 bp, Oryza sativa
  unsure (1)..(840): unsure at all n locations
ctaatccgtactccttaaccatatattttattttctccactcccgacgaattgtaagcntttagtctttnnttttaccgatcctcctcacaccccccccccccccaggganatgagatcaattgcgcacgccgcagncgacncnagaggaaccacacagcagganacccggccccagcacgcgagggggagacaacgcncccgcgcccggaagaccaggaacccacaaagccggaggaggacgggcgagaagacaagaacagcggcccgggagcgccagaaacgaaggccaacaaccagggggccacggaaggaccgcaaaaaccccaggagagccgccaagggagaaacgcgaggaacaggcaaggagaggcacacacggggagccgaaaaagaaacgcccgggcgggggaaagggaggaaccggagggccccagcaaaggcacaaaaaaccggaggagctgccaccggcgcgccaacaggggaagaaagcnnggcccaaggggcaaccggagcggaacaggggacacaaacagcaaagccagcacgctggaggaagaagagaccatactaccgccggggcaagagaaggccagaagcccggcgggggacgaagaagcccaccaaaggaagggaagcaccaagggcccncaaggagaacgaaaaccacatagaggagaagggccactggaggagcttatcaaaggaggcagtgagtgcgaagtcctctacgttgaaccaggaaggacacttatccagaagcacaatggtggacaaacaatgaagtgttgaaactgggtctaaaaaaaacaatggggcaaaagaaaggcctaaacctgtg

SEQ ID NO: 51719 - DNA, 8476 bp, Oryza sativa
  unsure (1)..(8476): unsure at all n locations
ctgttgtggcgatccactgcncnnnnnnnnnnnnnnnnnnnnnnnnnnnnnnnntttgggtgtccaagtatgttcaagatttttcttggaattatttgagcataggaagtatttttaacaatttaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcgacactgtttatcttctacctctagcagccgaactgagaccgatttggctcggtttttctcctccaaatctgacctttccccttgtgtttttctaaaattagttgaggggaaatattcctcttatcctcctctatctttacccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctttttcgtttgccccctctcccgtggtctcccgtgcctcgtagcgccgccgccacgtgctccaccccgccgtcgtcgccggccgagctccatccgcgtcgcgccgccgccttcgtcgtcgccgccggtcgccgttaccaccgttaggtgcgcgggagggtggagaagcccggccgctatctccccgaagccgcccaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcttgtcctccaaagtcgcagccgaccatccaatctccggcgaggtcgccatcttggttcggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtctttttcttcgttttgcgtgttagtttgtcgtttccgtcgttgcgaaggttcgtgagtgcgccggaagtattcaataagattaattgaagaccgattattgcaaggcaagtcacacagaccctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgagctttatatattggttcagctagatattagatatgattctttagccagcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggaccttcgctagaccgtaattccgctgcagttttcttttcttttgaaagtatgtaacactattattgatgattctgtatattaaattgtcagtttgtgtacctcggctgattcctggacgaggattttatgcacaaataagttcggaaattactagtgaatttctgggcgtgacaatttccccctctttattgcgcgcgggggcggcgggatgcggcggaatccgcggcggcggcagcgctagggcacgggcgaggcggcgggcgcggcgcgaggtaagggatgacgggtgggccctacccgtcagcgagggtggcgggcgggcccgcccgtcagcggcacgcgcgcggggaggaggccgattgggccgcgggggagaggagagagagggagggaggtggtccgagccggcccaaaaggggaaggggggaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtttgacttcttccgtcgcgtcttctataacgaacttgcctagcaaaacttctccactctggactgcttggctcgacctcctgttgcggatggaatcttctcttcacctgacttgaaccagggcgcaccttttagctgactcagactaggttgcggtagtttaatgatgcttccgctccagaacttctcatgattcataccttcggagtcaacctcatacaagttaccacttcatgtcatgcgtcaacactagcttgtcattactaggataccatatttgtcatcataagaatatcgtgcttgtcattcacttctaacttgccaccaactgcctcatattagctttcccggtctccgggtaatagctacttctgctatttgatgcaagggtcgataactttgcctttgaattatgcttcccaagagaaccaacttatcccacttgacatactttgacgtcttcccaaatggctttattgctggatttgttattgtctaatcattatcctgccaaatctgaggcttcgttgttagatgtgcttttaatctgacctctatagattatcttcgaacatatcacttgattcataactgggaatagctctcacgaacaagcaactcggattcactttctttacattcagtttacttcccattattatcttcaggttgtcctcagttagcattcaacgtattcctttatacctttaaccttgatgtgttctttcccattggatcatctcccaagacatggcattgcctggtaaccggtgcttgcacttttcactccgtgtagcatctgataccgagttgaagatttcactctttgccttcatagaaacacttttacccaggtcatcttgcttacttaatgacaaggtgactgttgcggggcaattacaatcaggggtcttccttgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggacgatgaggtcctttggcttgctgcctttcagagaaaccttgaagtagttcgtcaaaagctagactgacgattgttgcctttgatccgaagaagacacatctgaaactcttagtccaaacaaatgtctctttggttgatcacttgattttcttcgccatcaacaggttggttattaactcgagattagtatatgattcctctgaaatgagaccctaggtctcctttatcagtaagcaattatacacataatcacatatccgcatcttccaaaagaatcctaatagaacttgtctgtattacacatttctcccttattacatgaatacaaggcactaccttaaacaaaaagggaagatgcttaacatcggtacattgtttctactatgggttatgattaactcgaggcctcacaggtatggcgtttgctccagtgaccacaaggcgagtgacttgtcttcttcttgcataatggccggagtgatggcgtaggttacgcttcggctgtggacaatctctagagaaatgacctggttctttgcagttgtaacaaatcaacgtcttctttgttgagctgtccatctggggacgatcattttgacttggagttggaattggtggttggaaatccttgctaacattggcatcagtggtaccatagttgctatcaccattggagtctttctcagtgtcaaaattgctaaggttgtcattctggattccaacattgatactatcgttgacatcttggtgaatgctactgacattgcacgctttattcgagtggtcgctaatgaggcaagaaccatggttgttggtggtatcatcatcattagtattgctagtgttgttgtctgcattgcgtccatcttcttggggcaggaactcttgatgcacaacagaagatccggtgatctgaagtggctcagtgcgctgtctttggttaccacatggaaatactgggatgttgacaatcctcctcttgcagttcgtcatccgattatgctcactttcgagttgcatggctttgtccacaagtttctcaaaatcttagtaatcctctagaaggagttgcactgcaagctcatcttttaacccctggagaaacttctcttgtttgtcttcatctgtttccacatcttctggtgcatagtgagccaaacgatagaactcgtgcaggtactttgtgacggtcaaatctccttgcttcagatagcgaaactctcattttcttaatgtgatcattcctgcgggaacatgtgatctcctgaatacagatgaaaactcgttccaggtgatggtatgtccttctggccgtgatgcttcgtagctatcccaccactctgaagccggtccaaccagctgaggagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgctggactgtaggtacttgaacgttggttgtccctgctgggttgttccaattctgtaatagttgaaaggctgttgccaacatgttggtttggttaaccacaatttggattagctctggtgaggttttgttgatgcttttctcattcccactggcttgggttcttgagtcatcggatccatcattcccatagcctttgttaccagtgttatccatctgtcacaaggtagaggttgagaggggaagcagacaaggaaagaatggaccagaactagggacaagaccttaaaggaactaactcttcttgttgatatgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttcactccttcacagctggcttcactgcttcctccacttcgctagcggatcctgcagtcttccggagcttcggcgaacaactgacgatgtcttcttcttcactgacctgaccatctagtactagttgaaatttgaagaaggaagaaaagggtaaaccttttgcaaatagcattaggggaagaagaaaaagaggaactttcgcaaatagttttatttataaaatatgtccttaggttttatccacttggcttatcctacagtcgagatgcgtgtgataccagcttgtcgcgaccgagaaaattgcattttcccgaacgctagtgtattaatccccgtcccaggaaaagccagggtacaccatacaaacatgatataaaagacacatctttattatatcgataatatttacattattacaaaggcacttaaggcctgacaatcaaaaataaaaagcagcggactagcgggcctacggctccatcttcacaggcgctcaactggggtataagccaagactccacctaagacttcttctccaaagcatctcttactgaaggggggagaaagatagagcaagaatgagtacaaccacagtactcagcaagccacaccggcagatgcacgactaatgcaagggggtacaaggggtaatgatataggggttaagttatgcagaaaacagcatttaaaagtcacttagttgcccaaagccattttataaagacgatcctagagctacacagtattattaatcaaggccgtgaaccctcacgaacctgccttaacccaaggcctacgatgatccagaccgaactggcaacccaaccctgggtcccagctcgtcccaagccaacccaggccaaccattccacattttagttattgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccagggtgctacttcccacaactggcatgcacccaaaccccaccggaaaacaggttttaggggttttgaaagaggaagagaggtgtatgtccaattccaccataagccaaccattccatagtgtccaaatgatatgagaattcccaaagtctaaagttataaaaaccacctaatgttgtcctatttaatcagcgaagcatctacctaaattcatactagtggaaccatgaatagagtacccactagttggggtattgttttcctagggtgaacaaggtaataataacaatagcaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcagagagaacggccttccgaaccttcggcgacgaccgaaaaccacgcttcgggaacctccggaacgacgaagactacgcgaagcacacaagcaaagctacaagcctataaagaagcaataacaatacataaaaagaaagcacagggttctttaggttataacaaacattaagagacttgaacgggtcgattcggagttnnnnnnnnnnnnnnnnnnnnnnnnnnnnnnnnnnnnnnnnnnnnnnnnnnnnnnnnnnnnnnnnnnagngagtaactcaaaccagg

SEQ ID NO: 51720 - DNA, 3190 bp, Oryza sativa
  unsure (1)..(3190): unsure at all n locations
cttttaattattcctttaagaaaatgatttttatttcggattgaatttatcaggacgtgacatcccgacatcatgcttagtgtgtgtatgtgtgcccgttttcaagcggagcctaaagagtgccatttgattccggtcaagagaattctaagatatttagttcacactcctaatcttggcttgtggtatcctaagggttgtgactttgagcttttgggctattccgattcggattatgccgggtgtaaggttcatagaaaaagtacaatcgggacttgtcaatttcttgggcggtcccttgtttcttggttctccaagaagcaaaattccattgctttatccaccgccgaagccaaatatatcgccgccgattcttgttgtgcccaactcctttggatgaaacaaaccctaaaatactttggctacaactttaccaagatcccactcctatgtgacaatgagagtgccatcaaaatagccaataatcccgcccaacgctcaagaaacaagcacatagatattcgccaccactttttgagagatcacgagactaaatgagacatatgtcttaccatgtgagaaccaagacccaattagccgacattttcaccaagcctttagatgagaaaagattttgcgagcttaggggtgagctcaatatcttagactctcgtaacattagctgatgggtggttggctaattcatagccaaacatgtgtcactaaaatgtaaattaaaaaaaaaagagcttttgtgtcttgagatcacttcttgtgtagaagatggtcttgatactaggaataaagctcaaacattccctctattatccaaaaacccttttgtgaaattttgcaaaattttttgtgtgtgtttttattgagaaaatttggtttttatcccttcttgtgatgtatattgaccattcttatgtaatgttgattgttggctggtcatatgcatcataagtctctatatattcataggtttttatttctaaatcattgaattctcatctattcctttgaacttgggcctgactgccctctgttctgtcaggccggaagttccggtcatcccagtccagaacttccgggggtcgggggtataaatacccgggggagcccgagcctgttctctctctcctcacttcttctcctccctgattcccaaaccctagccgccgctacagtgctcctctcggcgattttctattcaaaccgtggaaatttgattcctctccgtggaatcaactacattggtggctaggaggttcatcccgcgatcgatttgcgatttctcctctctaggtagcacttttgatcttctcttttggttcatcatgtttttgccccgatctctaaatatgtgaacctagggagaaaaccttttggatagaattgttcctgctaccttgtagattgccgatctataggattttgtcacatgcactggcctggttaaatcctctgttcttcagttttgtaggccggaagttccagtgttcttggcccggaacttccggtctctgtctagccagccagtaaccttgattctgctactgtttcttttaaccattgcactccaaccttgttgattcttgttgcagtggtcattatgcctcgtgagaagagacagaagctttcacaagatgttcctgctgactcgagccccccagttcatggtcctagggggagattgggcaaagaaaacgttggagatttttacagtgggagtcagattccgatccatttcaggagggatggtagcattgtcattcgtgatgctccccgctctccctctccagctgcatcagagtcagataatggtggcaatgaggatgagcctggttctgaaagcaatcccttgagactttacaagacaagggttgttgatcctgatcctagacgcccaagagtgaactatctgaaaaatctgctcaagtgtggaaaggacaatgatgagtcctgatactttgcctgctaactctcaggatgacagattcaggaccttggtgcaggttgattggtataattctgtgatcatgggaagttctcatccagtggtaaggatgaagtggctagactgtcagtacatgtcctcaaagacaaacttagttttcaatgaggtgcgcaaggtgtgtgagcgcaagcacgtgccagatttgttagccttgcagtattcctggaatgaggaagtgactggtcagttctactccactgctttctttggcaccaccaagaaggggcttgattttgtgaagtggaccattcaggggcagcagtatagtgtctctatggcacagtttgctgcagctttggggttagatgatgatgacctgagtcgcccacatatcattgtagaggatgctctgtcaccgaccaacactacctttatgtatgagaaggatgctcccaaggattgtttggggactactcgagggttgcgtccatactatagagtgttgtactcgatcttcaggtggtctttgctccccaaagtgggagatgctacagctctttcaggtaggcatgcgctcctcctcagtcgcatgcgctacaacaagccagatttcagcatcatgaagcttatctggagtgagatctacgagacagtgtgtgagccaaagaggggttgcatctatgctccatatatcatgaagatgattgaggccaagactgggatttgttatttcaaggacaatcaacacaagcctttttgtcctcatgctcccactacttcaactacttctactgccagagtcactcgtgcttccacctcagctgctccttcttcctctgctgcaccacagcgttctgagtcttcttctcccataaagaaggctctcagggctatcttttgtatgtgtgccaagatagctaagaaggtaaacaagatagagaggcgtcagaaggaagattggattgcagcaggcaaggatgactctgacatttctgatgatgaggagtttgttgatccttttgctgcttatgagactgcttgagacattgctagtggtgagggtccctctgggggatcctctagagtcnactgcgnggcatgcaggagagattcagggacatttnnnntttnttnnataangaaataaaaaagaacntggtaantaaaaatctaataacaaacagaantagnaanatacacaataactaaaacccaacattttaattgaat

SEQ ID NO: 51721 - DNA, 858 bp, Oryza sativa
  unsure (1)..(858): unsure at all n locations
gcgagagaaatcngttaacattttantggtttattttagtccnnccccgtannccactggacgcttttgtggggtttttggttttaatggtttatggttgattttccttatnncaaannnnnnnnnnnaatgtattgatgtcatgtagccancnacacnagagnnnaagacanngaagagcacgaaccagaatagtgttgttcgtatagatgccataggacacgatggtacaactggcatgtattacggtgccatcgaggacatatgggaacttgactatcgacctctcaaggtctctctgttccggtgccaatgggttaggttgactggtggaggcgtaacgattgatggcagtgggatgacaacgattgaccttaacaaggttgtcggactaaccttttgtccttgccaatgatgtaacgcaagttttttacatgaaggacatgtctagcaaaggaaagaagggcaaagggcctgacgagccaaagccccacgtggttctcccaggcaaaagaaaaatcgtcgaagtagaggacaagactgacgaggattacgatcagtttgatgggcaaccccctttcacggtgacaattgaccctagcatcctcctatcaaatgaagacaccccttactcacctagtgatcacaaggaagaaacaatagtgaggagaaactacgtgtggtcaaccgtcaccgccaatgtattgctcgaattgttgtgtacacgatgtaaactatttttggatgtattgaatattccattaaaattaataggttgaatgggaaatggctgaatatagatggattactagaatcttttacacaatttttaattcttgcatattgcttgcgtatttc

SEQ ID NO: 51722 - DNA, 1189 bp, Oryza sativa
  unsure (1)..(1189): unsure at all n locations
atgactgtttcccctccaccnnccnaagnnncggacctggcaatcctttggcctctactcttaagatcttatggacatgtaataattctctatttgtgtggatgtaatgacagttagatgctcttagctgctctttatttatattgctcttcatttatgctatgagtgtcttatttgttgtttgtgatgtgatgttgattttatccttttgagtgctcaccatgtcgtatcttttgcatatcatatttattcttactgctttttgcatcccacgaatgagtagggatgaaggaaactctcctcggttgctccgttatatatatgcatatgagcttcactcatattttccatatgcatacactaagggggagtttcattcacctctaaccattcaaaacaaaattattatcaatcttttgtaagctttaaccatgttgtcatcaatcaccaaaaagggggagattgaaagtgcattaatccccctagtgggttttggtgattaatgacaaatgtggttaagggactaatgagttcattgagtatctttcaggtgcattagtccaaggtgtggaagatggatgcgtggagaccccccaaaagtataaaatcaaagcggaccggaactcgagaagtgcataggatagtttattttttgcaatcgagtttttagaaaaaaccgtactattaagaggggttctaggtgatgctctgagatatctcaagtgctcttagtgtgaaccaagtgtcaagtttccctaggagtcatttttgcaaatgctccattggttcaaaaatgcaagtccggaacttactgtcttccaggtccggaacttcctgtctagtttccagttcaaatttgtgagtaacggctagatgacgtcacctagccgttatacatatacagctcgtttccagctcgttccttggccttccactttcactttttgaacctagagctgttgctagcctctcccaagtgtttcttgccttctccactcaatctagagcctaattcttgtgagaaagagagattgagagggagagaagaagatttggagatgtgtgaagactaggatcttgggtgagcacttggaatatttcgggggctgtcatctcggggctaattactcttggagatgatctcctaaacggttaggtgtcgcccacgagaatcccgtgcatattgggg

SEQ ID NO: 51723 - DNA, 1483 bp, Oryza sativa
aaggagacctagggtctcacttccgtaagttcataatctgttatgaatcaaataacctagcaattgatggcgaagaaaatcaagtgatcaaccaaagagacatttgtttggactaagagtttctgatgtgtcctttttcggatcaaaggcaacgatagtccgtatagcttttgacgaactatttcaaggtttctctgaaaggcagtaggcccaaggacctcattgccccagaagcacccacaacatccggagtgaagagtacttggttgagaaaggtcaaaaggtgattaacggaagagatcggaaaagatgtttggttactgggaaaagaagtaggtcgaaaggtgattggtaaaggataatgagaaacatgatttgtgtcactcgaggaagactcccaatagcaatcgaccctacaacagtcaccatgtcattaaggcagatgaattcgtgagtaagcaagatgaccacaggtagaagtacttccatgaggacaaggatggaaacctttgtgacatgaccaagaagtcaagaagttaacctgaacagttggaatctaaagctcggttcaaccttcggctctgtattagatgctacctagaataaaagcacatgcactagtatcgttcaacacaatttcctagcaatcgatccattgggaaagaacacatcaaggttgaaggtgtgaaagaatacgttgaatgctaaatgatgacaacatgaagagaatagtggaaagtaaaccgaatggaaagaaagtggatccgagtttcttgttcatgagagccattcccagttatgaaccaagtgatatgttcaaggataatctacagaggtcagattaaaatcacattcaataaaaaagcttcagacttggcaggataacgatcagacaataacaagtctagcagtaaagtcatttgggaagacgtcaaagcatgtcaagtgggataagttggttctcttgggaagcataattcaaagttagagtgatcgacccttgcagtgaatagcagaagtatctagcacccagagaccagaaaagctaatatgagacagttaggggcaagttgtcaatcatggtattcttggtaagcgggatatgatagtctaaagcatttggtggtaagctggaaggaaacgccaagcatggtattctcatgatgacaagcatggtatcctagtaatgacaagttggtatcgacgcacaacgtgaaattgggaacttgtatgagattgacaccaagggtatgaattatgagaagtcctcgaactgaaacccccgttttaagtaccgcaccccagtcgaagtcagctcaaggtgcaaccaaagataagctatgtgaacagaagatcccatctgctacaggagatcaagccaagcaattcaaagtggggaagcttcgctggcaacgtttgttaagaagactcaccggaagaggtatacccgaatcagagaccctcaacctatctttttgctgct

SEQ ID NO: 51724 - DNA, 10229 bp, Oryza sativa
  unsure (1)..(10229): unsure at all n locations
acctatcctcctgnctagtcttctcgaatctcgggggcgagattcctgtaaggggggtggatttgtcacgcccgtgataaattcatcctgaaataaaattcattttctaaaaggaataatagaattaattaaaattcaaatagaatttggcaaacgttaaaatgcgtacaaaaaaaattcgaatgtggcctagagaattttttttaaattctccttggtctaaaaggagccctcaaatttaacttgaattttcagaacaccgggaataattattaagcaacaaaaacaattatcaaaatttattaaaaagaaaaactaaaaattaatcctccttttccctttgggccaagtctggcccaaagttttcctctctccctcggcccgcggctgaagtctctcttccgtccctctctttttcctttcttctctgtcgaaacataaattcggcaataataaaagagggtagcgcacgagacctaaaagtggatggatgcggagacaaggatttagacaggttcaggccctcccaatgagaggtaataccctactcctgtttggggatttgaatccgccgagtgtagtatagatctgacgatctagttgtctcatatgccccctagagggcctcctgcccaccttatataggatgaggggcaggattacaagatagaaaccttaatcaatacggtatcggtttcctaaatctactttacaatattatcaaaccaggactttgggccatttcgtaagatacaaggaaacgtaacacccaagtcatgatctgttacatgttccatatatataagttatcccctataactagtaggataaccatgccgtgtgggtatggggtacccataatctccacaggtttcccctgagaccttcacagtcgaaaagataatcttctctcgaactagattactccaaagccgagtgcttcaatcatctttgccatgatctcccgagtacttttaccaaatctgaagactgtggagggctgaaaaataaagtcaggtgcatcgactagatgcacctaataggtgtagcccccgattatgtggttaactgaacaaaccaagtatatagtcaaggaataaataatccaaccaaccaagtggtttcaataattatggtcaaccaagcgacttgatattaatatgtagcatatgcggtgtgaatccctgaataacatgatccgagtgatataccgactactttgtaaaatatgatgagtgtaatctaaggttggccacatcattgaaaattcacatagcaaaacagctataaagaagcttgtatgttgtgaataaagaaatttccaaagtattgggcatacgccatgcgcacactgctttaacagatgtgcttaagtccctaaaagacacatggtttcaccacacctggaaatatatggcatatgtggtgtaaaatccgagtaaataaactcataaaggatttaccaaccgcctggaaaatgaccaaaatatataatgagcctaagccataatattggtcaataaaagtgcacacttacgtggcaaaaagcaatgatattgtatccaatcaattgctttatgaatccaaacagcgccttgacttatataaaaaagtcagcgggcagctatataaagcattactgtttggcaccttttaaaatgcattgtaccaactcctaaaaagttgagtaactgcggtataaaaggattttaaggtattgagcacttgatcacgcgcactttggcctaagcaaaaagaacgtgacaggccacacctgaaaatatggactgcagacatattaggcctaggccaaaaaatatgccttcgacaccctttaaaggatgacgcatgtaacatgctcccgagtaataaatcttccgggtaatatataccaagtgtagctcatatgaatagcttctgatctgagtgattatcccttatgggatactccaaaatagatataaagattgaatcccgactggcgcaagtatttggttgataacccttacggggaataataaatagtccagtctttgagcatagaaaataaatccatgatcatgaattcatgttgcatgtatccggaacaagtccaaattgaaggtatgatacttgtgtttgaactagtaagcccctgatcatatagcctgtccttctgtagtcacaatggtccattgatggtagcaatcaaaagtgatgaagttgcatagccatggagacgaagaaaccagtcgacagtagtcaggtcagccatcaatgaagatgaaagcgcccagtgataaagttgtgtagtcatggcagcgaaataatcaatcggtgacagacgaggcaaatcaaaggctatgacgaaatccaccaatcctaaagatgaagaaaaaagtcggcgacgacaaacgcaactgacatgatgaagatgacgatatcggcgatccagtcaatagcagtgtcgcaaccaatgataatgacgaagacgctcatcagcatttgcatagtaggtcaaccgtgaaggtgaaataataagttggtaaagacataatcatccattagcaacaacggagatgtcagggtcgatgaagcagaggtgctagtgatgatgtcagtgactccaaactcccagacatggaaatttaatcttgacctactgctttgaagcgaagacaaaattgatgactcccagagttgacttgttgactgattaattgattgcttcatcttgacataaagcttgtcgaattttgagccatgtatttgtgtagcccccgactcttcggttagttgggaaacaactgaacatagagtcgagaattatagcttcttgtcgtcgagtagtcattgcttgattgaagataatggctctcctgaatattggagagccacttgttgtagtaaaataacacggcatcgcatgccgagatgttgaggttcacaaagacgtcgtggttggtgaagtagcaaagcttgcgaagtagaggcaatagagtttgccggtgccgaagataataaagatgaagccgctctaccatggtgacaaagttgcatagccatgatgaagtgaacacgagtcagcagcaacagaagcaaaccggtagcgaagacgcgcaattgtgaagataaaagcaccagtcggcggcggaagacgatgatgtccatcaatagtggtagcggtataaaccagacgtagagggcaggacaccagtcaatagcagacgagacgaccggcggtgaagacgatnaggccattcaaagtggcagaataatgcagncatggaagtgaagaaaccagtcggcagcagatgtagacagcttgtgttgaagatgatgacgcctattagtcgtggtggcaacgtggccagccgtgaagacgatagcaccagttggcgtcatatgaggcggccggtcggtgaagatgtacgcgttcaacaacggcggcataataagccagccgtgtagacggaaacaccagttggaggcggacaaggcggctgatcggtgaagacgtagacgcccaacaacggcagcataataggccagctgtgcaggcggaaacaccagtcggcggcgaacgaggcggccggtcggtgaagacgtagacgcccaacaacagcggcataatatgctagccgtgtaggcggaaacaccaatcggcggcggacgaggcggccggtcggtgaagacgtagatgcccaacaacagcggcataatatgccagctgtgtacgcggagacaccagtcggcggcggacgaggcagctggtcggtgaagatgtagacacccaacaacggcggcataataggccagctgtgcaggcggaaacaccagtcggcggcggacgaggcggccggttggtgaagacgtaaacgcccaacaacggcggcataatatgccagccgtataggcggagacaccagtcggcggcggacgaggagaccaatcggtgaagacgtagacgcccaacaacagcggcataataagccaaccgtgcagacggaaacaccagtcggcggcggacgaggcggccagtcagtgaagacgtagacgcccaacaacggcggcataatatgccagccgtgtagacggagacaccagtcggcggcggacgaggcggccggtcggtgaagacgtagacgcccaacaacggcggcataataagccagccgttgaggcggtgacaccagtcggcggtggacgagacgaccggtcggtgaagacgttgacaccgaacaacagcggcataataggccagccgtgcaggcggtgacaccagtcggcggcggcgaaagcaagcctgtggtgatgttctgactgatccattcctggatcgtaagagataagcttaaagccatgaatcccttttatgcatatctatatctggatcctgtagaccaaacatataggatgagtagtatctgatataaatataatactcaagaaaaattcaagtattttaaaatatttataaatatgtatttcttctcttgtcaattttgatttccccgagcagatgactcattacgtttaaacactctgcccgactagtcatagccaccaagcaccgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttattcggtccatccaccaagcccccgggtgctaggaatcggcccaaaggcaactatctattggcaaaccaaacgaaaagcataggaagatggaactccataactcgataggcacttttgtactcagaatatgtcgcaagcaatcaagataaatattatgaaaattgtttaaaaaatatgatataacatctgtagcccccgactcactagtcaacggcgaaccagttgacgtagtgaggcagaggaaaagaaaaatatcatataaagaaaattaatgatgacatagcttcgtaatattccgcttgatgatggcagaggtgaccagcgtgggaacaaagtcgtccatcaataacaatgaagacaccagtaggcggcaacgaaggcggttgacggtgaaagcgaagatccccaccaacagcggcataataggccagccgtgttggcagagacaccagtcggcggcggcaaaggcaagccggtcggtgaagacgtggacgcctatgaacggtggtgtgaccaaccaaccgtataggcgaggacaccagtcggcggcgaaggaggcaggccaacggtgaagtcgtagacgcccaacaacggcggcataataggccagccgtgtaggcggagacaccagtcgacggcggtgaaggcaagccggtcggtgaagacgtggacgcccatgaacagtggtgtgaccaaccaaccgtgtaggtgagaacaccagtcggcggtgacaaatgccagccggtcggtgaagatgtggacgcccatggacgatggcataataggccaaccgtgcaggcggaaacatcagttggcagcggatgaggcggcggcgcacaaaggcgaaactcccgagcccgcggcggaagcagcgtagtcgggctgtgttggccgggtgaagaccgaagcgcccgacgtgcggcgtcacatccaggtcgtgcttgccctaggagcagtcgggccgcgttaggcacgcaaaggcggcactggtccgcagccccccggcgtgtggaatctccaaacatgcgaccaaaatagccaacacaagcttcagttaagttgcgattataaataaatctaattagaaattagagattaatgctctgtaggtataatgcacgtgtcggtgcatatatgcagtatgcatgttggttcgtttgccaatagcatgaattgactggagatttggccggcattaatccagcaacacatgcatggattaatacgtggcagagatgacctcagatggatgccgcccgtctcgtcgtcagtacatgcaaaaccagagaaagcacaacagagcaaattaatctgattagaaattaatctaatgataatagattggagtatccgaggacgccatcagggagagatcggtcttgctgcctcgcaacaccagcgcgaggtcaccatgagcactatcgcgagcgcgatgtgaggccaccgctgacaccgctgcaggcacatgcagcacacgatctccctcttcgcgtgtcggcggcggcggtgttctccggtcgagcggaactgatgaggcctcgtcggggagataactcctaaaagtggcatctccttcttagttagattgaatctctcctgactggtttgaatccaagtcagagaatgagagcttgtcgaagttgtcggcgacgaggaagtgacaatcccgtagcgaagacgaagccggcgactcatggagttgattccatcgcatttctcgataggaaactcgacgcacccctacctggcgcgccaactgtcgaaacatgaattcggcaataataaaagggggtagcgcacgagacctaaaagtggatggatgcagagacaaggatttagataggttcaggccctcccaatgagaggtaataccctactcctgtttggggatttgaatctgccgagtgtagtatcgatctgatgatctagttgtctcatatgccccctagagggcctcctgcccaccttatataggataaggggcaggattacaagatagaaaccttaaccaatacggtatcggtttcctaaatctactttacaatattatcaaaccaggactttgggccgttccgtaatatacaaggaaacgtaacacccaagtcatgatctgttacatgttccatatatataagttatcccctataactagtcggataaccatgccgtgtgggtatggggtacccataatctccacactatctatcccaggcctcccctcctcctcccggcccacctcttccctcctcttccgcttgggccgcccctaccctatcccggcccagccgacctgccgccccaggccacctccctcctctccctcgcgcccctctgcacgtgcggcgcacgtgcgcgcctcgcgccggaccaatgggtccacccacccggtcgtcttctacctcccagccggctcctctctctcctctctcccattaacccttgcaccaattcctcccccgaatccgctccattcatgccggattaattcaaattggttagagaaatggaatccacatcccttcctctctagttcccctaactttccccatttaatcccatccccaatcgccgggatttaatcccccttctttgacctctcccgtgactggcactccctccttgccctataaaacgaagtcctcatcctcccctcgttacattttggtcccttccgagtctttagccacctccacgccgccttcttctcactccctagcaccggccgactccaaccgcccctgccgccgcgtcagctagccggccggccgtgccatcgcctcccccggcgtcgcagtcgcctccccttccccggcatgctctccgtttcccgcggagacctccggaagtgcatcctcgccggcaacagtggcgttgctgccactgttccgcctctgccgcgtctcctgtgcgtcggccgttgtcgccaccacctctcccggcaccggaactccgtcctcttcctcggctaggccacgacgtcgcccgaatttcgccggaacaccgccgtgccacgccggcctctccatccgcctcgccggaatttccccggtcggcccttcctccacacgtgcaccgtcggccgcgccaccaccacctccggaatcacagcggcgagccggcgacatcttccttggcatcgcctcccctccatccaaacccctccgcggtccatcgtcgtcgtctccgttcatcctcgtcgtcgacgtcccgtcggtcacccagctcatcgtcttgctgcgccgccaccatcatcgtcatcacagcggcgtgttccgcgccgtcctcgcatccgtgtagctgctgccggctgccctcatcgcctcctcgccggttccggtcgtcgtcctcccgtcgttcccggtcgtcgtggcattcgtccctccgtcaagccaattgcgtttgccgccagtggttcgtcaagcgagctgctgcagccccgtcgtcgtcttcgtcctcggctccacgtcgtcaagcctcgtgctggccgcgtctcgccttcgtccaaggatcgccgccgaagtcgttcgcctccatcgtccccgagccgtctccgccgtgcccattcgtcgtcgtcgtgccgcgccttttcgcgtggtggtaagggtgcctcctctcgctgccccatcctcgtcctttcggtgtcgccccgtgcccgttgtgcggttgtcgaccccggtacccgtgtaccggtgtctgtagtcattcgtgggtgcgtgtggtgaccgtgtttgtgtgcctgctcggtagccgcgtggtttccacgtgtgcagccgcgtggtgtctggtagagtccgtttgccggccactcgcctcggttgacacacggggtccgcttccgtcgacccgtggaccgtctctgtgtacccggtccaccgtggtcccttaggttgacatgtggggtccgcatgtcaacggcgcagccttcctgtcttttccaggctagtgcttacacatgttttatagttgcaaagcctaattacaataatccgtaaatctccacgtgacaacattaaacttgatgaccaaatattggtcatacgagctctgaatcgacctgttcaagtctcgtaatgtttgttataacctaaagaaccacgtgctttctttttatgtattgttattgcttcttcataggcttgtagttttgcttgtgtgcttcacgtagcttctgtcgttccggaggttcccgaagcgtggttcacggtcgtcgtcgaaggttcggaaggccgttctctgtaagcaaggcaagtcgcatcacccttgagcatattgaatcccagtttataaaattattttgatttaaattattgcattaccgctttacttaaattcccgcgttatcactgttttatttagccatgcctatttacctttgttatgacattattattgctattgttattattaccttgttcaccctaggataaacaaaaccccaactagtgggtactctattaacggttccactagtatgaatttaggtagatgcttcgctgattaattaggcaacactaggtggttttataactttagactttgggagttctcatatcatttggacactgtggaatggttggcttgtgatggaattgaacacacacctcccccctctattcaaaactcccaaaatggttttaggctgggctcgaggtacatggtttttctagtagcacctcggccactataaggaccggtcttcgggcctatgttgcaaagcactaccgtactaaccacatgtctaatgggtaaggcttaactcggtgctcagtctagtcctggaaagagtacatggatggagatggacgaagtcggggctcgatggacatctctagggcaaatgaaggctacacgggctgcggctcggtagtcgagatgttatgacacagggccggtgtcctgctgctaggggctcaatcgtacctacctgtctcgggattctggctgtaggcgaggttgggtcggtgcttttgtcatggctaggatgggtaaaggggttatgtcacatcctttatgacgggttccacggccgtcgaatgcagagtaaagatgtgtcttgtgggtaaagatgtacacctctaatcagagcataatctattcgaatagccgcgccctcggttatgggcaagcctagtaatgtacccaagttagtggtttaattcttaaaacttgcttaacaactaaaatgtggaatggttggcctgggttggcttgggataagctaagacccaagtcgggttgccagttcggtctaaataatcgttgcccttgggttaagacaggttcgtgtgggctcacggccttgattaataaacttgtgtagctctaggatcatcttcataaaatagctttgggcaactaagtgactcttaaatgctgtttattgtaaaacttaacccctatattatcgnnnnnnnnnnnnnnnnnnnnnnnnnnnnnnnnnnnnnnnnnnnnnnnnnnnnnnnnnnnnnnnagatgtgcgtctcatctccac

SEQ ID NO: 51725 - DNA, 5100 bp, Oryza sativa
  unsure (1)..(5100): unsure at all n locations
acaaggtggcgggtcatcacccggcttcggggaacccccgaagcatcatgggattaagagcgagtgctggnataagtcatcctatgaatatgagattaaacatanttagtgatggaagcaactaaggattgataatggcttgaaagtaagcacgcttcatacatgataaactaagttagggtcccgctttaatatgaatgcacaatacaaatgcatggaaagctaggtctatctntgcataattagtttcnatgcacaataaaaatgaacnattcatttatatacaaatgcgataagttatgttagcatgatatgatgcacccaaataagaagcattaagaatcaatcgagctcatcctatactaaagctcgaacaagaagcaataaaccaaaatagttttccaattgcgatcaaacatagcgggccaaaagcgtatcaatcgtcggaacatgaaaattcaaatagaccaacactgcaacttggccactactgctatatgacacatttctatctagcgtctctcagctgggagtacacttttgcaatatatttggtcgaatttttaagttggtatattttacttcttccgaaacaaggttctgaaatttctcaggttgccgaacagcagccactttacgaatttttagagagggctaaagaagtgataaaattctgaacatttttgtggttgttcctggagtagttgcctagctccagaaaaattttgacagcaaaatagtgattatttgattacagactgttccagaaattccagatttggctatttgacattttggaggtttaaaacatgttcataatttgtcaaaaattttggggagactaagagcaacatgaggaacagcaaggcaccattttagagtgactattgcacattttaattgtacttacaaactgagaataaagtttaattccctcaacttaccgggtgcattatcggtctaatatttgaatgggagaagtaataaatttattttgtcaaccaaattagaccaagatgagtggaaaatctgagaataaggtgagaaagaacactagaatgagatgaggagtaaaaatgattcacacatactaagattttcacaatcgactcaagttaaatattttgcaaatcattttcaaattgccaacttagctctagcctacagtcggcattgctatgataccaaccgttgtggacaccccgagtattataccatccagtgtccaacgcgaccaccacatactattggagaagtgggttccatacactcataaatagccactcgtcctcaatgtgtccatgatcgcggttgacaaccttctgttataataaccggaatgtcgagtagtgagcgcaagacataaccgtaagatagcttgccagtccactccgtcatatgcccgtcaaccactcgaaggtggcgaccaaaagcataccccagtgactcgatccaaagcactatccccgattatctcaagcgatcaaaacccattactcatgcttagctagtccccaggtatgcgactagccccacactttcatctcaagcaattaataaacatagcaagtaccataatagggttaaagtgcaacgaggtacatgacacataatagggtccgaggtcccaacatacaacacataaatatagcagcggaagtctcaaatagagttcataagcaaaagataaaaccggtggtgccacaaccccagtagggcaaaccaaccgggcaagagccaagctgcaagagatcactcattgccctcgccgccctcggcagagcaatgaccacataagaagcataactcataatcggaatcctctcctgaaattgcagacaccgggttaagtacaagattgtactcgcaagtcttacccaaaattatatatacataaggaagagagaagtatgcaagcttttttagcctatagtgggtctctaggttgaacatttgtataaagctaattttattgagcaattaatgagtaaaataagcaaggacaagtaaatctagcatcatattaatttatggacagcaagtatataattctgaaatgtataagcaaatgagcccaaacggcgctctcatcatcaaccatggactaccaaagtccataccaacatggcacaacatgccaacaccaccatcaaacataatcccatctataataatccacatttgatgctaatcataactgactaacacatcaagcattgtccataaccgaggacgcgtctattcgaatagattatactctgatcagaggtgtacaactggacccacacgaaatgaacaaagatcaaatgctacacaccccgtcgagtgcggtacacaattgattcaagctcattacatgccctttcttagccccacccaaccacctataccatgctggggttcccgacgactcagtcacgtgcgtgcgtgatgtcaccaaggcgggcgcgccacgcgggagacacccccggccaaacctaggcacctgaggccctccaaaggctacctgcctcacgactctccaacgtggtataaattatcacagtagaactagtaagaacaagccgatcccaaataaggcatgtggaaaatacgtaggatgcttgattagatgtcaaaatgttcgatccttaacgacctagacggggcaacttgcatcaggggaaaccaacctcccatcatcgccctatcacccgtccaagtccaacatatttcatcaaccattatttagtgtaagtgctcaagttttatgcctaaaaatgcaagttgtctatataccacaattaatagcattgtccatccctatagttctattagcactaagcatggctaagcattaatgaataagacatcccaagtaattccaaccagtggtaatagggtataaggacagcaatatcacaagaactaaatgcataaataggttctacccatacaccataaaccgacaatattaatatctaggcaatgcatgcatatatatacgtatagattgcaaccaaatcatttttagagaaagcatagattctatatgcttaggtgcttgccttgctgctgagggtagtcactatcctcctcgggatatggctcgttactccccggaatctccgaatctatcgaaaagaagcaatatgcgaataagagccaaataaacatgcacatgcaaaatgatcaataaattatgaaataaatacagtgggtagatcatattttaacttgaatttagttgaaataatcaccagattatcacttatagtttgggagatatgaaaatgacaagctctcaggtgctgaaaatggcagttctgcaaatattaacatttccttttgtacattacaagtaaaatgcatttcaaaccaagatttcataataatgattatttttagagtaatgtacatcactcacagctcctaagaaaaattatttcacagctataagtgttgtcattatttatttatggattttaaaagttagaaacataggaatgctaaataaactcctaaacatgatttaagaggtagtttctccaaaaacaacaccacaccagcaaagagtactaaaatataagctcaacaaaattggtttcacaattttaacttttaccaataatttcttacgaatttcttaagagctagaccacacaagggatacatatagctatttatatttttactgggaaaaccagtacaaaagttggtcattcttatttttcaacactgaagatcatgtttttcttaatcgacaaaaatttggttcactgaatttgcagttcatatgaattagttatgaatttttaaagcgcaaacctctttcagctcaaaagctatctcaaaaatcgatttctattttcactcccccttttctccaacttccaccggacttcgctcacatggcagcaacctggtcgtagggtcgtgcgaggctaaggcctcgggctgatggcaagagatggagcaaggcctcgggctgacggtaagagacgttgcctagggctgtttcaaccgaaatcaaaagagattaacaccggatgagctacagccacctcctagctgcaataatgtagatggatgacctgttgaatgttgctgtagatgttcaacatgaagggaactaaaaaaaggcaccatggatggcatggaagctcaccaaatggtgggaaacaaagtcatgttgctgctgcaaccatgcaggctgaaaccaccactctcttctcctatttcgatctctctcaactctccatgcatgtgcaagatgttgggatggatggaaagcttggatgatggggattgttgtggtctaacttgcagggattgatcttgggctattggatgggatttggggaggagaagtgagatgagagctcagcttgaggaagaaaagaaagaacaagcagtgaagatgaaaggggaggaagaagaaggggttttctctgccccccttaagtcctgaggtgggagcacgcccatgggtgtgttgtggggctaaagaggcacccaaggttagtgacaagtgggcccaagtcatggctgtctatgagggtgagagaggtgggtgaaaaactgagtacagattcgtttatgcaatttccaggatttattttctttccctctcttggtaaatataatttgactaggtaaaaatagttcaaaaatttaagggatttggtgtggtgatagggtgttgttttcttggttccatttttcaaagtttcactcaaaaaaatcgaaatattttaattctggggaaaagatgaaattggttaggctgaaagttggtttgaatttttaggaggcctaaacagagagtaaaaaatccacaaaatttatatttgttggtgataaataaactagtatttgaataaattattacacatgtacacttatgttcaagttattattcaaatagaagtggtttcaattttaccgattagagttaattttgttatcgcctatgatcaaattgcaatatagtaaatatgaaatctaaaggacaacaaatgcacttctaaatacctggttatgaatgtagggctgttacaccagatggggatcctctagagtcgacctgcnggcntggtngtattgtatttcatacaaatg

SEQ ID NO: 51726 - DNA, 1444 bp, Oryza sativa
  unsure (1)..(1444): unsure at all n locations
atgcgccatgaagatgagctnctnnnnnnnnnnnnnnnnnnnnnnnnnnnnnnnnnnnnntcctgcaacatctgaccaagatcatccgcagcgtctttatcgtcagcatacctgtccaccttgcccgtttgatttccttcaaattcagcgtactaagcccagtccggaatgttctcgtcttccacttcatcttcttccatttcaaccccttgctcaccatgggatgtccaacaattatagcttaccatgaaccccgactcaaacaagtggatctgaatagtcctgaatctagaatactccttctggttctacacttattgcatggacaacaaataaaacccttatgcttgttagcttcggccactctcaaaaaataatgcacgccatcaataaactctttggaccgccggtcagcgtacatccattgccgatccatctacataaaatgaaaaaaaaaatcgtacataaataaattttcgtacaataatgacagtcatacaataatgataaaataattaaaaactctttcaacagttataaaataatgacatatcattattcatacaataattataaaataatccaacaaacaattcttatttattatttttgaagttttaaactaatattaatgttgtacttctttgaattttcaatttagtttgttttctattttttaagattaattttcattatattttaaactatgagttaaaaactctttcaacagttatacaataatgacatatcattattcatacaataatataaaataatccaacaaacaattcttatttattatttttgaagttttaaactaatattaatgttgtacttcttttaatttttaatttagtttgttttctattttttaagattaattttcattatattttaaactatgagaataaaactttcttaagtaaacaaacaaaattcctatatattcttcttccccacacaaattttctctctcatcaacttacaacaaagttttggagacaaaaaaaatatgtgaaacattgctcccaaagtatataacaacaaaaaaaacattggaggatgaagttactaaccttctatacacctccaatttatatataatcaccaaaaaaatttcacaagaaattttggcatgacctcccctcttttttgaagaaattttgaagcttgctcgggctgaaggaggaagaagacatatataaaggggatctttagttccagttggtgttaccaaccgtctgaccgatcaaagatggtttctccactggtgttactcctggaacttattaatccacaagctaacatttaatgaattaactctcttagctacagaaaaagttcatttgacgttctaaacaatattttcctaacttctttatattacggtccccttcaaatttaccaggcgcatttttgctttgattaaagccacaagacaaaa

SEQ ID NO: 51727 - DNA, 3924 bp, Oryza sativa
  unsure (1)..(3924): unsure at all n locations
cgctgcgtttgaaatacnanctccgtnnnnnnnnnnnnnnnnnnnnnnnnnnnnnnnnnnnnnnnnnnnnnnnnnnnnnnnnnnnnnnnnntattgtaatgttatctgaaccttcgctatctctgatgtggatcattattcgcaaaagcgctactgtggcgaaacataattgatggactagtgacgtcattttggtaatgacggcgcgggtcgtcacaatattcttactctataggaccgaaatcttttgaaaaatattatttctgtaaaaatgtatttaaagccactcataagtcatcacggaagagagagcgggtggataaataaggaacgagagggagagagaggggagtatgataagtgggctctattttatttattttattttattagaaaaaatgctcgtgcattgcaacgggaaaggctattttaatcttatttttgttatatggtttagttaagatgaaattcactgtgttaaattcgtttggatatatatattgttagaaaatcatgatctgcaactaggagtctgatcttctcaaattagcatgcgaatttttttaaagagatttcttatacgatttcttctgtatttccaaaagcgaatgaacttaaaaaccaactcaaatatggatttgtatttccaaaaacgaacgaatttaaaaaccgacccatacacaaatggcgtaccaaagtaccgataaaaacatcttcaatttataatagtagagaagagatataagtagtagatagatagagaataacaaattaaaaccgactcaaacacggatgacgaaccgtaggagcatcttcaatttttataatagtagagatttgataaatgggatgccacgtgtacaccacgtcaacagatactatagtcaatattgctctggaattcaaattataccgtttttaatagtttaagatcatgatatcgggtattacgtactctctctgtcccaaaatataacaacttttagccatcaggatttatcccaaaatataacaatttctccagcaacattctctttccaaccaatcataacccaataagagcaaaatggaaaacttgtcgtgaaaaattttctccaaaaatttgaaatttttgagtatgttacaagcatttagctgttctcttcccaaccaaatacaaccctccaccattgacttgttccatatacctccactactcatggaatcacaaccctccaccattcacttataccctattttcttaataaccgtatcccacttaaaaactttttatattctgcgacggagggagtattatagttgacaaaggtatattcagggagtcaaagtggacttatcactgcggctttgataaatccgaagtggactggaaaccgacaccgtgtgatccgtgggcgggcctggacttgttctccttgtcggattccagcccatataccacatcacaggcgcaggggcacagagcagggcgacccgtcgtataaaaccctaacgccgccttcaccagctctctcaccccagaattcccaaattcgcaacgcacgcacgacagccagagagagagagagagttagaccgccgacacccgacgacaaggccgtcgcctccgcgtgggccaaacccggctcgtgggccctcgccgccgaggagcaggacgacctgcccccgccgccgacggccgaacccgccgccgacggccccaccctcgccaccggcgacaccaccaagggccccaagaagaagaagccgcaaccccgcccgctcggcgagttcaacagcaccaaggacggcgcccccgcctaccgcgggcccacccaagacgaccccctcagcccccccacaggcccccgggagcgcaccgncgaggagctcgccaacgccacgcgcggcttcggggctcgctggggcggcgccggcgccggtggcccccgcggcgacgacgagccccgccgcggcggatctggcccccaggacttcggcccgtcgcgcgccgacgaggccgatgactggggcgccggcaagaagccgctcgagaggagggagcgcatgggagggtttggcgtggactcttcgatgtcgcgtgccgacgacgtcgatgactgggtctccaccaagagggcggcagcccccgcgcccatggagcggagggagcgtagcgtggcgttcggggccgactcgcattcccgcgctgatgattccgcgagctggatctccaacaagggctattctgcggcgccgccaccgccctccgacagccggaggggcggtccagtctggggtttcaacagggatggaggcccagacgccgactcttgggagaggaggagggaggaggtgagcggtggtggttcaagcggtggtgcccggccacgcctgaaccttcaaaagcggaccttgccactggctaatggcactgatggagaagggaaggaggacaaggaggaggagaagggagagatgcagcctaaaagcaggtcatcaaacccgtttggtgcagcccgccctcgcgaagtggttcttgctaccaagggagatgacgggaggaaggaggaggagaaggagaaagaggaggagaagctggagattcaaccaaggaccaggacttcaaacccgtttggggctgcccgcccacgtgagaaagtgcttgctgcgaagggtgaggactggaggaagattgatgagaagcttgaggccatgaagatgcgcgaggcaccaccacctgagaggaggtcctttgggaggagaggttcccctgttagaggagaggacaatgggagccgtccactgccagagagtcatgtcgagggagcttggaagaagcctgatgcagttcaggctgttggagaatccgaagatgggtctgataagcttaacacggctgaggctgcgagaaaatttgaagaagggtttgataactgaacttttatccttcttttattcaattggctaattcatcatcgattgctccctgttattgaattaatagttaattgatctctgttaggtactagtagtttttattgatctcagtacttttttgtctgaggtatgctttctattgctagggtggaaaccaaatattgagcctgttactgtgtgctatctgcttttcagtatgtgtccctctagattcattgtcaagtgcatgtcctagcagattaccaattagtatgcagcgaagctttatttttactggcttcattaataaaataagttcctctcttactagtcaatttagcaacagttttattaagacaaattgcattcatataaacatagtggttggtatggtaatgtttaatttgattattgtttgtcttttgctgggaatgttttgtttgccagattttaagattatcattgcagtgaattgaagaacattgtttgcttgcttgatgtgatatttagacatgagccaaatacccgtgcattgtaacaatctagcataaatatatgatttcaaattgaatagttcacacttaattctaatacaaacgacgtgcaaatgatacagttatgcagagaagattgttcagataaaagaaaaatgaacacagttatgcatagtatggtggtggtgcaaactcatttccatcactgctagcttcttttacaatatactagtaaatatcaccctgtagttttggttcgttacatgttcttatggtctcaatatgacaaatgcttagccaatagccacttaggtagttggtgttgttctccatttgttccacaatctaaattacaaaaagtttcttgtctggtgtttatgctccttttcttttggcttcaaacttatgtacttgagtgctcaaattcgtgttgtgttgggttgcaatctaattnnnnnnnnnnnnnnnnnnnnnnnnnnnnnnnnnnnnnnnnnnnnnnnnnnnnnnnnngtgaagagagacatcatccacg

SEQ ID NO: 51728 - DNA, 2254 bp, Oryza sativa
  unsure (1)..(2254): unsure at all n locations
aatattccaacaggagtatcttatgagatttgtggcacaactaaaggaaatggtcaaccggtcaatgaaaataagaatgcgctctgtagcgcatccgacacagcattggaaaaaccagaagaggacgggtgaaattgaatgcgaaggagcttttaagaaattaaaatagangggcagcaggtgtgcaataaaatataagaaggaagactttatggcgnctgctgttcatgtttacagtggaattggggatgcgacgtgcatagaaatccatgcgtgtaagcaagcaccaggattggggcagcggagttaggatttacaaagttggtaattgagactgctcattggaggttatcaaaggagcttaacaggtcggtccatggagtgatgatccaagactcaaagtcattttgaaggacttccaggattagaagctgaggtgggtacatcgtttggcaccaggtggatagtgttgtcctcgggtggctctatggttccatctctgccgatcttctccaagagggcgatgacccacgtcaccactactcggtccgtctagcatgctctcgaactccagttcttgggcaacagcgagcagcgcgccctcatgcttgaagctgaattccgcaccttccatcaaggcgatctttcaatcaccgactatttgccacaagatgaaggccatggtggacactctctgtcgacgggggtgttagcgaccaaatttggtaattcaagtattggagatggagataaaactgaagcagaatccaagatagagatcgttccggaaacagagtaagaattggctaaagtccgaatcagctgcgaccagaatcggcagagttcgagtcggacaaggttagccgattgagccgattccgacaatgtgactcggtacacgttgtcgggttgagttaatgtgcttcatatggattgccacgcacggattaagtcctgaaaaaggcaattgtatctattagttaggatattttatgtaatttccttagaaataagtttgggcaaaagtctgccgcaaagacttatggtattttagagtttttttagagataagagtcatgtccgataaggacatattttgtatctcgggtataaatatgacccgaacccatgtaatcaaacaacacacgttcaatacaatctcggcgcatcgccacccttttactttcgtttactttcgacgagttcttactttcgggttgagttgcatcggtttcgatcttcaactagaggtaaaacttgttatggcggcttgcgttctcgggattagtgctttcatctttatgatactctaatcttgtttatgtaattcatcgagttatcatatatcttataatactttgacaatattgttatttaactttcaatcggccaacatccatcattggaaggcagccgattaggtttaatatcaatgttgacttagattatataggatatccaccaccctatgaaacattcaaagccttgattgtctagatattgtccttcttttcctacttatagctgcatcagttgagtttgaccttataagtcgtgattagaatcttaatctctggcctgcttttgagttgccgattagggtagcattagagttccagccgatcttacctgatttaactattttatatcttatatgcctgattgacatgttaagtccgccctttatgctaagatcttgtcgcatataggtatattaagcttcatgtttgatatattttgcctgctttaatatcttaatatagagtagtatcggagtattagccgatacatgctggatctatttgatcggctatgctatgaatgcttataatttcctcgttaatatatatttcgatttaagtgatttatactgtctcggcatggcgaccgatctatcccaatcacttgatttaagtatatatcgacggaagtattatatatcattaataacttcagccgatcgaatagatttagttctttttttacctatttatgactgtcgatcgacttaaatatgacatcggctcaaagataaatgatacgtcatcggcgactgaccgatcggctatcgtttatagatttaaccgctatttttcctgtctttgttccttgctgattgcaggataaaatcaactggcacgctcacgaacctaaaggtaagatttttnnnnnnnnnnnnnnnnnnnnnnnnnnnnnnnnnnnnnnnnnnnnnnnnnnnnnnnnnnnnnnnnnnnnnnnnnnnnnnnatccagcg

SEQ ID NO: 51729 - DNA, 884 bp, Oryza sativa
  unsure (1)..(884): unsure at all n locations
cgtatataggtaagattaataacctttcggtagaaacaaagcatataataaatcccaagtcttatttatnacataattcatagactggaccccttcttattctccattggaatatccaagcgagtgggtatgtggtatccataatatccacacacttatccattatttttcattacactataacataaatgtttttttacatatgcggctaaaatgttaagccgcttgtattaatgcctaagctgcctcaacctcagtggccacttttgcaaataacatttgtagtttacacgggtggagaaacctttattagttccggatggtaacccccttagtcccggttctcaaaccggaactaccaatccgggactaaagatcgctatcattagtcctgggtggaataaccgggactaaagatcgatctttagttaccggtaccaaccgagactaaagatcgatctacctttttttttatttgcatggccctgttgctgcatggtttatatatatatatatatgtgtgtgtgtgtgtgtgtgtgtgtgtacacatatgtatatatatatatacatgtatatatatacatgtatatataaatgtatgtatatatatatatatattacatatatacatgaataatatatatatgtatttatacatatttatatgtatgcaaatgcatatggatatgtgtacaaaatagacatatatgtatatattaaagcacttaacattttatgtgcatatatgaccaaaatatatatttacagtaaagtaaatgtgtacatatataaatatagannnnnnnnnnnnnnnnnnnnnnnnnnnnnnnnnnnnnnnnnnnnnnnnnnnnnnnnnnnnnnnnnnagtgcgtcaatcaaccacn

SEQ ID NO: 51730 - DNA, 885 bp, Oryza sativa
  unsure (1)..(885): unsure at all n locations
tttcacaaaacagttattttttaaaattcacccaggtcactggttttattttatttgaatcaaatttggaatgctttcatctttttaatgaagatgcaaaacttgtgagatttgtgaaaggttatttcaagtctctaccacttattttaattagttttttttgttatgtttattgcatgcaaatgcgttatgaggtgcatgaaaaatccaagaacaccaaaattaacttcaaatgacaaggacaagatcaaaatcaaatttttgctaagttttcttcattttcttttttttaagcttcaaagaattcttggtatgttacaattccgattatttctcgcattgttaaattaagatttgctccaggttaaacaaaacattttctttgggcgatttattgatgaattgtaaactaagggaaaggggaaaactccgggtgtgacagctaccccgtccaggatcgctccttcatcctcaacaccctcaacggtttgagtttgacaagacattcagtctagtcatcaagccggccacccgtcctgttgacgaaaaatccacgctcggcagatagtgccggaactatattggcgtgaactaagtcaacgaacacaacagccgaggagatctccttaactccaatgcaggtccaaagatagatgagatgagggcgtactagttagtttgatccaacaaccgtcaacatgtgcaaacaacagatgaaatagccgatcggctgacaagccaatggagtaattctagccgatgctgatactagccgatgccgataccaactaatgtcgatagnnnnnnnnnnnnnnnnnnnnnnnnnnnnnnnnnnnnnnnnnnnnnnnnnnnnnnnnnnnnnnnnnngtcgcatctagtctcgcg

SEQ ID NO: 51731 - DNA, 879 bp, Oryza sativa
  unsure (1)..(879): unsure at all n locations
cgtggagggttagaccnctnnnnnnnnnnnnnnnnnnnnnnnnnnnnnnnnnnnnnnnnnnnnnnnnnnnnnnnnnnnnnnnnnnnttccgtaatatacaaggaaacgtaacacccaagtcatgatctgttacatgttccatatatataagttatcccctataactagtcggataaccatgccgtgtgggtatggggtacccataatctccacactatctattccaggcctncccttctactcccggcccacctttttcctcctcttccgcttgggccgcccctaccctatcccggtccagccgacctgacgccccaagccaccttcctcctcttcctcgcgcccctctgcacgtgcggcgcacgtgcgcgcctcgcgccggaccaatgggtacacccacccggtcgtcttctaccttccagccggctcctctctctcctctcttccattaacccttgcaccaatttcttccccgaatccggtccattcatgccggattaattcaaattgggtagagaaatggaatccacatcccttcctctctagttcccctaactttccccatttaattccatccccaatcgccgggatttaatcccccttctttgacctcttccgtgactggcacttccttcttggcctataaaacgaaagtcctcatctccctccgtacattttggtccctttcgagtttttagccaccttcacgccggcttcttttcacttcctagcaccggncgacttcaacacgccctggcgccgngtnagttaagccggccggccgtggcattcggcttcccccggnngtggaggtcggccttccctttccccggcattgctcttcgtttnccggcggagaccttcgcaagtgctatctct

SEQ ID NO: 51732 - DNA, 1754 bp, Oryza sativa
  unsure (1)..(1754): unsure at all n locations
gctggatgagtttacgaactnnnnnnnnnnnnnnnnnnnnnnnnnnnnnnnnnnnnnnnnnnnnnnnnnnnnnnnnnnnnnnnnnaatttagatttatcttgtgagaattatctcatggttagtttctaaatagcatacgggattattgtctactataatcaactaaaatatagtgattgctttggtgagttataaacactaaagtagatagtaattgcttagatatagtgttcagacagttgttatccagtaattgctgcgtatcccacagtatgtttgaggtgggtgtagaggtggtgacagccctcgagatcacttaagtcctctctgtccgggtacgtagtagagcgacatctaggaacaacgggttgccagtgcctgaagtattgcatctaggaacagcgggttgctagtgcctgaagtattgcgttaggattaaaattaagttttccctggttggtgtccttggatgaactggaggaagatctgaccacacacgttcccttggattcgatacccttagaatactccgtatggagaagtgctacatcggtatatccgtgcgcttgcggaaacacttcgcgtgcacgcgcggcgggcgcggacggcaacggggcccgtgcgggtcaacggcgggcgcacgcgacgacgacgacaagacggcaccaccggctccgcttgcacgcgctacgggtgcggatggcggcggggcccgtggctcagcagcgggcacgcgcgacgacgacgacgatgaggcggcgccgccggctcctcgtgcacgcatggcggggccccacgcggctctcggtggcgggcttgatgatgacgaggcggcgccgccgactccgcgtgcacgcgctagatctcaagcatctcctactctctttcttctccatggctgctacgacagcaaagtggtgtggttgtgatgttgaactactggttccagtctcttgatgatttctctcaagcttgagttgaatccccagccaaaccactggtggtggctgctattgctaatgttctggtagttgaagctgttgcgctactaatttctccatgccgatatagccagtgcttgagttcttgctctctcctttctttgatgtcactctctctctctctctgcgcgcgccgccggctccgcgtgcacgcgcggcagcggctgattttcctacggatggtttctatggctgtaactactaactagtactactgcannnnnnnnnnnnnnnnnnnnnnnnnnnnnnnnntgcagaagcgggcgccactacgacgacaacgatgaggaggcgtcgtcggcttctgatgcacaagcaccggaccgctggtgcttgtcgcggcggagcccacggcgattattgcaattgtgtaaatcagggtttttccaagcggacagtataatttgaccgcaccgagtcatcgaataatccgtgcagccaacttaaacccgaccgtacgggaaaatgaccattccatgtgggtgggtcacccgcacgcgaaaatattgatttttgcagacgtattgttgatacaggcaagttcttcgcacggaaaaaatatattgaccgctccgtaaaaagcgttccataacaatgcgcgaatcccttcaaacaggctggtatggccaacgttttttgttgatgtcacagaatcaacctccatagtggactcatgcctgggagtcaagcgcgtagcccctaggagcctgcccatccttataatactaagcgggtctacacttgtggtgctg

SEQ ID NO: 51733 - DNA, 934 bp, Oryza sativa
  unsure (1)..(934): unsure at all n locations
gtggattgttatcgactcccnnnnnnnnnnnnnnnnnnnnnnnnnnnnnnnnnnnnnnnnnnnnnnnnnnnnnnnnnnnnnnnnnnaatctaagaaaaaaaatacatttttaggggatgaaacaattcagcaaagctgcaagagacctcattggtcagcttcaaaagattgatggtgataactaccctgaggtaatgccttggatgcacaatatattggttgtaattctgcagaaaattttgtgctggatttattaaagttctcgccgcatgtaattgtttttgcagacattgtgtcgaatgttcatcattaatgctgggccaggattccgacttctttggagcacagtgaagagtttccttgacccaaagaccacagcaaagattcatgttagtgttcttccaatactttgtctatgagtgctcaacttgaagattgattatcaataatctgtgcatttctttaggtgttgggcaacaagtaccagagcaagcttcttgaggtgatcgatgctaggtagaacacctgatgctctaagttaaccatcatattcgaagacaatgttcaccattttaattctattaatttatgttgtctagtgagctgccggagttttttggtggaacttgccaatgtgaaggtggttgcatgaaggctgacaagggcccctggaaggatgctgaaatattgaaggtgactgttccaatctgaacctttattatccttgaacaaattcttaaattacaattcataagggacaaggaactcaaaatttctatgctatattatgtttagatggttcaaagcggggctgggtggtgtggaaatcttagtttgaatcatctggatgctgannnnnnnnnnnnnnnnnnnnnnnnnnnnnnnnnnnnnnnnnnnnnnnnnnnnnnnnnnnnnnnngttctcatctcgcggg

SEQ ID NO: 51734 - DNA, 1504 bp, Oryza sativa
  unsure (1)..(1504): unsure at all n locations
gactggtttganagtcgacgctccnnnnnnnnnnnnnnnnnnnnnnnnnnnnnnnnnnnnnnnnnnnnnnnnnnnnnnnnnnnnnnnnnntcgttgtggcgttcgtccctccgtcaagccgttctcgtccgccgcccgcgtttcgtcaagtgtgcagcagccccgtcgtcgtcttcgtcctcgcctccgcgtcgtcaagcctcgtgccggccctgtctcgccttcgtcccaggatcgccgccgaagtcattccctcgccgtccgccacgcccgttcgtcgttgttgttcccacgcctcgtcgcgtggtggtaaggatccgtcctctcgctgccctgtcctcgtccttttggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttccaggctagcgcttcgacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagtcttcgtcgttccggaggttcccgaagcgtggttttcggtcgtcgccgaaggttcggaaggccgttctctctgagcaaggcaagtcacatcatccttgaacatattgaatcccagtttataaaattattttgatttaaattattgcattatcgctttatttaaattcccgcgttatcactgttttatttagccatgcctatttacctttgttatgaccttattattattgctattgttattattaccttgttcaccctaggaaaacaataccccaactagtgggtactctattcatggttccactagtatgaatttaggtagatgcttcgctgattaaataggacaacattaggtggtttttataactttagactttgggaattctcatatcatttggacactatggaatggttggcttatggtggaattggacatacacctctcttcctttttcaaaacccctaaaacttgtttccggtgggtttgggtgcatgccagtgttggaagtacaccccggccattataagaataagcttggcctcttgtggaaaagactaccgtacttcacatgctaatgggtaagcttaattggggctcaattgttataacaaa

SEQ ID NO: 51735 - DNA, 1988 bp, Oryza sativa
  unsure (1)..(1988): unsure at all n locations
cgcctggattgattgacgctcttcatnnnnnnnnnnnnnnnnnnnnnnnnnnnnnnnnnnnnnnnnnnnnnnnnnnnnnnnnnttcccgacgtgacaatgtgtctgccacctatttagtttttgtgggtggatcttacaatgttttactccggtgaaaagttgcacgttatgtaaacatgttatgttttacttgatcaccagaaaggataacctaagagaataggaccaggcaaaatttacctatctttaatgtttgtaaaacaatccaataatctactcatctcagcgtttgtcttcttcaaattaatggttgatgtagcaatttgagtttaaatcgattaagtttcttaacactcatatggttgatccataagatgacaacatcaaaaagcatcaatcccgcacccacaatgtgcaaaaattaatattaaggcagagaagctcagatcgatcaattgtagcaacacaggaaaaataataaatgaacattatatgttacacatggaatcgtcttttgccaacgatgaaaacatcacctcttgatcaaacccatggtatttgttcttcgcatattaccaacgaaacaagcgctgcaagtgaaatttcaaatggcaaagttaaatttatgaaatcaatgattagaaaggaaaaacatttttttagcataagtatatagtagatgagttcataaagagaacaagctacactaattatttggtgagaatctcatatattttggtacaccggtcagcgacaagtgcaaaactttacttcttgtagttgagggtcacaacacagcagcaaaaggatgccttttaatttcccttttttaccttgcttttcttcttctttttcttctcaatgtatgccatgatctcctcttgccgctcaagagtctcctgcaaggcctgaaaaaaacatataatatgcgtgttttagaaatggtttagtaagagtagtagaacaacatgtaatttgttagtctcaatacatttaataatacagatctatgggattaatgtaataagaatgtgcttatcatcattaaggtgaaaacagacaaaccttcttggtcgctgcaagttcctcctccaatgcactaacacggctgacggcagtctttagcatctcctctttatcagctggcatttctgcaggcttggtgagaatcgcaatgaccttctcctcaatatcggacaaacgctttgtagaagaaacatattcagctactgacacagcctccactgatatctcggatagttgttgtgcttggattttggatgtactttgtgccccaagggtagcaccaagtaccttctttggcatgttgcggctaacacggagcattgttgcaatgctcatgacaagagccatgatacccccatagagtggaggattggatccattagaggcatttacaatcgctgcaagaaaaagattatccaatctgttagttaaaaactaactagagagtaacaatattaagtcacaagattattaggccgcaaagatgtttaacctttggttactgtgacattctcatctggcaatcccttgctctggcaaatggcatctatggccttctctaccattggaacatcacaagaataagctgatcctagggtctgcattaaaaaaactccttttatatgaggactaagcttagaaagtatttagaaaagaaatatatgaaccactacaccacaagaatgaaaatttatatgatgactaaacttgggaagtatttgaggttttacacttttcctagaactgaaagatcatcacaaagttacttgtctgtgcatatctatcgcattatcaactgacgagcccacttaagcttgtaagttaagactcaaattttttttattctagtttgtctagggagattgaacctctagtttcatccataagacgtgagaaatattcttttagttgtatggttcaacactaactgcaaatttgtttgtgcaaaaaaaacacactt

SEQ ID NO: 51736 - DNA, 4303 bp, Oryza sativa
  unsure (1)..(4303): unsure at all n locations
cgcgcgattggattactgnnnnnnnnnnnnnnnnnnnnnnnnnnnnnnnnnnnnnnnnnnnnnnnnnnnnnnnnnnnnnnnnnnnnnnnnnnnctttgatcaatgtggcacttggcagcaattgagcaagctgggaacttaacagcaaagttcttctcaaactccctgacatggttcttgataaaacgatccattgtggtaacctgcattagcctattgacattgatctgcccaagacgttcaatgtagacaggccttccttccttatcaaccccatggtaaccttgaggatagcattctgccaccttgtcagcttcttcaaattcaaaatcctgagataggatttgaagaaaaatgtgtcaactgcttataaacaagggtatgtgtcaaccatagaaggattagtccaaatatattttaatcttaagcaattacctcaagaatggtatctgcagcgaattcctttctccactgcagcatatcaacccacatttgctttgccttctccacatcaaactttcttgccttcaaaaacctatgtaatctcaaattttagtaatacttttttcacataagaaactataaataacaacatgatgtgctattttcagattatacaccttagcatcatgtggtagtcatcatggtgagatggtagcaactcttcaagtacaaggagctgacggaaggcatctacagcctgcacctcctcaggatcacgttcatccgcaattgagatggatatgaccttgctactcctcctccccttcttcattgaatgccttaacttttgtgaagcactcattgccttcttcttcagcgatatgattttggctttcttctcatcctctgagtattcaacattggatttcctcttctcttcatagtgaccatctaaggttgctgacacatcgtgtatgtcagttggtcatgtatattccaatataccagattctaaatattttctaaatagttaagttagaaattaattctttgatagtgaagcgggagaataccattgggaaaagggcatacgctttatctgaaaataatgtttatactttgagatagaagataatataatgattttttaataaaaaaatacacattattagggtgtaataatccactttaaacaataagaaaatggttgtgacaattatttgctttacttacgagagcttagacggtgttcaagaggtcttgataggacttctgtcatgactgttcggctctatctggacctgaacagttatacacattattatttgattatatcacatgctatgtctcaatgtataataaaggagaaaacgaataattttctaaatatcttgatgacctaaagtattgcttggcagtacgatgcagtgtaaaataagacaaaaggtctcagtttgctgggaattttttaatgcttgagcagtgggcctgtgagacactaattagcctcatctcatggtatatatcatagtccatcagtataattataagtttagtaacatgtgttccttttctggattaacaaaaaatttataaaatacacatataaattaatgataacgttgaaacaccagatgataaaaacctacaggtgcctgagattgtgcttgaagacacaaattcaacacattaatttacagccaagcccaaaattcacaagaacgcttgaataacacaaaacagaataaatttcgctaaaaaaatagcagaaaagtaatctaagtggaagataggtgttatgatctggaataatttgaataattcttgcacccattataagtcatgacatgcaacacaatcagaaccatcaaaaatcaaatgaagaaattataaaggcccaaaaaaccacaatgaaccaagaatgtaccaaatcctagatccccttgacaatccctggccgaccacccaaagaatccaaaatacaaataagcaactgcctccgatgtagattttcccaatcttatgaaattggagcacaacaagtattgaaccaggtagaaaacaaagtagagcctctttatcctcagtccacatgggaaaagatgtataactgatgcttacattttatcattaaataaagaacatacaatgccggagcaacacaattattactaatgtccataggaagaaccaggatcaaacaaggaattggaaagaaaatcatgtagtggtggaagagaagagcatgcacgtaccaccaagaggaggagcctggatgtgggaaggggaggaggtggtcaggtgggtgtgggggtgggggcagaaatggaggggcagacagaaaaatagactcatcaatggcgcgcattccccgctgccaaacaaggagagtaccataggcaggacatctggagctggcgatcgatgtttctgttctacaattatgacatgtacggttttcttccaatattagataattagaccaccaaacccttattagatgtgtccttcctgtatagaacggtttgattttcctattaatagaaaagacataatttttttgacacagcataatgttttctgtaactacatttttattgtaacgtgaaaattttgtcatgactcatgcagccatacacctacatgaacgagtatttatttatacatgtatatctaaatagatgtttttttaaaaaaaaatcaaccatgttattgtatatatcgtatatatgctcatgctttatctctcactttttttatttaatctttattagtagctttctgcaatatatattatttttatattgatatgggtgaattgtgtgtagtgcgtgaagatgtactttttgatgtattgtgttccgcaactcatacacaacgacactaattaaatgctaatatttctaaaaatccaaatggagtgcaacccaatttttttccagaaataaataatccaacaaaataaataccaatcgtccagatctaaaacaatttttattgggtttttttctcaaaaatattttcagtgtcatcgcaatgaaatacttcactgggtcgtatatcaatcatccatgccctggtgattgccccaacaaatgcttactttcaaaaaatgacgggcaattaattggccatatgcaaatatccatggctaatctatgccataattgaccactagctaggcacttatccacttctaagtttcaaatgatagagtggaatggaaactgggataaccccgcaggggatggcagcgtttatggagtgctggtattccgtataaaattaaagtgaatggccagcgattaatttaaaatgggctagcacttggcttagagttgcagagaaggaaaatcaagacaggggtaagatgtttgttctgtcaaagggaagaaaatgttgtccataggttttgggaatgcccctactccaggtgggtttggagtaagggggaaggaaagctaggcgtcaacttcttggtgccaaatgaggaatacaacaactataaaatgtttgccttgtgggtgtttgacagacttatggatcaagcagaccatgtaatacatgcagtctttgtgactctacataacttatgggctgttcaaaaagatggacgccatgctcagatgccagagaatccaacaggagtagctatgagaattgtggcacaactagaggaatggtcaaacgtccatgaaaataagatgggcactgtagcgcatccgacacagcattgggaaaaaccagaagagggacgggtgaaactgaatgcggaaggagctttttagaaaatgaaaatagaggggcagcaggtgtggcgatgagaaatgagaagggagactttatggcggctgctgctcatgtttacagtggaattggggatgcgacgtgcatagaaatccatgcgtgtaagcaagcagcaggattggggcagcggagttaggatttacaaagttggtaattgagactgctcattggaggttatcaaaggagcttaacaggtcggtccatggagtgatgatccaagactcaaagtcattttgaaggacttccaggattagaagctgaggtgggtacatcgtttggcaccaggtgaatagtgttgtcctcgggtggctctatggttccatctctgccgatcttctccaagagggcgatgacccacgtcaccactactcggtccgtctagcatgctctcgaactccagttcttgggcaacagcgagcagcgcgccctcatgcttgaagctgaattccgcaccttccatcaaggcgatnnnnnnnnnnnnnnnnnnnnnnnnnnnnnnnnnnnnnnnnnnnnnnnnnnnnnnnnnnnnnnnnnnggtggtacaatcntccac

SEQ ID NO: 51737 - DNA, 1160 bp, Oryza sativa
  unsure (1)..(1160): unsure at all n locations
nctagatattgtccttcttttcttacttatagctgcatcagttgagtttgaccttataagtcgtgattagaatcttaatctctggcctgcttttgagttgccgattagggtagcattagagttccagccgatcttacctgatttaactattttatatcttatatgcctgattgacatgttaagtccgccctttatgctaagatcttgtcgcatataggtatattaagcttcatgtttgatatattttgcctgctttaatatcttaatatagagtagtatcggagtattagccgatacatgctggatctatttgatcggctatgctatgaatgcttataatttcctcgttaatatatatttcgatttaagtgatttatactgtctcggcatggcgaccgatctatcccaatcacttgatttaagtatatatcgacggaagtattatatatcattaataacttcagccgatcgaatagatttagttctttttttacctatttatgactgtcgatcgacttaaatatgacatcggctcaaagataaatgatacgtcatcggcgactgaccgatcggctatcgtttatagatttaaccgctatttttcctgtctttgttccttgctgattgcaggataaaatcaactggcacgctcacgaacctaaaggtaagatttttggaactgcactaaagttaagcagatcttccaggcctcgtgtttttcgcatcaacacgcttttggcacacctggtgggacacgacaaacatgtcagcagaaaagccacctctgccatcgacaggcaagtcgtcagaccctcaaaccaagattccaaaaccgactgggtccgacgttaatgaagggaacattgttccagtcactatagacaagttgtcaccagaacaaaagaaggattttgaattaatgatgaagagcgctcaggagcaattcatgaagtcgttcgtagaaactcgcgggaaagtctaccaaaagtacaaagtgaaagtagttgttgccgacaaagtttgctcaagctcatcccaaggtgataaaggcattgcaaattgctcaagcaataaaagggaccgccttcaagatgaaatggttgaagatcttgatgaaaataacaatgaagtgccaccacagtttaacaactttcaagacg

SEQ ID NO: 51738 - DNA, 10641 bp, Oryza sativa
  unsure (1)..(10641): unsure at all n locations
agcgcactcattgaaatacngtcanctcgtacccagccgattcttggctcaatgtggtgaagcatcggctgttgatgctttaagggttagattgtttcctttgtccttatccggatcggcatttacttggttttcttcttttgccatacaactctgtcaatagttgggccgatttggagaaacagtttcacagttatttttacagtggaatccatgagatgaaattatctgacttaacagcaatcagacaaaggcatgatgaatctatgcaggattaaattcagagattcagagagatgaggaataggtgctacagtttggctttgaccgattctcagctagctgatttgggttttcagggtctgataacttcgatcaaggagaagttttcatctcaggagtttgaaagcttatctcatcttgcacaaaaggtaaccctacatgaacaaaggtttgcagaggctaagaaaaatttcaaaaagatcaaccacgtatacccttacatgtatggttccgatgaagaggatgattccgaagtagcaacagccgagtaggtcaggagcaagaaggttgtgccatgtccataggtgagaagttctgggaaagaggaaagatttgattttgatatcaccaaggctaataagattttcgatttgttgcttcaggaaaaacaaattcaacttcctgctggtcatgtgattccatcgactgaggaactaggcaagagaaggtattgcaagtggcataattctggttctcacaataccaatgattgcaaagttttcaaacagcagatccaggttgccattgaaggggggaagattaagtttgatgattcaaagaagccgatgaaggttgatggtaatcatttccatgttaatatggtgcatacagctggaagatcagctgatgaaaggaaaactcgagcttctcagttgaattcaaccaggattatcaacaaatatcaaagaaggtatgacaagcagcaggagaggtattgcgaagaagatgatggcgggtttgatcctcattgggactgtgagttctttagattttgctggaatgaggggatgaggttgtcgtccatcgaagattgccctgggtgcagtgataacacagggagttcaagccgcccttacaatagaggcaatcggctgaatcagaagagggtgtccgttccctcaacaaggcactatccgttatattggatatgctcagacgcccatgccatatggtgaacacaaccatacccatagtggtcacatgggtagctcctatgaaccatcgctcagactagtccttactacaacggcctcccaatgcaaggttaaccagtaaccaacttaataagccaaggtcgccccataaccaacacatgtggtggcacggtaatcttagttggtgacacatagttcagtccttaatcgactcgggcgtacactcccccctatcgatgtgcaactaccaccatatgcacaccacttgccgcccaagcctaaaatcatcattttttttttcagatttcaattttcacaaaaataacagaggcaacccctccatacaatattttttttcaattatcccatttataaagagtaaatatcatgtcataagtaaccatcgggaatttctaagcatggctaagcaatagctatattagtagctcgaatatacccacggtggtgcttggatactaccacataaatacccatcctagtgcttcaacagtaaggataaccaatatatcaaggtaggtaatgcagcatataggtcatttctaccgataccccattttttttataaaacatcgcatgcaatttataaaataataaagcatttgcgaagatattggattcaacatgatcgaaggaggaatagaataggacttgccttgattaggagttactcaaatatctcttagtcctgcactcccatcaacggcaacaatcgattcgtcctctatttaaatttaaacatgcattcaaatgaacatccaataaaactccaagataaaatatgatgcatggtgcatgaacatgttcagtgtatagaggatgatttaatataaatttaggagaaagaatcgcctaaatccaatgttgtatgtgcaagttattgcatttctaatatctaatatacgataaaaacgaagtttactattcaaacttaatttagtgaaaattttcacaatagtggtgataattttgagtgtacagtcttcaagagaacaatattatgaatctaacaaattttggttcacctcaatcggagttaaaatgaattctctatgattttccaaagtttcagcattttatagtgcataaataattaaccgaaaccattttcttagatttattaatttgtttataaagaaactacagcgcactgccctgattacgttttcctacagggaaagcgtattcatgttctgtgtattcattttaaaaccgtgggtccacatgtaagtgtctcgtaaataaccctatactttttattatttacatataaatccgaggtcccacttgtcagtgtgtggctttttttgcacaaagagccctataatttaccctaattacaggacaagttccttcttcttcaacctacaggcagctcgattggcagaggcgcggtggctcgggaagtgctcgccggcgacgagcagcgacggggatggctcggcagaagggcggggaagctagagtggtcctttcgcacaccctaaaggcggaagcgtggcccgggaaggctggaggcggcgagcgccatggccggtgttggcggtaggttcgggacggcgacggctagcgcgctacgatcgacagcaattcgattccttcctaggggagggtctagggactacgagaatccttaccccgtgcgtggttggagtggagacggtccgaggcggcgtggcgacgagctccctaggcggtcggcggcgacattgggtggcggcggctcttcggtcgaggggtcctaaaatagatgcggaaatggatttagggagggcctatgatcttggtggcgcgaggaatcgagagggaactcaccgaggcgacggctcgatggtgtgggttcgcgcaggcgnctctgttcgnccggcgcggagcgtnacggtggcncgcccgttcccagcgaatcagagggtttaggtctttggctttgggagtgnaggttgagggtggtgtgaagagttagctggcgcgagggttcgatttatacgcgaggaaggagcgagaggcaagtgcggggaattgtcgcgaagtgctcggcgtctctcgcgcgcgcaggcggtggtcggcggggaacacggcttgcagcaggcgccggctttgcgcagggattgcagagggggtgcagggatagttacggggagccaggggcggtcggtctcgccttgtcgcttcgtgcgtcggctttggcagggggcggcggctccgggttggcgaggcgcgcggcgaggccggctttgccaggcgcagcatcggcggtgcagacgtgagtcagagggctttgcagacggaggcagcggcatcggctttgcgcagggaggaggcagaggaggaaggctgcgtcggtctggcttggtcggcatcgggcagagggccacggtgttggattggccacggcggctgcggtggtcggagcctgggcgtggcagggaatcggcagggacggcgtcggctttatgcagccttggcacagcgggattcgcgggcagagggtggcgcagtgtcgcgtcgcgtcgttgctcgggcagagagagggagagagggagagcaagagagcggcagctccagcaggggcggatctacagtgttagcatcggtgtcaggcgacaccgatgactttcggcaaaaccaatagttaaactgcttatccatatattataacacactaatataagtataattagcatgctatgacaccgatagacacattatgacaccagtgaatcaattttctagatccgccactgagctccgggttgggcgagccagcgagggacgcggcgaaggcagcggtagggcctcgggcaggggtgcaccagctttgcctcatctttgccagcgagaatcgtgggcagaggttgcttggtcggcttggaaacgatgacctcaatctcgcacgctaggtgctcgatgaattgcctgaaagaaatagaaggagagaagggagaaagacagagagcagggatatggggatggtggctggcaggtgggcccaatgatccttaggcccactgatcagagagataacgggagaagggatgaggtgaggggatttctctctgggtatttccaagaaggctgagagtttgattaatttttggatatgctaatgtgctcaaaagcttgtgctaaaatttctagaggttagtctggtcaagacctccacttggtaaattttggggatttttctcaagagcagtttattttttgaaaattcaaacaagttcactgtttttattttaatttgaatcaaattttggatgctttcatctttttaattgagatgcaaaacttgtgagatttgtgaaaggttatttcaagtctctaccacttattttaattagttttttttgttatgtttattgcatgcaaatgcgttatgaggtgcatggaaaatccaagaacaccaaaattaacttcaaatgacaaggacaagatcaaaatcaaatttttgctaagttttcttcattttctttttttttagcttcaaagaattcttggtatgttacaattccgattatttctcgcattgttaaattaagatttgctccaggttaaacaaaacattttctttgggcgatttattgatgaattgtaaactaagggaaaggggaaaactccgggtgtgacagctaccccgtccaggatcgctccctcatcctcaacaccctcaacggtttgagtttgacaagacattcagtctagtcatcaagccggccacccgtcctgttgacgaaaaatccacgctcggcagatagtgccggaactatattggcgtgaactaagtcaacgaacacaacagcccgaggagatctccttaactccaatgcaggtccaaagatagatgagatgagggcgtactagttagtttgatccaacaaccgtcaacatgtgcaaacaacagatgaaatagccgatcggctgacaagccaatggagtaattctagccgatgctgatactagccgatgccgataccaactaatgtcgatagggttttgagcaatcggctatatgtccaatgtatattctgatacttaagtaaataatgatatatagacaatcggttgataataatgtaattaagcaacaatataatccaatagaaaccaaccgactaataatgatatgatagaacaaatattgatccgatggttaaagcatacatcggctagaggtccggtgtcataaaatccaaatgattagataatcagttaaacctttgttgcaatcggcgaaaccaacttgtatgtaatcattataagccgatgcaacatccagataactcatcggttgaaaccccgatgaaaccctttattataatcaaagacaggttagcctttataattctaagtatgactagggatgatgcatcgcaaagtatgctaagaaacataaagtctaaacaatcaacctttggcaaattttcagggtggtggataccttagttaatctaatctagcatgataatttagccgatactagcataaaccctaagacgactctcaaccgatatgatcaaattaagatgctaaactagattaactaagatatatgataaataggtaggcaaaaatatcaaccgaaccagagcgatccaagaggttgaagcgatgcaaccttgagcaacactaatgtagctaatacaattgccagggccgacggaacataggacttaccccttcaccagatattgaaagctgatgcatccccgcattaggagccatgttccgccgtgataagtaaaaatctcggaaaagagagtgacgatgcaacgagagtacttgtattgatctgtaagatagtttacaatgaccctgggtgtacatatttatacacataggtagatactagtccttcttgacaagaaagaaactttcctaaagataaaaggaaaacataaagtccttagtggacaagaaacatactttcctaaagaaaaaaggaaactaacagattctccctaattaatagataaactctcatgccgcatcctccttgaattcattttcttctagataaacttcctttaattgattaatttccttaaccaaatatagcaagaatacaactattggcgacttgataattcccatcggccgattcaaggactctgaagccgatactgaatctaggccgaagatgacttcggggcttaccaaatttcactgttaacacatccgcactgtcctcagcctggcagtctcctgcagttggcccatcgactagcttgatgtcaagaacatgtcccttcattgcactctctaggagatagtctactgcatccagcctcccagcttcatcgactccactcggctagacatggtttgccgcctgaacaagttcctctattggtacaacaggtttgcggcattccttctgcccattggtttctctgagaccaagttcaacacttcactgtttgtccaccattgtgcctctggcatagtgtacctcctggtctacgtcgacgacatcgcactcactgcctcctctgcatagctcctccagtggaccatctcctctatgtagtttgagttctccatgaaggaccttggtgctctccatcacttcgtcggcatcatcgtcacacaacagacttctagccttctcttgcaccagcggtagtatagtctcaacatcctacagcgtgctggcattgcagattgtaaaccctgttccactccagttgacacctaggccaagctatcatccactgatggcgcgccggtggcagatcctacagatttttgtagctttgctggagcactacagtacctcacattcaaccgaccgggcatctcttattcagctcaacatgtgtgcctctacatgcctgatcctcgcgaatctcacttagcagctctcaagaggattttgcggtacatccgtggcaccctggatgatggacttcaaatctagcgctcccaggccgctgatcttgtcaactcgcaagtccacctccggctatgtggattcctggtcttccaagcgcaagaacattgtctcccactcgagtgctgaggccgagtatcatgctgttgccaatgttgttaccgaggctagttggttgcgacaactcttatgtgagctgcactcccctctatccaaagccacactggtgtactatgacaatgtcagtgcggtttacctctcatccaatcatgttcagcatcaacgcacgaagcacgttgaaatcgacttacactttgtccgcgagaggtcgccctttgtgatgttcgagtgttacatgttcctacctcgtctcagtctagtgatggtgaagccaatatagacacgtgatcaattaacagtggatcagaaaatcggacgctgcagaacgatcccatcatactctttctccacacgcaatctccttcgcaccaccatcacgtaactcctccggatcacgggtcatttaactatttgccacttttaaaatatggcaattaaggatttgccactcatgtgtctatgacatgtgggctctcatgtgtctataacgtgtgggccctcatatatctattgtcacgcccgaaaattcactagtaatttccgaacttatttgtgcataaaatcctcgtccaggaatcagccgaggtacacaaactgaaaatttaatatacaaatcaatcagttacatacttacaaaagaaaagaaaaacagcagcggaataacggactagcgatggtttcagctccactcacacatgcagctcaactagggtttaaaccaaacttcttttccttctagatcctttttcttcaactgaggtttgattgattattgcaaagtgagtacatggaatactccgcaagccacacaacaaatatgcaaacacacaagggtaccaaaggatggcataatataggctcatttgcaaaagcagcatttagcaaatatttgagaatgtaaaatagtagagtaattaatcaatgttaatcaacactgaacagcacacccatgctgctcaggcccaaccatcctgaacaaccatacccggctgtacagatctaactccaaaccagaagctaagcaaattattaccagttatagcatcaataattattgtgagaggtgtgagactaatcacgaaaaacattgctcaacccgcccatgaccgcgggcacggctattcaaatagttttactctggccagaggtgtaccactatacccacaagacacagagcctcaaaacatgttaccatgcccttagtaccaccacgatacctcgaaacgggattgtgacagtacccctcgcacaacacaatccaccacagaggcatggactccccagcgacccccacggacttctcaccacttcacagtctggtgccccgcaatgagccatactatacaaaaggtaaagctgttgcccacgctggcttgtggttggcacgattaatgtctcacaacagtagctcgtgaaccgatccttaattgtcatgatcacgaccttcaaaaccatgtgctcacaacccaccattatcaagttttaattatcaattaattatcataacatgattaaccatcatgagctaccatttaatataatcataaataataatgtagtatgattcatcccattaatgagctaatgtagctaagcatggctaagcaattatatatatagcatttagctgaaccaaaccaatatataaggttcgagctaatcaatttattatccatagaaaaataaagtcatcttcggtcataattatttgggaaaggctcaccacccgatgacattcgaaaataatgcataagttgaaatgaaacaatagctttaaatgggttcaacatgctcaaagggttatttgggatctttgtgacttgccttgcaataatcggtcttcaattagtcttcttgaatttttctgatgcactcatgactcttcgaaacgatggataacgacaagctaacacgcaaaacaaaaaaaactaataaaaaccaaataaataatacataaaaagtaaacaaacatgtagatcatgattttagatgaatttagcaacttgaaccacttaattccaacttcatatgaattaattatgaattttcgaagtttaatcagtttttcacctaatatagaaaaccattacgatttaaatttaagaatttatgatgtcatgatgacatcactaacaggcatggctctggaccacacaaccgccggcgatggaggactcggccgggccaactgagggcatctacgtcatgaggacgacgagaggaactcaccggtggtgacggcgacgacaatcgatgacggaaaacggccggcgacgagcttcaaaaggcggcgacctcgggtcatcgatggcggcggtgctccggcgggaaacggcagcaatagagggggggcgggcttcttctcgcttctgcgatcccatgggtggcgacggcgaacgaaggcggcgatggacggcgacgagcggcacggctgaagacgcggcgacggatgattgcctcgggttgacggcgacgatgaagctccgatggtttgcagcggcggagaaggggtggacggtcttcggcttggcgctgcgatgccgaagacggcctcggggtgaaccagcaacgaccgcaacagtgaggaggatcggctggagatcaaaccgaggcggcgaactcggccttcacggtgatagccgcttccggcgggatttggcggagggaaaccggtggccggggtagagatcaaccttgcggagcgaagggaagcggcggcactgatcgggaacggccgacgtgacgggaaaaggcggctggagatggtggccggagttggagagagaaggcgagcgtgcggaggcggctagggttagggaaaacttcgggtaacagggggaaaccgaagaagaggccgaggggctgctatttatagccggaagagggagagatcggctcgggaacggatggattcgatgaaggaagttaggatttatcccgagttcacccggataaaaaacgggccgaaattcatgggatagataacgaatttgatggggttttcttgggattagatagaggagatcgagaggaatccatttttgcaatcaatttcggaagggtagcaatggatgcaccggatttgatggaggaggcggcgcggcaacgcatggcacgggatgagatcggccggctagaggaggaggaagacggcactgtgcagagtgggccccaggtgccggagagaaagaaggaggagggacacaaatcagacttcggccaagggagagattgggccaagagcgagtgaggacttttcccaattcagcccgaaaaggaaaaaggaacttttaattatttttccaattaaactaatcattgaaatgatctttgttaaaatacttccaatgctcnnatnttgcngggtncgagcggtttgcatgtcatcaatgccca

SEQ ID NO: 51739 - DNA, 2982 bp, Oryza sativa
  unsure (1)..(2982): unsure at all n locations
ctttttccactcatttggaagaggtacaaatgaagcccggtttaattaagaaagggggcggcaaccgaatgccccgaattagtcggcggttaaagaagaggaaccggccttttcaaagtgggcccccagtcccgaataaaagaagaagagggacccatatcagccttggcccaaggatatatttggccaaaagcaagaagacctttccccattcagccgaaaagaaaaaaggacttttaattatttttctattaaactatcatttgaatgatctttgttaaaaactttccaatgctcaaataattcaagaaaagtccctgaaaatatttggacattcaaagtacttaacagttataatcagaccattcaatgactaatttaatatttacataattgctaaaatgctatttgtattattaaaattaggagttgagctccgaaaaatccgagaaaattccagagagtataattaatcatggagaatttaataaaaattaaatccagccatgctttatatttaaaaaattttatttcccacatttaacttcacttgtaaattaattaatatttaatataaattctaagaataatttattaaataatttataaatcctgaaacgaaattcaggatgtgacacactggtgacagtgtcagtgcagtttagctctcggccaatcgtgttcagcatcaacgcacgaagcacgtcgaaatcgacttacactttgttcgcgagaggtcgccctttgtgatgttcgagtgttacatgttcccaccacttaccgctcccgcatgcgatttgacgccgccctcaggacccactgccaggtcgccgtcccctgtctcctcgccgtcgctccgtcttcaagatcggtgggagagcagcagacatgggggatctcgctcggtctcatcggcgcggggaagctcaccagcacgcagagcagagaagcttgccaatggggggagttgcaggtgtggaggtcctcgtcggtgggggtgtagtacgtgattcctgtgagaggtgagtagttgaacacaaaactcatcatgcagtccttgtcgctcttccacagagtacaacgtacgtggggtgctcgcgaacttccatgtccatctccacacctgtaatgccgagatcatgtgttctggagagtgcatatgaattctggattttagatccacacaacgacttgtacgtgtgccaagtcatggcgatcgttagtaatatgaaggtgtgtattcatcgaactattatgcatatgatctttaggtgataaaatattgattgaattgtctaccgttatctttcagaatccatactccagaaatcttacatatacacatatttgttgcatcaaacctaagctttcttttcatacatccctgaacaattcaacttcacaactgctctcgacataatctcattcagaatggtttttttttctcaaattagttggacatagcaaaatattgcttttcaagactgtaacacaaccaactagcagggatattcataaattttccccttctgttgggtgtttttttatagacatatataatgaaggcgtatataacaaagggagaagctgtttgagggtcttaaggacaatagctcaattgactaggaaattgatgtacaaatctctaccttgttttttgatttatagtttctttggtttcaaaaagtaaagtagctcatgacatgagaactttactagcagagaaatgggcttatatattattggaaagataaatttctccatcgatacttgctgccttgattgtgttgcgtgtgccagccctgtaggtggcaaatcattggagaatcagatgcagcttttagatgggcaaagtaaggccatggtcggtctgattaatctgtacagctttcaggcataggctcttgagataaaaaggtatcaaatttcaacttcttgatactcagtactcaagacatctgttaggagtagagctcagagaaaccctatttttagatcctgtaatcagtggcagagcttcgtggaggataaactgggttatggctcctccagcttcatgcaaatacactatattgagtatgttcatcttcatagacattgattaccatctttaacaggttagtttatgtagaaatcctacattatatttcatgttaatggccacttcttgttagtctatgaagctccgccattgtctgtaatgttgtttctgttaatggaaataggggtaatcttcaaaaaaagtctcatcttcgcactttcacattttttttgaaaaaaaaatatttctaaaataaattttttttaaaaaaaagaaatcctacattatatttcattgtataatatgctgatttagtgattttgagtagaatttcagggagtcaatgcaaaaacttgcatagtttggtcaacgccaccatcatgaagagttgcccaggcaagaagaactctggcaagctcatcatcacatgattcataattcgcactcaaaacatagaagttcaagacttcaggttattgtctcatctctacatctgattatcaaattagtttttttttcccatttttctatattttataaattccactacaaatgatcaatgaataacctcaggatttgacttctttttcaactgatctcttttttttttagcaaaacactgtagaggaagccccccagtaaacaatatattaaaaattaaaaaaaatattttcaacaagttcaaccaatgaatgaggactggtctctcaattacatttaactaggtgataccctgcgtgttgctgtgggatttgtaagaagtgatcatgatattttaagtgctgacaaatgctcaagcattacacaacaaagtaatcaattaggggtaggaacggtgcaaacaactctgaagaagggcaatnnnnnnnnnnnnnnnnnnnnnnnnnnnnnnnnnnnnnnnnnnnnnnnnnnnnnnnnnnnnntggcggtctcactccagc

SEQ ID NO: 51740 - DNA, 9122 bp, Oryza sativa
  unsure (1)..(9122): unsure at all n locations
ctgcccttgatttgagtagctctgccannnnnnnnnnnnnnnnnnnnnnnnnnnnnnnnacatgatccagaaaagtcaccttgtagggtggtaataacagtacttgataaaaataggcaaaacattatcaaaatggcacttagcctatgattggacactttatcattagctgaacatgtagctgaatattgggcatcagagcttgtatgtgggtaaacaacaactaaagaatacatcataattgatgacatgatccaagaaagtcaccctgtagggtggtaataacagtacttaatgaaaataggcaaaacattatcaaaatgtagaagtgtgatgaaatagtaaagttcatttgcaaaacgtagaagtgttttgtatggttagtaaaagtcccatgtaaattggtagcaagatattcacttagaaaaattgatattgcaagatagacaatattaaatgcaggttagtgggacacatttatagaatagcagaatatgcctgatgctgtacgctgctgagaattgcgttcatttattctttgattaaaagtgcttggtatgattgccactggcataatattagaagtgcttgatatgattgccactggcataatatggtatagtccgataataagaattaaacagagaataacgtattgcagttctgaaaatttgataaatcacctttgcattagaaaaaaaatatctcatcaaagaaaataaaactgaaaactgaaggtgaaatttagaggcaagtactataaaatccacaggaaagtaggaatgcatgcaagatgtagcatgaaggacctaactgtacatcggacaaaggatgaacagtgcaaagcctatacagcggaagaactaattgggaaatagtggagcttgaacgaaaccaatgaaccaaatctgctgacgctctgcacgtataaacatgatttagctcaaacaataccaaaccgatgcaataagctgatcaatggggcttagataaaagtagaagaaaagaacttgagaaaaaggaaacatgaagataaacatctcaagtcatacccaaacactgtgagaagacatctacggccaggaaccggatgcaggtcgaagaaatcgatatatgagaaaactcaagtgtgttgatggaattgataattgatttaattgccacagttgatgccttgcagttacctgaatttggggagataaccaaaggttttagagaagaggaaggggaggagaatcgtacaggacttggtggcgctgcaccatgcgtagtgaaggggatgcgcttcggctgctcggaggaaggaggcaattattcggctagacatgcaaaaatactgtaatatcgaaaggtcctgatttttagtgatctctaatccaagggctctatttggctgatgacatggaggcatgcggagcaagctttatagccagtgggtatcaactatataggaagaaaggatctatgaactaacaaagagagatcactttgcctacaggaagagattagagcaaagaataaggtggattacaggattagtatatacatggttctcattgtaaatcgtaagttcattcacatacttatacatgagaaatgagttttctaacttgattagcatatacaattttgtaacttcctttccatataccatcttaatgattttcatccaaaatctatttactgtacagtggaagcatgcagcaatattttttttggctattaactcatgtgatgaaaattccaattgtttaaatttgtcgatagtttgtaagcttcaggttgtaataatagaaagcccgtgtgctatggcaaggaaagaagtttcagttttatggactgttttgtatgcgctttgtgaaacttctttttttgttttatggatattttaaatatccatatttgatcgatttcctttggcatcaagtgaagccgagaagcaagcccgcagagatgttagtaattctttctagcctccaataaatttatagcaatataaaattaatttttaggataatttattacaataatgtatgtccttgcttggttatttggacttaagatattttaagatttgttttgtcaaggtatatatatcttttaattacgaggcaattgtgttcttgccccgtttcaagatgtaattgcgattttaccccttttttttaaggtttgtgattttacccatgttttttcaaattgaagcttcagtttgcccctactcggttaagtcctcttcacacggtgttaatttagtagtagaaagataggtgcgccctttgctttctttgtgaggatgcagtgtttttgccccgttgtgtcaatgcatccagcgatggatctgacatacatactggaactttaactttgagattatatggcacctccacacaaatcaattttttgccaattttttcaggaacatataagttgcatatatacaagaaggcgaccaattgtccaaacaaatcaatttattacccatcttttcatgagcaaagacattacacacaaaaaaaggaaaaagaaaggagaacccaagcaaaaaaaaaaaaatcccaaatccacgcgcaagcctgcccgccgcctctgcacttgcttgcctccagcagcactgatccacagccccggcgacggtcggccacccgtggaattcacacaactacttgaggtctcctaatcaaatgccgcccacgcagtcgtcgacggagtcgccgcacgcctccctgcgcattggcctcacggctgcctattgatgtaaaaacacgaggcatgtgagatctgcttaacttcagtgcatgtccaaaagcttgcctttaggttcgtgagtgtgccagttgatttgatcctgcaattaacaagagataaagacaaagaaaccgcagttaaatccataaacaatagccgatcggctagttgccgatgacatatcatttatctttgagccgatgtcatatgtagatcgatcggcaatcatgaataagtaagaaaggactaaatctactcgatcggctatagatattaacaatatataatcgttatgtcgatatatatttaaatcaagtgattgggatagatcggtcgccatgcctagacaatatgaatcacttggattgaaatatatactaacaacaagcctatatatgttcatagcatagctgatcagatagatctagtatgtatcagctaatactccgataccactctatattaagatatcacagcaagcaaaatataccaaacaaaagcctaatatacttaaatgcagcaagatcttaacataaagggcagatttaacatgtcaatcgagcatataagataaaagtggttaaatcagataagattggctgaaaccccgatgctaccctaatcagcaaccaaaagcaggctagaaattgagattctaatcacgactcataagatcaaactcaactgatgcagctataagtatgaaaagaaggataatatctagacaatcaagctgttggatgttttatagagtgatagatatcctatataatctaagtcaacgttagtatttaacctgatcggctgccttctggcaacagacgttagccaattgaaggttagatagcgatattgccaaagattacataagatatatgataactcaatgaattatataaacaagattagagtatcataaagatggaagcactaatcccgagaacgtaagtcgtcataacaagttttacctatagttgaagatcgaaaccgatgcagctcaactcgaaaacaagaactcgtcgaaagggtggcgatgcgccgagattgtattgaacgtgtgttagattgattccatggggctcggggtctatttatacccgagattacaaaatatgtccatgttggacacgactcttatctctaacaaactctaagataccataagtccttgcggcagacttttgcctaaacatatctctaagaaaattacatgaaatatcctaattaatagatacaattgtcttttcaggactctacccatgcatggcaatcttcatgaagcacattaactcaacccgacaacgtatgccgtgtcatattgttggatttggctcaatcggctaaccttgtccaactcggactctgccaatcctggtcgtagccgattcgtactttagccgatccttgctctgtttccggaacgatttccatcttgcatcctactccgctcctatcttcatctccgatactcagattaccaaatttggttgttaacaccgccgcacctccgtgcaagctggaccgcgaggacatcgtgccgccctgcacgccgggcccgcgaggccgccacgccgttacgcctcctgcgtgctagccagcgaggccgccgcctcgcttcttgcgctctggctggcgaggccgccgcgtcactgccgccgcttgctcgccggccaccgcgcctccctgtgcatcgctgccgctgcttccttgcacgcactgccctcgatctagggtttttcgatcggggaaatgttgattctcacatgtgattgacttatttactgaaattaggggtacgttggtaattcacaaattaaaatataatttttccctttatttaattcgaaaattttgggcccacctaactaccgtcaaaaccaggggcagatggttgcttcatttcaaaatagtaggggcaaaatcacaaaccctaaaaagtaagggtaaaatcacaattgaactgaaaagtaagggcaagaatacaatttctaaattatttgatttgcattactaaatattaccgtagcgttagcacgggcacattacagatcttttatgtgttttagacggatatcgatttgccacggtgagaaagcaaattcccttggcctatttcaatggacaatacacattgtctcttaattttgagaaaactaactgttttattgactatatctctgaatctgaaaaaaatctcatcggttactgtttcctttataatgctacaatggaatggcaatcttacttattggatattggattccttgcctcactgaaattcaaagaaccgttgttgctgctcgtcagtgtagtcagacttttttttttgagaatattgataaaggatttgaaggtatgttttcagaacattatttacttgcatgatttttcatgtagagatcaactgtggtccactgctgtagaaacaacatgtgttgattaccagtctgttaactctggatatatttggtgttattatcctggacatggacaatttggttagtacaatcaaacaataatttcgtatatttctatggtaagaaggctgaaatgatattatattcgctctttgttcatgtctatctgttatatattgctgcttgtactctattatatttgctcttgctgttttatacagcgtcacctaccaaacaacaacgtttctattagctattatttctaatccaataactgtactatatagaactctattagctactatataaaactctctggacttcgtgccatggttgcttcctatttcaaattcatatgttatctacgcaaatgaccaatatacttgttgagaataaataggccattttataacatgagatgtgttgtttcagggataacttatgtgctagcagaaccagttgttcagcactgttagatttagccaatgaaaaaacctggcaagcaattacaaagctgtttcattggcaagcaattacaaagcttctttagtgtgagagaatacctgttgtttcaggtcttgagtgtaccctggcatatcttgagggggagagagctgtaaaaaggaactgctttggaagctggagtgtcatcatagaagtgttgttgaatcgaaggcaaaagaggaagctgcaagggtcttgatttggatgaaggacatctgagatgcactttaaatccaacttgatggaaaatatacagttcctcaacaggagagattctggcttgacgccaaaggggtggacaggacataaaaagccattgcaaaatctccttgttcagctgtatgtgaaatgttgacactgcctatttgaaatataaaggaatggttttgttgacgaaatgagtctgcctagacttatgtttttctttaaaatgccttggcagttagtttctgaagttagaaagaagattaggatcaggatcattgttgatttgtatgttcaacaatctcaatgaacaattccacattgcaattaacttattcttgttgtattaaccactggataccattggacaatatgcagtaagatgtagcaatcaaagtgtttaaaccttgagtgggttagtatcgatttgctgcgtgagtttgtaaactttgagctttgttttctcataaaatatgtcattagtagcaataatataacagtgccaaagtactttcaaacatgaatcagtatagtgagcagttctgaataagaactacatgtcaaatatccagtaggaagtcaacatgaatatccatataactggcaatatatttgggttgaggccaataaatcgagtttcatgctaggatcacttcgttgcaccaatatgtaagatcttgtttccacctaaagaatttatgaatggagacaaatgtatttgcttgattggatggtcaaattcaaaatcgtaagtattttcactagaatgtagtttagcaaaccggtgaactttgttagctttaaaacatttttatccccgttgcaatacacgagcacttaactagtattgtaaacactccgtgattaatccaatctagttgagtttctccatctcacattcaacaccctactcacgggctttctcgatgccaacaaacactaaaaccattcccgacgtcgttgacgccccgagctcacaaacactaaaccatcctctcctcgctgttctgctagctcaagaatagtaaaagaaattgattttaatctgcatcttgggttcttagttctcacaggttcttgcactgacggagcagcttggaatcaagccggacattgtgtacaacgaacagaaacaaccatcggtgtgcggcggagatttgtgaagaggggacgacagataaaggttcaatgccaaggccaacaagttatggcggttcatatgtactgacatacaacccattcttgaacgccgctggcggtagcgccgcgcgcgacgcccagtccgggagggcgccgccgccgccgcttgctcgtcgtcgcaccacaggattgggagggggccgctcacgcccatcgacctcctcatccatcgctgctaccgctggcctccatcccctcgcactgctaccgtcagcctcttccctcgccaccgaccctgccgcgctgctgccgctggcctccgcccctaccgcactctccgcccaacttgtcaagctcttaccactaatacatacatgatagatttcctcctttttttaatatgcagtatataactggaaccgcacgaaaaaatggggggaccggcgcgaaactgtcgaccacacgggaaaatgcatttttccgtgcgaacgtcttaacccaaccacacgggataattctcattatcccgtgcggtcaacttaagaagatcacacggaaaaatcatttttcgcgtgcgggctttttaagtggaccgcacggaaaaatactctctcttttctctctcacccatttcaaatttttcacactctctcttcttttttcctttttattttctctccttctttactctcctcgatctcctcccctcccctctctctgcctccttttctcctccccacccctctctctcctctctctcctctctctctgtctctctgcgcgcgccgccggctccgtgttggcggcaattaaatgccgattctataccgccaaattctgcataaagtacggataataaaacatccaacatagtgataggtgcttaatctcacatattccacaagtgttggtatatatttgtatttagatgataaactcagatgctgggaggaaaatcagactaaagtgaggataaatgtgtatccctgcaaggatgggttgtgaacttcatcaaaacatcagtaaatcgacccaaaataccgaagaatgaatagagaaggatcaggggagaacatgggctgaaggccaggccaggagggcccagcccaggttcggccaaaccccctggttcggccgaaccaccaccaccaccgttggatgtggggtttggcgtggacgtcccagatgcatccctaatgacggttggagggcacttcggacatttccccttcgccaaccgtcatacctacccctatataaggacatcatctcactcacttcaacacacacttccaagcttgagcttaattataagaggctctattgtactatattgtatactagaataggaagagagtagagtagaagaagtcagaagaattccggagttgtcggtaatcttctcctattttcttttattccgtttattactctaaatttaatataatattcttcttaagtaatttagatttatcttgtgagaattatctcatggttagtttctaaatagcatacgggattattgtctactataatcaactaaaatatagtgattgctttggtgagttataaacactaaagtagatagtaattgcttagatatagtgttcagacagttgttatccagtaattgctgcgtatcccacagtatgtttgaggtgggtgtagaggtggtgacagccctcgagatcacttaagtcctctctgtccgggtacgtagtagagcgccatctaggaacaccgggttgccagtgcctgaagtattgcatctaggaacagcgggttgctagtgcctaaagtattgcgttaggattaaaattaagttttccctggttggtgtccttggatgaactgaagaaagatctggccccgcgcgttccctggtttcggttccctttgtatcctggggctcctgtagagtcgnctggcnggctngcggcaagngttactcaaaatcaaantccccttgggggggggggnnnaggaaaaangaaacgaaactattgcggtgataggtgcagagaaaaacgactctnccaattaaggtggagagcccacatcacgactcttgacgtctggtagaatacgaatattgactggtctagagga

SEQ ID NO: 51741 - DNA, 3080 bp, Oryza sativa
caaagggagcccccaaatccgggatgccggcgctagatctcaaggaatctcctactttttttttctaccagggattgaacgacaacaaagtggtgaggttgtgatgtttaacatctggttccagtctctagatgatttttctcaagcttgagttgaatccacagccaaaccactagtggtggctactattgctaatgttatggtagttaaagctgtagcgcaactaattttcaccatgccgatatagccagggctgaggtgatgctctctccttatttaatgtcactctctctctctctgtgcgcgaaccgccggctccgcgtgcacgcgcgagcagcggctgattttcctacggatggtttctatggctgtaactactaactagtactactgcagttgctgcttgtttcggtttctacgaccaaaatacggcggcgggcgccacgacgacgacgacgatgaggtggcgccgccggctccgcatgcacgtgcgccggccggctgttgctggtcgcggcggcgcccgcggcgatttttgcttttttttatttttgtttttttccgtgcggacggtataatttgactgcacggggtaatcgattatcccgtgcagtcaacttaacccgaccgtacgggaaaatgattatcccatgtggttgggccacccgcacgcgaaaatattgatttttccagacgtattgctgcatacgggcaagtcctccgcacggaaaaattattttgaccgcacggaaaaatgcttttcatagtagtgtgcgatcccctccaacagtgctgttgtcgccacgctctttgtgttgctgccaccgccgccgaccgccgcaggtggccttcatgccgtgggggtcgaggtgcgtcaccgccttgggagccttccccatccctcttttctacttgagctcggctcgccgctcgctgggcctgtgttggcgtcgttgttcgcttctgcccgactaccgcgtgctcaatcgccgaggtggaccactgcccctcctccgatgggaacgacacgtcagaattgaaaggggtagtggtgctgacaaatgagccccacatatttttatttttaccttttacgtgtaggatccacttttaccttacattcatttgacgactgagactaagtcaacctaccacatcagaataaatcacctccctaacaatcaatgagttcatttgcaccggtttttaaacttgaggaacacgattcgaccaagggcaagagttgaggtacgtgaaatagacttattccatcccatttcatcgcattctgaaacctgtgcccagcccagcccattgaagttcggcatagtcagcctgcaccgaatttttgtagagctcccttgctggctggagctgaagaagtggagactggttgcggacctcaccctaaaccctagccatggcggcggccaaccttctctctcgcgcgctcctccttgctctaaaccctaacccaagcagccacagcaaccgcgtcagcccttcggccgtatctctccgctgccgccacggcctgacggcctccgttcgcgcctctctctccacggcagcgccgtccccgccgccgcggccgacggcggcggcggccgacggtcgggcgccgaagcgctgtttccggcgcggcgccgatgggcacctgtactgcgagggggtgagggtggagaacgcgatgggggcggcggagcggacccccttctacctctacagcaagcctcaggtggtgcggaacttcaccgcctaccgcgacgccctcgaggggctccgctccatcgttgggtacgccgtcaaggccaacaacaatctccgcgtgctgcagctcctgcgggagctcggctgcggcgccgtcctcgtcagcgggaacgagctccgccttgccctccgggcaggattcgatcccactaggtgcatcttcttctcttttcgtttttcgtttctatctcccgctatatttgattttttgatggattggaattggaatgcaaatgaacaatgatttgctggtggacaaaaggcctttttgactattctccatggacactagccatttttttatcttcatgttaattataaaatatccatctagtgactttctggggaaggtccgatttcagtgtcaaaagacatataaatgcaatagttggaccggaagaaagtagtatgaaaatggttcattaatatgctatatttatattttttttgccatattacgatgataggcaactttgttaattctaccaattttgttcacagagcttgactcgtgaatatgattttgataacactatgtttgcacaagcattagaatttataaccaaaatggtccgaacttaagaccatgtgttgggtcaaggagcacagccaaatttacatggcagaatgtagtgtaagaaattacgatcttcatatttcacagagcatgcgaggtgacaatccatgatgaaatctaagcgtatctatgaatgtttccaagttatagattgcacagttttctaaagtctttatctgtaacaaataagtacttcagttcatgtcaattgataccaaacaaaattgtagtaactaactagtttaagtatttatttaagttcaggtgtatatttaatggaaatggaaagacattggaagatcttgttttagctgcagagagcggagtgtttgtaaacatagacagtgaatttgatttggagaatattgtcactgctgcgagagttgctgggaagaaagtccctgttttgctcaggataaacccagatgtggatccacaggtaaagtttttccttccacctcaggatacagtgggggatttagttatattggtatgctattgtgttattgtcatataatactagaaatcagattatatagttttgggtacccttgtgttttccattttttcttgaaaaaagttgtgtactacataggtgattattgatcttagttgtgcgcggtatcaaacatgtactactccctccgtcctaaaatatagcaacctagtacttgattagacactagggcatttcttttgcattaattaattgaatggataattgtaggcaaat

SEQ ID NO: 51742 - DNA, 2209 bp, Oryza sativa
  unsure (1)..(2209): unsure at all n locations
agccacagtattattccgcacaacattaaacagagcaaaaaggagcccaaatattgtgaccggtaaattatttaggcgaattgtacacgcaaaattactccgagatgtnttccnncagctaaaaccgcgaagtcacgatgtcatgtagcgaaatttgccaataatgtatgtgcatatagtgttacctgttcctccatagtcttttgtatgatgatactaatgcagttgatttaaaattgtatgaaagtatctttgtttttacttgtaaaaaggcatgtcaattgtattaagaactggaagcaagataatcttcttttgaggagcaaacttaagattgcttatttcttacaagcttgtcttttttttctgtcaacaggtccatccttatgttgcgactggaaacaaaacctccaaatttggtatccgtaatgagaaactacaatggttcttagactctatcaagtcatactcaaatgatatcacactggtgggtgttcattgtcatctgggatctaccattacaaaggtaaatgaattatgatgtactattctttggttataattgttggaaactttgagttgtaataagtaggtatttgttatggtgagcttgttcgtggtggtgttttgtaccttagcatcttgtgctcaacagacattttgtcatacagtacaggcaactcgccttctgtttttgccacaaaaaagtgtaaattttaacaaaaccccaggtagtaaggtttccttcactaaatcccatgttttgcaacatgccggcatgtatcacaaaactcagttccatcatatcctgttaggttcccgttagctgataagacaaccccagaaatcagaggctcggagcctcgaaacgtaggttcctgtatcctaagatcacattgcctctgttaccaggcactcggcttccattgtgcagtcacagccctatattgtagaacttgctccgcctctccctgctttactctgtgagctctttgaataagttgtgatttagtgaaggaaacctcaaaacgtggggttttataatgctagtgccccaaaacctgacatgctgcatttctttacattagttgccattttttaagtacatatacacgttagctgcttttcaataatcgttgttcatcgtggtctgatcatttatgtgtatacttaaccaattattatgtcattatcacttatgattatgttgagtttttttgtgcagtgaaaaattgagaaaaaataaataaactagacgagagtcaacaaatgtgaatttatgaaaaaaaatcatatgtaataatgaaacatgagtattttacataaatatggggttttttgaaacattttaccccgaaacatggggttccctgaaacaaatcacaataactggggttttgtgttatggatgccccaatacctggggtcttgtgaaatttactaaaaaacatgctgcttgctttgcattagttgtacctttttatggttaccacttcattcattatatatcgttttagacattctttttcaagaatagttctgcttttctgagaaagtaattttgggtgaaatttccatttgataaatacttcgcacaaacttaaacctattaaccaaaaccatcaaccgttagcatatgccagggttttctcggttagtaatattcctctcccctcctgtgcaagcatgtgatggctgcatgcattcttgtacagctgcagcattcttgtacagctgcaaggggagttcttctacacattaatccttgtgcaatgagctaaaatgtcttgtaagtacttctgagccagcggacatgcttttatgcatcatgctcaaacaataattcgtctcgccgtagcttccatatgatgttatatccatccaagcatgttaatatggcattcagatgattaacattaatccatacttctagctagttgagaacaattaagtaacagttggaaattgctagtaagaaattgcattttgggctgcattatgctctaaaaaatgtgcttttttgttgatttgagtttatttagaaagttattgttgccatttgttttagtgtatgcgaatggcaacaacagatcatttcaatcattaagaattataggaaccacactgctttnnnnnnnnnnnnnnnnnnnnnnnnnnnnnnnnnnnnnnnnnnnnnnnnnnnnnnnnnnnnngagcggtctaactccag

SEQ ID NO: 51743 - DNA, 823 bp, Oryza sativa
  unsure (1)..(823): unsure at all n locations
cggactggtttgagggtacgactnnnnnnnnnnnnnnnnnnnnnnnnnnnnnnnnnnnnnnnnnnnnnnnnnnnnnnnnnnnnnnnnnnnagtaactgatgcttacattttatcattaaataaagaacatacaatgccggagcaacacaattattactaatgtccataggaagaaccaggatcaaacaaggaattggaaagaaaatcatgtagtggtggaagagaagagcatgcacgtaccaccaagaggaggagcctggatgtgggaaggggaggaggtggtcaggtgggtgtgggggtgggggcagaaatggaggggcaaacagaaaaatagactcatcaatggcgcctattgccggttcccaaaaagggaagggtctataggctgcatattgtggccgggaaatggagttttttgttttaaaattatacaaggtccggttttcttccaattttagataattaaaccaccaaaaccttattagatgtgccctccgtgtataaaacggttggattttatataaaaaaaaaagacataaatttttagacacagtatagttgtttttggcaccacatttatatgtgaacggaaaattttgttatgacttatgcacccatacccttacatgaacgagtttaatttacacatgtatctcaaattataggttggttcaaaaaaaacacacccgcgcctgttattttgtgggatagcccatattttaatttcaatttttatataaaaaataaaaaaacctttttggagtgtgtgtactccaatacgaaagggggaatgggttacgcgcttaaaatcctttttattttt

SEQ ID NO: 51744 - DNA, 862 bp, Oryza sativa
ggtgctgagacccatactataggcgaattcgagctcggtaccctgtcctatcctgagaattttgaaaaatctggaactttgtatcggttaggtaatggaaccctctcaaaccactcaaggtacggataccgatacaagtttccagtatcctttggcttaagcccaaactgctccctcatcacatctgcaatcatatcggcccattgtctctactgaggcaccccttgcgcttgttgctgtatcggctcaaactggttgaactgaggagcatactgaggctgaggcaatcccccctgttgatagtgaacatgaggcgaaggaggctggtattgataattcaagttacccccttggtagttctggacattcggctgaatattacacactaagtgctcagggataacttgggtagcaaccgattgatccggttgtacaacgtgtaccagatgctcagggacaacttgagtcacattctgatgcgacggctgattatcaggcgtcctcaacccagtcagcatctactggatcgtttgttgctgaatcagctaagttgtctgctgttgaatcggttgacctatctgctaccttggcggcgtctgctgaatggatccaccaatcggctgagttggcaaaaacattgaagcaatttgctcttgggacagccgattgatattctgaccaggatgttgcggttgttctttagacaagaggcgaggattattaattatttgccttggtgccgatgatggtgcagcttgtgctggagtcaaagctgatgccatcggctggattgatggtgcattggtagcagactggggtaccgagctcgaattcgcccttagtaagtagttgtctactcgcg

SEQ ID NO: 51745 - DNA, 859 bp, Oryza sativa
  unsure (1)..(859): unsure at all n locations
cctggcgttggtagtactatccgttanggcgaattcgagctcggtacccaaatttgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgagtttataaaaagaaaaaccctaaaaagtcttttccccccccttccctctcttgggccggcccggcccatctctccccccctctctctctctcctctccccgcggcccatccggcctctccccgcgcgcgcgccgctgacgggcgggcccgcccgccaccatcgctgacgggtggggcccacccgtcatccccttcctcccgccgctcccgccgcctcccccgcgccctagcgccgccgccgccgcgaataccgccgcctcccgccgtccccgcgtgcaataaagtggggggaattactccccgtgatcccctctccctttccccccatttttccctctctctctctctctctcggattcgnttggaaatcctcccgcaaacttcgccggcgtcattgatggagccgagatcgcccgcgccggccttttctttcttctcgtngacgtcttcttcggcagncccttccgncgcgcccgtgcatcagccggcgctgncgtnccctccctcggcgtcggcgcatcgcccttcaccccggctgctccctcggttcgccggaacgccgtcgcagcgccggcctcttcatnctntttgtngncagcgttcttttcgncgncccttcttcttcccggctcgtcggcttgtg

SEQ ID NO: 51746 - DNA, 870 bp, Oryza sativa
  unsure (1)..(870): unsure at all n locations
gcggcattgtactcacnnnnnnnnnnnnnnnnnnnnnnnnnnnnnnnnnnnnnnnnnnnnnnnnnnnnnnnnnnnnnnnnnnncttcaataagggttcggttcttcctctcaacaatgccgttttggggaggatcatagggggcggagaactcgtgcttgattccttcttcatcaagaaattcctccacttgagtgttcttgaattctcctccattgtcactttgcaccctcttgatagtgagatcataaaggttttgggcttgctttgcgaagcgcttgaagacatcttgagcttctcttttgtcatggagaaagtacacccaagtgaagcgtgaaaaatcatcaacaatgacgaaaccatacttgttacctccaatgcttatgtaggccacgggcccaaataaatccacatgaagaagctcgagtggtcttgttggagtcatgatgttttttataggatgtggactgccaacttgctttccggcttggcaagcactacacacacgatcgagacccattaccttttctttaccatcatgtccaaagacaatattttcacgactttcacccttctcattaagacttgtaaacatactcctctcttccatcatatgaatggtgcagccactgtccacaacccaacttgagccactggaggagtatgcctacaaaagaaatcaagcttgggatttaagacccaaacttgtctagtttgggtccttgatgtagtcaccaaacctttgcacccacacacaagtacgggactcatcattgtaattnccattgnaataaggcaccactttgccctctgatttttggaaatacatatgactcattgttaagaccctctagccagaaccttctggctn

SEQ ID NO: 51747 - DNA, 1315 bp, Oryza sativa
  unsure (1)..(1315): unsure at all n locations
gcgcgagggtgngaccgctctnnnnnnnnnnnnnnnnnnnnnnnnnnnnnnnnnnnnnnnnnnnnnnnnnnnnnnnnnnnnnnnnnnaatataaagggttagggtttgcagtaaacagcattaaaagacacttagttgctcaaagctattttgtatacacgattctagagctaaacaatattattaatcaaggccatgaacccacacgaacctgccttaacccaaggcctacgatgattcagaccgaactggcaacccgaccctgggtcccagctcgtnccaagccaacccaggccaaccattccacattttagttgttaaccaggttttaagaatttaaaaacactaacttgggtacattgctcggcttgcccataaccgagggcacgggctattcaaatagattatactctgatcagaggtgtacatctttacccacaagacatatcttcctcagatgtaaccacgtgccacataccaccacggtatacggacggaagacgtgacatagtttccaacccatcctagccatagacaagagtaccgacccaaccccacctacggccggaacccccaggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgagatgctactatcaaaaccatgcaccccgagcccagcctaaaaccattttgagggttttgcatagagggggaggtgtgaatccaattccacaataatccatccattccatggtgtccaggtgatgagaatattcccaaagtctagagttgtaaaaccacccaatgttacctaattaaccagcgaagcatctacctaaaatcatactagtggtaccatgagtagagtgtccactagttggggttttgtttaatctagggtgaacaaggtaataatatcaataacaataataataaggtcataacaaaggtaaataggcatggctaaataaaacagtgataacgcgggaatttaagtaaagcgataatgcaataatttaaatcaaaataattttataaactaggattcaatgtgcttaaggatgatgnnnnnnnnnnnnnnnnnnnnnnnnnnnnnnnnnnnnnnnnncagcnntaccaacnccacg

SEQ ID NO: 51748 - DNA, 1359 bp, Oryza sativa
aattaaggaggtaccatgatattcagtaataccactttcagtttccaaatgccttgttctcaaatcttatcaaaccaactcatatatctcgtgaggaaaacaagatcctttgtgtgtgtgtgtgtgtgtgtatgtgtgaaaatcgtctgacttaaatcagtcccataccacattatacatgcaatatatgcaaactataggtaacactcttttatgttaacattttcaaaatcacccatgcacaaacacttcaaaaatattttctaataaagaacttatggttatttttgaggaattccattagatgctttcgtttgttccttatagaactatgatttactagctttatcttcaaaacatctccattcttttccttaaaatgacttacagacgagttagcagtgccacttgaaactaattggaagctttcttaggtttgggagatcgaggaaggaaagcacaagccaggttctgtgattcatactgtagggtggcctttggactcgaaaacatatggaggatcatttatgtatcaccttgatgatagacaggtagttcttctgttatttgctacaatatccctttatgagttctcttttcttttgcaaatatatgttcagtgaagtctgtcatctgtgtaaagatgtaaaaatgtatttatcttacatgatagatgcatccttctccacaacctaagttcacagcttacagattataatttgggtttaaaggaggaaccattaattcatcccttatcataaggccttttgtttgcagagtggataaatgtataacttgctcagttttttccccggaaattttgattactttatcgcttagtggtgtttactttatctctgctctgatatttcagttagcgataggtctggttgttgccttgaactatcaaaatcctttcatgagcccatacgatgaattccaggttagtcaaatttctatgggtatgttcttttatgatggtagtgtactagtatagtcctgaactcctgatggtcgattttttttcttctaagcattatgcaatcatattttatatttcagaaattcaagcaacaccctgctgtcaggacaattttggatggtggaacagttcttcagtatggtgctcgtacgttgaatgaagggggttttcaagtaagtggcatgtcaaagaaatgaaaattttgttgtaaatagattcatatgatatgtaaactctgcgcataactatattgggcatctgccggtttatgacattacaagcattttacatcaaaatcaattcacctggtgtttccggttaactggtacatgaactttgaacacagcattggtatagtgttcttgttatgctatatg

SEQ ID NO: 51749 - DNA, 2455 bp, Oryza sativa
acgagaaaggtgaccagaagcttcacataaatgctcaaaattgtcttcattgcaaggtatttgcctccatgttgattcagttgtccatggacatttgcatcttttgtttcctgtaactgaatgaaatgttgacggtatctgcaggcttgtgacatcaaagatccaaagcaaaacatcgaatggaccgttccagaaggtggaggcggtccagggtacacagtaatgtagacgatagcaaaatactgcctgataccatgaaaacattaaccgaaaggcaataaattatcatcatgtatagaggacatcatgaaataatgtatggtatatttcttctggtcaatgtgaattcaacctatacttgtcaattggtcgttccaaagtataccaaaggaaaaaaggaaatacatgacaaaatcacagacagactacatcaggactagataatttcacagtgacttttgttcagtgtagtttcaaaatattcttgttttgaagaaatttaaatgccgtcaaagttgcaacatattttcctgttacaaaccataaaatgcagtggtgcgatgcgatggcccacaaggcccacttcgctggccacgtccaactctgtcggtccggactggattgcgaattacttttggcccatttgttgggatgcaacacgtgcggcctatatagtaattgggccgaaaagggagtgcgggctacgtgcggcccgtacttgttactccggaaatggaattgagagtttttgctccatcgatcagcgcggcgactcgattggaagccggtgggcggcggcgacatccaccggccgcggagaagacgattggcctccgccgccgctatctttcatttgctcctcagtcttcagctgcaacacgctcttcctctgctgtccggatgcctcaactccactcttcaaggtttcaaggtttgaggtactttatcgatgaacataatgtgttttagcctcaaagatgcaaccagctcacaatgatcaattcctctattgaagtttacatgtggtatttctgaatggaaatttacacacgttgtttggaaccacatttcaggaattcaagcaactcatcagattccaaccattctcaggcaggaaccaatgtactgatccattctggctgtgctttctgtgatccatacggcattttgcaacgaattcagtattcagcttacagccaagacatgtgcacatgcattacagtgggctcaaaacagcaaacccaacgtttcagtacacagttgctgactactgacaccaattgctgctggttccaagcttcagagttcagagagaccagatactttgctttcagatcacaagttcacaacatgttgagaaaggcattgatcaatgggataaattgttcagcaatccatccagcatgatgctttgcttgcatccttggactgaatacttaagagatagctaaagtttagcccctctctcccaaacacccccttatgttttttgtgaaggactaaagtttaggtgatgtttggatccagggacttaactttattctctatatttagacactaatttagagtattaaatatagactacttacaaaactaattacataaataaaagctaatttgcgagataaattttttaagcctaattaatccataattagataatatttactgtagcatcacataggctaatcacggattaattaggctcaatagattcgtctcgtgaattagttcaagattatggatggattttattaatagtctacgtttaatatttataattagtgtccaaacatccgatgtgataatgacttatttagtccctcccacccaaacaccacctcagtcagctttggattctcttatcaagagagaaaattcaggcgaccagaatacagtgatcaccagaaactgcagtgatcactgagatctaatagtagtactgtattgtgtacactacacgtgattaggagtacaatgtacggatgacaggacacattttaagctggtcttgtccaatctccaaagaacatgcatctgtgatctgtcactgagctttaatttaattagtagtaacagatatataaaacgaaggtatctcttcagattatctgtatcggctgtacggaacattctgaggttcagatcaccaaatgaaaatccaatctcctgaatcggttgaatgcagacatcaacatatgaacataatgctacctgcaaactgatgaaatgggcacaaaatcttcactgcaaaaggaaaatgatcacatttcattccctcacgggacactcgagacccaacctgatttctcaattccagcattagagaaggctagccagtatgatcagtattcagaaacagcaaaaacaggtacatggtcaattgatcaaaggccaaaagaattaaaattcctgaacattgaggactcatagatagattgatttgccgctacac

SEQ ID NO: 51750 - DNA, 4946 bp, Oryza sativa
  unsure (1)..(4946): unsure at all n locations
gtgcgctaaatataaggcaccgcctgcatagggtcactgccacacatcgtagggtgactgcctcgtgggccatgtggtgcgggtcggcgacgtggacccacctgtcagcgagtgtggcggtgaaggataatgggttgacgcgacgacagctgtggggaggagcccgggatcgcggtaacagcggcggtgaagtctgtggactttggaccgtgggttgcgtcggtgacgggagcgggcgatgcggccgcggagatgtcggttggattgcatcggattggatgccatggcagcatgggccgcacgcccgcacgggacggagtgcggccaccgcgtggaatccatggcgcggccggtacggagtgggccgcgtgcggcgtgccccgtgatgcgcccgagctggacggccatgtgcgtcggtgaaggctgtcgcgtcgtgtgactcgcgtcgtcgtcgtgtcaacctctgacttgccgaatggaaaatgtctattgtaactcccttaaatataggccgtatttctcgatcgtaaagctgctggatacaacaactctactaaccgttaaaaccggaaaaaaaaacttataagacactactccatctgtctctataaatataagggatattggttgaaaataacacatcctaatataacgaatcattataccaggatatattatatccgactaaaatctcttatatttagatacggagggagtatttagaatggcattagctaacgtggcaaattaaccacggtcaaaaacaccaagccaacaaggatgttaggatatcaagtggaactcacatgtcattctcgcttaccctccttcctttctccttcctccctcctccccatatctctctcctcttcccgcaatactatcttagaaatctttttcaactctcttaatagttagaggggttattatatctgattttatggttaaaagacgaattagatccaacctaagaaaaattagacattttccgcagcgaattgatgcccgctagtcgcatggatagatctagcccgcttatcctaatggatgcggcccacggcctcccgtagttggttcccgtgacatttcggcctttttcccccacgccgaagatccatctacacgggctccttcaccactgaggccaatcaacggtaaccggacgggcccatctacacgggctgcttctccagctgagcttcttgctgttgggcccgtgacgaagcacacggcccgctgaagcctctgctcgtggggacggacggagcgaggcgagcgccttcgccgtgccgcgtcgcgcggagcggcggccggccgaacaagccggccggcggggcgcggcgtgcgtgcacccactctcggcacggcggtgagctcctcctcctaactcggctactcccttcaaccgccgcgtcggctccgctccggccgccgaccccttctgcaccgttgggttcggggggttgccgggttgggggaaggcggctcctcctcgccggcgctgctcggttcgattcggagggggaggagaccagccgcgagcactgtagtggcgatgtgacgccccttcccttaccagtaaccagtactcactttgtgcctctgtttatctattattcagtttcactagatgttaatttgagaggtagggcgctaggcctgtaaaattttacccaataaggtcagttgatattttttttattcacttcatgtagtgattaaccctaacacgatcctagttgatggctgggcatgggcagaactgcacaagtagtgcttggagttggcaagggaattttatagagggattctgcgaaatcgagtgaaaggaatagttatgtttgcatcgtactttgattggtacaatcggctctctcttcaaagtttttatcgattattacccccttattgcagtgcctcacttggtcatagctatcttttgttcatttattagataagtgatgtcccagcattgtcgtttcagacattctgtaagtattccactgtctacctctccaatacacaatcacttgattttgagttctctatggttcccggcagttgacttcacagatctagtagtgctatgctttacacttacagctgctgtgcaatagatttttgttttggctcctactattgtgaactcaacgaaatagtttccatcaaatagaaagtgaaatacaggggtcaaataatttcaagggaaataaaagatattggagttcagtactttttgcagtaacaataacctgtcagggttgcatgacagaagtcatattccctgaagggctgaatggggagatgaatcttccctgattttcatatactcttaggctttataataatgatagcctctgaataaacccttcaaaatgttaagtttgactaggatagtgattgacagcatcgatgtaagtgaatgattattttgtttttgaacaatctttcatgcatcacatccagcttgcactgtcatcatgtaaacgttatttaggtcagtagtcaagttgttaagggcatgtaagtttgtttcattattgtttaaagtaggctttagcatatactgcaagttatgtctggtgaagcaataataatttatttgatgtgacgtgtgtaaaatatgataaggaggattaccgtgtgaaactcaagtaacatagttttttcagtttgttttatactttatatgtgggacccaaactagtaatattgaacttatttctacatgcttcaatacatacaactgaaaaaattttaaacccccaaannaannccaaanaatgacttccatatatttattattcatttgtaagccagttagtcctaaaagaaacaaggaaatatgtggagctattttgatcactgattcctctgattctgttctttttcctttttttctttaccccctgtgggtaattatatatataagaattgatgatatgtgattcgatgacttatttggaataatcctttgagtttcatctgttctattgatatctatactacatcagtttctgtccaaatgtttatttcaggtgaagaatcttacactggcatttgctgttcgagtagctgcgtgactcttatcagaactccggcatatcaattgatgaggcccaacttggtgagaatcttcctattttgggctatgcggtgataatctaaagatttcctttaatggttaatatgtaagcggcagactccttatctaacttctagtttacaatatctctatcaaagttgtggcaattgtaagtatggtctgtgaaaatgacccctcaaaggccaacccacttgtatggctggaaagttacaggaatttttatgctcatatgttcctatcagtcaacagtaacgtttcaatatattgggattctttattgcagttcctactgtagcgtgcaattccttatgggctctaaagcctcccctgtgattatctaattaaccacctggcccgctagcccgaatacttttgtcatatcttagtagatgatattatgacacacctccaagattgggctgacaacgaaagatagtgtagatggacatgaaagtaaaatgataaaacatgtccttttcgaaagaactgggactccaccaatttcgaatatttatcttctacagtagctgtgactaactgagctgaagtactgtatatggtacagatgctcattataaagatccccttaatctcacaattaagcgttaggcatttttagcatctgtatattaaattgcatgaatttctttatccttagcttggttcctgtttataacaagactatttagtccatgcaataattcataaaagtttgcaatcagattcacctcatgaattgattttatagtggtagagatattgctatacaatgcttagaacagagcactgttccaatgcagaagtctagggtacagaggagttgggaaaaggaaggtggtgataattgttctgtataggaatggggtcccatggcaatgttaactataggagaggaggggaggaagggttggttatgaggccatgtgcaacgggagggcacaagtggggaacaggggttgcacgggataacatgggagccatgtctctccatgttgcctagtgagtatttgtgtatagctttcgttcttggctggactcctctggcatgggaataactatcaacaactcacaattcccccacttctactttacattacttacccttttcctaccaatattagaaaccaaaagaaatggaagctttactattttttccttttccgttttacttttatagatccgatttcaattggcggtcatccctgtaggggacatggaagagaattcattccctcatatgtgatattttttagctggtattttgacaaagtgaataaaatctgattccttgatttctaccaagtaatcagctttaaagtttaagtatttttcccattgtaccattctgttatttcttactggaaccagatggattgctggggtgccatgtgtgctatggtcatggaagaaggattttgcacgctgtaaataaagttttttcaccacctaacactaacggatatcagaaagagtttcctagtgcactacagcatcggtgcgctcgcctaatcatgagacaagacaaccagagcaacggtggcaattctacatgtaattgagcacattaaggtgaaatggacttctgactgataaattcttttgtggtttggtcactttgtactgccctgtaatgacagtaacactcaagtgtgtgctttaggtgatggtaccttttgtgaaactgtagggaatctttgctggaaccatgatgtacaagcgaaatgttggcactttaacctaatgagaaggaaactagtagttctgattatcacatgggtcaggctcttatttgagtatggatgagatgcccaagataaaaataccttgggacactggaagc

SEQ ID NO: 51751 - DNA, 1112 bp, Oryza sativa
  unsure (1)..(1112): unsure at all n locations
gcttaattagttatctctcctatgcatccaagcttgaagaggacaagggaaaaagatgtctaatttcagatcgtctctccagcaacacgtacgggaccatgataatgtatgggtttccgtttggaccatcatcgatcgccgcggctcaccggcgtgcacagtgggagccgccggctggaccatggttcacatatatagcaaggggccatttggacgcatctccctgtttaactggtttgattagtcatgccagacaaggtttgccttattaaaccctttcattggttgacagagctcacattatttaattttcttaaagaaatggtcacacccctggctaaaaagaattgttcaggtaatccatcaggtgctttgttttcctaattattcgcaaatttatatacaacatgttgtaatataatctactctagaatttttttatcacaatagctaggtatatggtccagttgaactatgcaatcagctttaacttgatatttttttacataataagtagtaattagagtttttttaacatttgggatattaaaaaagtcccaggtatccctgcggcaggccctnaaagggtaatntgaaatacacgttggtgaggcttcttttggtaaattcttggtgcacacagcagccatgcaagcatatataancttgtcagcattgcacttngcgtccctctngacttncannnnnnnnnnnnnncagagctcatcccgacgttggagggaacccttttttttaattattttcctatctttttatttgtttcagccgtgctgcactggaaaaggtccctggaatcgccgcaactttacaggttttttttttcctctcttctgtgcggttacactaatataataaaatgaaaagagatagagagataaaaaaacaataatatacgcaacagatcaaaagaaactagcacatcatgatgtcgctatcaggcggcatattaagctattaataatttagttttgcatacttgtgccgcttccaaacgcttctctttgttcttatcatttgagctgcgacccaatcattttaacatcaccttttcttgcactaggaaggatgccctttttctctttaccggtttg

SEQ ID NO: 51752 - DNA, 3397 bp, Oryza sativa
tcaaattcgttgtattaggagaaaaagttatattttcttttaagttattttttgttttgggaccgagggagtagagctagagctacgaagggcagcaaggtgaacgagcgcgcgccctgcaacctccacgttctcccataatttaaacaggaggcatcaatcccacagctccattctttttaaccttttatggcagacacatcaccccacacttcaaccgtttttatacggatccccagccacagccaagccagcctgaccccaaaactaattttgtatgcttgccaaaggatcagccatactcactatagctaggcaaccccccccccccccctgctggctctaactccgaggcatccaagcctaaaactacagtggtagggtatctcacgtactaggagcacaattttaattacaggactagtgctactgggagtagtatacagtagcatagtgtgtataaaagtgtggtttaagtagcaagaatttgtgcaagtgataattaatcaagtgtcactttgtagcacatgctctcttagctagcactcgaagttgtcatgatagggcgatctacacaagatccttctactagttgattttgtgctggcaatttaagttgatcaagatcataccgaattttatcttttgatctacctaaatttttgcaggcattttttttatttacatgcatgcatgcatatgacaacataccgtgacatctagcttggatgctacctagttattttaatgagtttacctcggttataatttgataattacttgctttaaattttataccctatatatcaagccttccttgtgctatactaatctttggcatgtgagggctatctccccatgcttatactaatcgtggcatagcaatttatattaatatttgaaagatcgagatcgatccttatgggatctaaaactaaaaagtttacaataaattaagcattggatcctagagtataaccagagctgcacatgtaatttaaatcgttgcatctgcctctaatccttcttttctctaaaaataaataaagtagacaaagagcatcacacttatttagaaagaatgctggtataagaatagcaagaatgtaacatataatatgtcgcgagtatacactgtaaaacttcggtaacaacagtttgggaaaggaagaaaaaaaaactcaggtaatacataatggacagtttaggtaattagaaaaaacaaaacaaaacatataaaagaaggagagaaaagagaaaaaaaagagaaatgggaaaaattccggcatacaccagcaccagctctcttgctttttcactgccacttcacttgatgagcacatctttaatttttcaccttcgatttttttttcaccgcgcccttgcaacatgccacagtagatcgagcagtagtacacatagccaaacaaatttttaccgaggtgtaataatttgtaacaaccacaaccaccgcaacattttgcatatatacccttgtcttcctttttttttaaccgcgagagcgaggtgttattaccgctcctctgtgccgtttttcaccgcaccaagttttaaaccctctccgtgaaccctcacgaatggagggtccttattaaatttaccacaacaaatcaataaattaccacgccaccaattcctttttttttgcttttaacactagctaagaggagacgcgagatgggagagaccactgtaattaacacaagaacgaatcaagaaatggatcgatgctactagctttttcttgctaggaacatccagcgacgaacgatcgatgggcatgcatgcagcttgaaatgggcgaatttttctttcttggcatggagatgtatagctgctagcttgcatgaggaatcaatggagaaatatgccggaggaggaagagaattcttgaggttttaggtttttgagctttttgatggtgttgagatatggacgagccatggaggaggcgacaggtaggtagatacaaatggtacaagagatggaggaggaagaagaagaagaagccattgacgcgcatggaggtatgcatgtgtaggaaggagagagagtcaccggatggatggatggatcactggaccattgccaagaaagatccggtggtcgtcgttgcggccgccgccgtggcgggggcggcggtgccgggcgggttgccgccggcggccgcggaggcggcggcgttcggtctgacgacgctctgctggtggcggtgctgcggcggctgctggtggtggtgctgatgctggaactggatctcgtactgcatcttgttgccgtcgacgtcgtcgtcgtcgtcgtcgtcatcgtcgtcgtagtcatcctcgtcgtcctcgtccatgttgtcgctgtccacgccgccgccgccaccgccgccgtccgttcggttgaaggcgttgttcgccgccgccggctgctgcggcctctgctccatcatctccttcataatgtcctctggctttaaatgcgcagcgttacgcaatcagcattggatcaccaaaaacgaacagcagcgtaccacatgtgtacgcgccaattcgctacggccacacggggaaatgcacacggatggatgcacgtagcttagcttaccttcttcgccgccgcgccggtgaagaacttgttgccggcgacgacgctgccgttgctcgcctgcatttgcatgcccccggagccgcctcctcctccttcgccgttcgcgccgtttgtactgctggtgccgttgccgttcttggtcgtcgtcacgggctgtggcggcggcggcggcggtgtctgcgagatcggcgcggcgactgtcaccgccggctccgcgtgctccggcggcgggagggccggtgcggcggcggcggcggaggaggaggaggagttgagagccgccttgttgcggtagagggcgtcgagctggtggaagtaggggcaggtcttggagtcctcggggcgcttcttgttgctctccttgaccttcttgaagtacttgttgatgttctcccacttctcaaaacacctcttggagctccggctgtagcccagccgccgcatgccggcggagatctcctcccacagcgggcccttcggcccggcctcctggtaccggttgtccaggttgctccgcagctggatcagcgcgtgcacctccgccttgggccaccgcgacgacgacggctgccccccgccgccgccggacccgtcgtaccccgcgtcgtgcgcctcggcggccgtcatgacaatgtccatgctgctttgcgtctgcggcgtcgccggcaatggcgacttggtggcctgcggcgatggctgggatgctgctgctgctgctgctgctggtggcggcggcggcggagctggcgcgacggaggtgatgggggtggggtgagacggc

SEQ ID NO: 51753 - DNA, 2784 bp, Oryza sativa
  unsure (1)..(2784): unsure at all n locations
agctcatcacgttccccatcaccaccgcgggcggcggctcggcgggggcgcgcaccccgccggacacccccacagctgtcgccggcggcggggccagcgacgtcaccggcgatggcgctgccacgacgccggcggcggtgccgtgcagcgcctcgagctgcgtgaagaagcggtacgtcttgccgtcgttgcgccccgcgcggctctccttggtgcgcttgtaatacttgtgcacgttctcgaacttctccttgcacttcttcgcgctcctccggtaaccctcctccgccagcttcctgcacccaacccaccaccacgccgccattaaaaacaacacgaagaagaagaagcttaagctcgagctcgtcaatggcgagccaaaatttgaaggaaattaagctgtaaccctcacaggaaagttgcatgcatggagtagaattttactcgatttgggcacccatcggaaaagataaagaaaggaaggtgtgtgcatacatgcagcaatagctagctaaactaggatgaatcaaatcccaagaagagactagagagaatgctgcagggggggagtaaaaattccatctttttttcttctcctgtgcttgtgcaaaagaatgcatttttatggccaattctgcttgcaaaattggaattgatgcctttcggatctgaagcgtatgggcgtgtgttgtattgtaccaccatcttgataagagatggccatgaaaaaaaaattctttggaaaggtgaggaaggagagtgatacccgtattattttaaaatggaaaaaaagtcactgtgctcgtgaacgatggttaagggaaaaaaagtgaaaaggaggtgtttattttagccggtaattaattaactgagcctaaccaaaaatcacaccaggctactgcttctggaggccgccgagatttcatgcagcatttcgccgacgagaattcagccatggcggcgagatcgacggcggagcaattcttgaggggggctcatggcgttgaattttttacctggagacctcctcccagagcgggcccttgagggtggcgtcccggaacgcggcgtccatgtccgaccggatcttgagcagcgccagcgtctcctgccgcggccaccggttcccccccgcgccggccgcttggcttttcccccccccccttttccccccttttttcccgcgaccgcgncgcgcagcgcctgggtaaacccacctcgctccgcctccgccgcctacgccgagctcgtcgaactgctgctgcgccggcggcggccggctgctgatgggcgacgcggcctccgccatggagatccgccccccgccgcctcctcccgccggcgagaatggcgacatctccggcgccaccgcgccgaactgctgcacccctccccctcctccccctggctgctgctgctgcatgctactacctcctcctcctcctcctcccccacgagtgttaccactggggaatggaggtgatggaatgatcagtacatcaggagagctagtagaggtgaaaaggatggcaggagagagaaaacccaaaaaaaaaagaagatgaggaagaagaagaagcacaagaaagggaggaaacaaggaaacaccagtacaggaagaagcctggcaaaaataaaaattatactcctgcaacagcaagggagagagagaggaggaggaagaagaggaggcagagaggaaaaaagaattaagataccatcacttagccttgaataaataatagggtggatggatgagagagaaacagccagcagcagcagcagcaagcaggaggagaatatgatagctgtgaagagagaaaggaagaagaagaagaagaagtgaaagttgagaaatgttgagtagagtacaacaaagagaggaggaggagagagaaagatgaagaaagagagtttgtgttgttgtgggtgcttgcaagaagaggagatgatgatgatgatgagggagatgatgtgggagataaaacaaacaagatgctgcgctgtcaggggagggagctttgagctttacctcccctcctaaccacctgcctaatgctagttaaaaccgaaaggacagagagagagagagagagagagagagagagagagagagacaaactggtgaagaagaaaggaggggtaggaaactgtgggatgagagagaaaggtggaggcttgtaataaaagggagaggagcacaaatacctctacaaaaactcctctacctcaatccccatgggggaatatattggattctgtgattcatgatctactgtactaagctggaggagtatttttcacactggaaatttagtcataaattatcctcaaaattaccctttttattttacctcaccatttctactctcatcaataccttttcttttgagatgaaaaatataaaattcatctgagttagaagccattggttgcactggtgaccagtactaaacccagggccattggaggatccaaggggcagcagaaaaacaattacaccaagattggttttactactttgcagcagcatcagcaacaggcaaaaaaatcattacaaaggcaaaattaaatccccaaaaaaccaaaaaaaaaagtttacatgtgggaacaaaattagttaggagaattggagaaaaacaaaaaaataataattaaaggagtagtagtaggagtgagaggaggaggcagacaagaccacattataacagctgtaatgtgggcccttccggagagcgaaagaggtgcagaacgtgcccggcgataacgcggaccccccccccc

SEQ ID NO: 51754 - DNA, 1876 bp, Oryza sativa
agattttatattcagataataaaattgtggaatgtctaaatacttttatttggttcgttcctcccccagatatcttccttttggtcatgatgcatgtcttgaagcaattaattatttatgggagcacaataagtttttagaaattttatgcgaaattttggtaaatttcattattatttttttctaccgaagctcatccgcatgttgcacaggcatggacactccttgctcccttgctatcacatttctatcacgtactccgtacgaacgttccaaaatatattatctatattaacggtcagacatgcttatatttgaaaaaattagagtagctatttttttctaatagtaaaataatggctagtctttaaatttggagtagagtactatctacatttatggattttaaaatgcacatctatgtctttaattttgatttaatgtatcactcagctcaaagtacagataacacaaacttagaaactaatttggccatccagtggaaattttacattcagcccctccagtacaatattcccctcccaaatcaactcccaccatgccagtgggagaggaggcgaagaaatggtaacgaggatagctgcgactgtcattggtggatagtccctagaaccgagaaaaaccacgtcacatagagagggttaatattgtaagttcagtgtggtgttattttcgccgtaatcctcgtgcaatatgatgttccattgtttgccttcacggcgacgatcacacgtgcatggctcgtgggacataattcctaattggcgcatatgcgtcgccgacgtgtacttccggcccacaagacccacgcgtatgcgcggcaccgcgcgtcggcgcggttagatttttttcgggattttttccatagcgcgtctagtaactaatccgttagttttagcatgtaaaaaaatccattagttttagataatgaagataagatttttttttaagtaacagattgaaaagaaatttatgcgtgaagtcaaattcgtgaaaactttcaacacaaatttgaaaactttcaacccaaatttgaaaactttcaacttgaaatttgaatttttaaaagtcaaattttgaaaactttcaacttttcatctcaaatttgataaacttcagcccaaatttgaaaactttcaagtcaaatttaaaaactttcaacccagatttgaaaactttcaagtcaaatttaaaactttcagacccaaatttgaaaactttcaacctagatttgaaaactttcaagtcaaatttaaaaactttcaactcaaaaatttgaaaacattcaactcgaatataaaaactttcaacccacaaaattgaaaactttcaagtcaaaattaaatactttcaactctacatttgtaaagaggtgtctgaagaattaaaaaacaatagaaagaaaccaaaaaaaggaaaaacgtgcccggatctgggcactaaaatcgtaaaaaggaatgtgagaaagaaaagcacgctgaaaccggggagggggccaactgccgtgtgcgccagctaaatttgctggcgcgtacgcgcattagccttcccccctcgtgggatcaccctttcactatggtgccatcttacctcggttttcggggacctcctatctccgacaatagatgccactctaatcgtcatctcttcgccacctctcccacatgtgtgttaggagtcaacttgggagtgatgaaagccggattttgggacatattgtattgaataggtgtaaatacaaaattctcgttattgtggacaaccatgtcagcacccgagctacattgtttgtactttatacatctcgtgatacattaaaccaagattttagtccttatattttataagtgcatga

SEQ ID NO: 51755 - DNA, 2019 bp, Oryza sativa
tgtcctgttcgaattcagtacattttttagactcgcacttcctgtacatgctccccttttcttgttttgaatctctgtacatgcaaattgtactccactatttgaaaactaagcgtgtggtccagttgatccttctggatgaatcgaggacaaaaggccaaaattgagatcgcaaatactactaggaagtaattccatcgtttacaagaagtatcctagactaagggggtgtttggaaactagggactaaactttagtccctctcacaaaagtatagggactaaagtttagctcctctctcccaaacaccccctaaatactcgtagtgtggtatatatcatagttaagagatatatcactcgtatgtctactagccgaaaagtaagggctggtttggtttgagacctaaattaggcttaccaatatttgataatttcaatagtgtttagtgtctatttggtttgaagctaaattttgacatgcctaagaaaatatgtcatttcaataatgaacttaggctattttagcttcaatccaaacacaactttgccttaataaaattagtcatgccaaaacttactaaaatttgcactgacaaaatttggtaatgtctatttgaccacaaaccaaaccaaccctaaaacttccaatttaaaaaaccgtggttaaatcttattaaacattagtgcatgttttaattgacccttcttgataaatcgaggacgaatccgaaaatgagctcgtaattaagtaagaagcacaagaagcacctccgcccaaattaaacgttatggtatcaaattatcacggtcataagatctcgcatgcacgtctgccagtgtgaaaggaaacacctccaatttccgcaacaatagttaaacctaaatacaaaagattctgcacgcatacacgacttgccggtggaaaaggaacacacccaatttccgcaaccatggttaaacctaaataaaaggattcctcacgcaagcttgcaagtggaaaagcaaatacccctattttttgcaaccatggttaaatctaaacaaaacaagtttacaaggttaaccaaggtgaaggtgtaacctagagtcacagtcaccctctccatctctctctcctttttgagcccccagcacagcaatgatgccaccgggagacgagcaaaagaactaaactcaaggggatttcactgtcaaagtgtcaaagcacacggcagtgtcagcactgttaagtgcccagctttgcctaactgtctcctcacgcacacatgtggctctcccctcgccaagtcgcacgcgcgcgcgcgcggcttccttccacgccgcgcgcggaagtgctcggcgtttccgttccccgtcaggttgcagccatgcacgagaaagggacgcccgcggccgagctattggctgtttgctttctctcgttgtcacgacctgcttgaaacagattatccactgaattatgatagtaaataattaaatattttaataactgataacttaggataagtgatgttgtgcagtaaaaggattattcttttcttttagaaaaaaaggaatttttagagaaattagatgaatagcctgcgtcccaatagtgaattatctatatacaattataagttgcgatttctcccgttttcacgaccaaaactacaacagattattgaccaaattattatagcagattaactatacaattataaatataaattaaatatagtaagcggataacttataacaagcgatatgatataaacaattaaaaatgttctctatttttttagaagatgagtttttagagacgtgaaatgagtaacccgtaacaataactgtgaagtagccgaaaagaacggggtcgtggaggcgagacagagaggtgatgaaggggatggagagacgcacgcaggccacagggagggacagatcagagaagaggagaattacagatgctgactcttgacagtagtgacttggctggcacctggttacagagacgcgtccatgcaaacggctggtg

SEQ ID NO: 51756 - DNA, 1926 bp, Oryza sativa
tattaaagtgccattagtaagggcacggccacatctgcatatattcagcttcggcgccggcggcctcacgtaaccatcagtgtccgtagtggccgcagctttcagcacccaaaaaaaaaattcagatatctgcaacctcgtcagtgtcagaattcagacacggctctgcaggctttgcagtagtacggttcagagataggatcagtaccgggagaaatccactgcgtgaaatatctcggttcttcacgtaatctggagtgaggaattccagtcaatttactgcttccagtgcgagtatatggttttttttttttagaaaaaactagtagagtactgtacggagtatgttttttcagctttcaggagtcaaagatgaacagcggatgagatgttggtgattgctactgataacgaataaaatgactcgtggtaattaagtggtagtagtacagaaggactcgtaaaataaggatggggattaggtgaagatgggtaggtagttttaactccaagcttttgatgcacattttggattggtttgtattacacgcaagcaaactctgcacaattattggctaaaccactctgctgaatccgtgtttctgaaattacacgtactgtagcacactgacattctggaggagtataggagtatctctgtgtgatctgatgattgatgtacgtaatgggtcagtgagaggtggatgaagctgaggaaataaatggcatcagcgtgtaagtacacggcaattagttaggagatgtgaaaagggcagcagaagtggatgaatttgcagaaggtacaaatagtcagatgccaccttctgatgagcagttgagcacacaagatcaataattgggtttttacccaatgggagaagcaaacagagttgcagacggacacggccacactaggcagctcatctgacgtgtaattttggcctcttaacagagagcatcatcgaggtcttggagagttgaacacttggacgtttcgacgttaagctcaaagctcacttatgagaaacagagaaagagctttctacgtaattttgacctcttttctacgccaaattgggggcagagagatagagagctcgtgccatgggagaaattttgcagtcggttttctgaacttagtcaacttatcctgtgatctgtgaacgaatgatcaaagtgacaagtggctggtttagttattgagaaacatttttcattcccatagtttcgcctacagcagattttaaaccgtaaggtttattatatatagtataagtaaagcgttttatatatgtttttagtgatttaaaagctctaaactaaaaataaacaacgacgaaaaaaattgaaaatcaacccttaaattaagtctgataattttaaattttaattacggctgataagctgaagagcaaaacggtgaagttgtttggaataggtccacgtacgtgccaccgcagctcggcgactcccatgctcggcgtagctttgcttacggcggcgcgtgccagccatgcaccgggcgggatgacgcgaaaacgaaggcaatttgcatgcgcttttcctttgcggcacgcatcgtctctttgttcatcctcacacacacgcacgcacgctgcctgccagcgatatgatgttagttccaaccgcctagccttcacacaaaacatgtttcagatagcgtgcaaccgaactgctcgccttactgcacagttggtctcacctttcccacaattcccactgtactgttttgtatatcggttgcaaaatgttgggatcgatgagatggaatgatggatcgcatttcgcagaaagaaaaattagaaatggattagtagaaggcaaaaggactcctttctagaggttagatcatgcatgcaggtaggcttttcttaaatcctggtaataattgagcaatttcattag

SEQ ID NO: 51757 - DNA, 1391 bp, Oryza sativa
atgcatatccaagtctcagaacttgtcatagtgtgtcacaacccctttaggatcctacgtgacgttgatgtggcatgccacacgaaatgacgtgtcatcattttgactaacaaatgggtctcgtttaagatttttcctttttctttttttcttatctttttttccctttctactgctttctctgtgacccgagcagaagaaagggaaaaaaaagaagaatgagaagaaaacgaagaagaaaaaaaaatggcacgtcacatccatgtggcatgccacatcatcgccacgtaggatactagaggtgatgtgtcaatttgggacctagatgatacactttgacaagttctgggacctgtatatatattttgagagtttagtgacctatacgacacaaccctacaagtttaaggaccgccaatgcactttactcttttatctataatataaaaaattataaaaatcaaataataaatagtacccgtacaatgcagataaaatttattattattgtttcttcatgtgtagatcgaatttagacttgcatatttgtatagcgtcttatattattatagtctatattatcaaattttatgatttttttatataactgtctaaagtaggtgtcatacatagcagtatggcaggtaagtgtagaaaataatttctaaccgtccgtccgttctcttcgtctccgatcgatcggccagagatctctataaattggcgccgagagtgagagctagccatgacaaacaaacacacactcagtagctcgtagtgttcgtacgtggtgagctactagctagctaagctccggttcaccatggacaacttgtacttgatcctcggtgcaatcctcgccgccgccgtcgtcccgttcattctgttccgcggcaatggcggcaagcgcggccgccgcctcccgcccggcccgccggcggtgccgttgctcggcagcgtcgtgctgctgaccaaggcgctgaccgacgtcgagccggagctgctcctccagaggctgatcgctcggtacggccccatcgtgtcgctgcgcatggggacgcgagtgtccgtcttcgtcgccgaccgccgcctcgcgcacgcggcgctcgtcgagggcggcgccgcgctggccgaccgccccggcgtgccggcgagcaggctcctcggcgagaacgacaacatcatcacgcgcgccgggtacgggcccgtgtggcgcctcctccgccgcaacctcgtctccgagacgctgcacccgtcgcgcgcccgcctgttcgcgccggcgcgctactgggtgcaccgcgtcatcgtcgacaagctggcggcgtccggccaggcaccccacgacgtcgtggacacgctccagtacgccatgttctgcctcctcgtgaata

SEQ ID NO: 51758 - DNA, 6190 bp, Oryza sativa
tacatggtccaataagcaggatgctaacagtaatagcaaggtccggcttgatcgtgctgtcgcaaatggcgagttctcgagatactttgaggactgcctggtggaaaatgtgataacaacatcctcagaccactacgccatctctattgacttgtcgagaaggaaccacggtcaaaggagaattcccattcagcagggattcaggtttgaggcggcttggttgcgggcggaggattacagggaggtggtagaaaattcttggaggatctcttctgctggatgcgtggggctgaggggagtttggagtgtcttgcaacaagtcgcagtgtctttgaaggactggagtaaggcttcctttgggtctgtgcgcaggaaaatcctcaagatggagaggaagctgaaatccctgcgacagtcaccagttaatgacgtggtgattcaggaagagaagttaattgagcaacaactctgtgaacttttcgagaaagaggagattatggcgcgtcagaggtcccgagtggattggctccgtgaaggggaccgcaacactgctttcttccatgccagggcatcggcgagaaggcggactaatagaatcaaggagctggttcgtgatgatggctctagatgtatttcccaagaagggatcaagcgcatggctgaagttttctatgagaatctgttttcctcggagccctgtgattcaatggaggaagtcttggatgctatcccaaataaagtaggcgactttatcaatggggaattgggcaaacagtacactaatgaggagatcaagacagcactgttccaaatgggatcaacaaaggctccggggccggatggattcccagctttgttctaccaaacacattggggtatcctagaggaacacatctgtaatgcggtgagaggtttcttgttaggagaggagatcccggaaggtctttgtgactcggttgttgtcctcattcccaaggtaaacaatgcgagtcacctctcaaaatttcgcccaatcagtttatgcaatgtcctgtacaagattgcttcaaaagttcttgcgaaccggctgaagccttttctcccagatattgtgtctgagttccaaagtgccttcgtgccgggtcgcctcatcactgacagtgccctagtggcatatgaatgtttgcataccatccgtaaacaacacaacaaaaatcctttttttgcactcaagattgatatgatgaaggcatatgatagagttgagtgggcttatctttcgggttgcttatcgaaacttggtttttcccaggattggatcaacactgtgatgcgttgtgtctcctcagtgagatacgccgtcaaaattaatggagagctgactaagccggtggtcccttcaaggggcattcgacagggggacccaatcagcccctacctgttccttttgtgcacagaaggactgtcatgtttgctacacaagaaggaggtagcgggtgagctacaaggaattaaaaatggcaggcatggaccccctatctcccacttgttgtttgcggatgatagcattttctttgctaaggctgacagcaggaatgtccaagcactcaaaaacacgctgcgatcatattgcagtgcgtcgggacagaaaattaacctgcacaaatcttcaatcttttttggcaaacgatgtcctgatgcggtcaagatatcggtgaaaagctgcttacaagtcgataatgaagtcttgcaagactcttaccttgggatgcctactgaaattgggcttgctaccacaaatttcttcaagtttctgccagaaagaatttggaaaagggttaatggatggactgaccggccgctgtcaagggccggtatggagacaatgctgaaagcagtggcccaagcaattccaaattatgttatgagttgtttccgcatccctgtctcaatctgtgaaaagatgaagacttgtattgccgatcattggtggggctttgaggatggtaagaaaaaaatgcactggaaatcttggagctggctttctactcctaaatttcttgggggaatgggctttagggagttcactactttcaaccaagcaatgttaggaagacagtgctggaggctgcttactgatcctgattccttgtgctcgagggttttgaagggaagatacttccctaactcgtccttctgggaggctgctcaaccgaaatcgccgtctttcacttggcgaagcttgctgtttgggagagaactgctggcaaaaggagtgaggtggggagtcggtgatgggaaaaccatcaaaatcttttcagataattggatacctgggtttcgacctcaattggtgacaacgctttctcccttcccaacagatgccactgttagctgcctgatgaacgaggatgccagatgttgggatggagatttgataagatccctcttccctgtggacattgctaaggagattctacagattcctattagtagacatggtgatgctgacttcgcttcttggccacatgacaaactgggtttatactctgtgcgttcggcttacaatctggcgcgatcagaagctttctttgctgatcagagcaacagtgggcgaggaatggcgtcgagactgcttgaaagccaaaaggattggaagggcttgtggaaaatcaatgcgccgggaaagatgaaaattactctctggcgtgctgctcatgaatgcttagcgactgggtttcaacttcgacgacggcatatcccctctactgatggctgtgttttttgcaacagagatgacacagtggaacatgtcttcctgttctgcccctttgctgctcaaatctgggaggaaatcaagggtaagtgcgctgtcaaactaggaagaaatgggttctcaaccatgaggcaatggatctttgatttcctgaaacggggatccagccatgcaaacacccttttggctgtcaccttttggcacatctgggaagcaaggaacaatacaaagaacaacaatggcacagtgcacccccaacgtgttgtcatcaaaattttgtcttatgtcgacatgattctaaagcacaatacgaagacggtggatggccagcggggtggaaacactcaagccatacctagatggcagccaccgccggccagcgtatggatgatcaattctgatgctgcgattttcagctcgtccaggaccatgggggtcggggctttgattcgtgataatacagggaaatgcctggttgcttgctcggagatgatcagcgatgtggtgctacctgagcttgcagaagcgctggcaattaggcgggcactgggtctagcaaaggaagagggcctggaacacattgtcatggcatctgattgtctcactgtaatcagacgcatccaaacttcaggaagggatcgctcaggggtgggatgcgtgattgaagatatcaagaagttggcgtccacctttgttttatgctcttttatgcatgttagccggttgtccaatttggcggctcattctctagctcggaatgccgagctgtctacctgtactgtgtaccgttctgtaataccggattatatccgggacatactttgtgatgatgttgcttaatcaatgaatggcatgccgcctttgtctcaaaaaaaaaaacaagcttgtgacttgtgagttgtgaggcttgtctttccgaggagagttgtacagtagtcggtcagtggtagactggcagtaggagtagtagtggtgcaggtgcagggccatgatgatactccactgtacatgtctgcatcgataccctgcgccgggcggccaatgattgcagctgggtgcagcgatagattattggagaggggggcgtccttgtcctgacgacacatgcccttgccttgcgtcatctcgcgtatggctcagaaagcctgcagaacatgtcagagctaggagtagctagctgctggcgtaccagtgctcgtatggtatggatcgtttttctaaaaaaattctgaaaagctacgccagttgcgagccttttggttaaggaaaaactgttataaaacatgtgccgacgtctgcgcaggagtaaaataaaacagtgcagcgtgtgatcatcagtactgagtactggtagtacatagaggtaatgtaggattaataaggatttgcatcgctcatgggctcgtttgctccgagattaacctgctggtgaaatggcacctcgacacacatcaacccctcccctctcatcagtcatcataaaccagcaaagaaaagcactctcaggagcatcgaatcagatcgatcggaggagtactacaactgggtataaagcgtactagtagtaggctgctccaaaggcagatcaaaggtgagaccaaagcgaagcaaactcgcaaaggcgcccaaccttttgcgatccatgccagcagcaacagcccccctatcttagctagctatccacgggatgcatgtgccatgtctgatgtcttcgctagcccgcgcccggtctgcgtcgcgcgacgccgtggacgagcggctcgcgccagcgtgcgtggctgctggctttgctggtgtaaaccgtgtaaaggcgtgcgcgcgagcgcggcgaacgatcacatggcgtggcatcattggcacgcgggggagggcccgacggccatcgagacgaacgaacgaaagaacgacggcgagctagatacttcccccatcccaaaatggacggagacagtactccctacatttcaaattgatctatatattttataggtacatcgagaccaagaaaaactaatacggagtaactctctcatactatatttactctagcaacaaactcaatgtatacaccatccctactatttcttagccaatagcaaatcaagatattgcatgtgggttataaatacttgtgtgcatggatgcatgcatcaatgtccatttactccaatgcacaaataacgaatagacttaataaatgaacacaaatatgtagataatttaggaataacataaaaaaaattatatgcagatcaatttggaatgtagagagcatatatctaggccgttggctctgtagtgatactaatttcttttcgttttctactctctccataaaaaaaccaatctaaatttatcccctcttaatacaacgaatctggataagagttgtctagattcgtcacaggttgttttctttttgggacgggggagtacgtaataacccacggcatcgtacgtactcctggtgttgccgtatgttgctctgcgtcgtgctatacggcctactaccggtacacttattcatacctcccccacaatgcaatcaatcatcgatcgtgcactaatgcactgtgcattatgcgtattgatgtgtatatatacatacaggtagtagtagtactggtagttgttagatgcgtacaaaagacaattcgtgctgggatttcttgtacacactcgcgacgcgttctcccccatcccgtggtattatcaccagcgactcgcgccacccaccggtcgcgttgcttgcgtcgttggcggcggcggcggcgagcagtcacgtgacgggcccgcgtgtaccggattctgtccgacgtggcgtgtggggggggggtgacgtggcggggcgcgggggatttgaatttggtgcgggcggctgagatcggcgatcggatcggggagggatggtgggatggggcgccaggctggcggtccaaccttgcggcgtgctgggtggagggccccacctgccatgacagctatactactacagtagctagcaaggactccaggagcacgatgacacggactggaggaactggagaaggacgattcatactgcatttttgccaagattcgtactagtagtatagcttttgctcgaatttcatctgtttttgcggttctgccgaatcaagcttggctcaccgacgcatttgcgaattgattggcgtttaaggtactgtttcaattaagatacagattttacatcggtctttgttagcacgttttttaaactgtcaaacactatatttcatgcgaaaaatttatatacatagattgatttaaaatatcatataaattcatttttaagtttaaattaattaaaacttaattaataacatgctaaagttttttttacgtgcgtacacttcatcttcacttaaagcaatctcaaatagggcctaaattatgtacgattgcagatgtaat

SEQ ID NO: 51759 - DNA, 2815 bp, Oryza sativa
  unsure (1)..(2815): unsure at all n locations
gcagagatcatcacatcacacatgtccaacaacaccatctcccggcctctcatctctttcgatcatggcggcaatgatggattcgccatggataaggtgaggtccagagcatgtgagctaatgcacaatcttatcctcctccatggtagaccaatggcaaatggcactatctcttcgatcttgttgttcttggagaaattaattaatatatagaatggttaatcgctttgagtgcattgcaactaacagagcagtagcacgttaaccctgcaactaggtaccaattatgctctgcgaaatgcaaggtcttattggcctctcgatcaatcaacatgtatctactactactactaccacctactgccagcttggctgcttgcattgctgatagatcactcgattaccggttaacaacgatgattaaaccaagccacatacgcaatctctgagaatgactgttccaaagtaacactgtgcatttgcatgtgggagattgctagagtaattggcaatgctgataataacattcttgatataaatatatttgaaagtaccgtttgatgggttgacctatcgatggaagtgaccaagtatgtcgaggatgtccctcatgctgctggatatgaccacagcattgccccaatgacaagtgtttggcatgtgccatgcttcctctaattaaactccattatggatcaacgcagaattgatgtttctgcatgttaggatgaataattataggttggttgatgatcacagcagcaatgcagttgggttgttcatgcaattcccccttttagctcaccagctaggaaccctttattctctcctgaactgttcattcccatggatggaattttaaaaaaaaaaatttaattttttaaaatctatatattacctcaaatggatcatgggtgatcatgggaatcattcactaagtatgcatgcaacnctnttnntactnnnnnnnnnnnntcttttggtncagaggcaggangggnnnnnnnacctcatgctaacatttagcatgggcttgtgtactttggatgacacaaacttatattgttaaacttccatctaaaaaatggctgtgaatgacgtctggtagtaggtggatgtgacataattacatatagtttttagttagtagttgaataattggattaacaaatgcccctcctcaagtgcatgcaaaaggtatcctactttctgattcattgttgcattgcattgcaccccgtgaagaagtagctactacaatctggactacttgatgtttggttcttgcagctttttcttgaacaacctgtacttagttcagttgatatatatcagcatgcaaagtttattattgttcagtgctacttgcaagtacatatctctaatatatactaacaattacttatatgaatcattcgaatgctagcaagatatgattctctcaaggtatgcattgctgcaggagcagatgaagaagagatttttcactcactctttacattgcaaaggacaggcatctttttctggctccaataatcagatgtagcagcagctattagcaatgaaacctacagttgatccatcgatcacctgatcatgtaactgacggatgcatctgcaatgccaacttaatcagttaattggtggtctcaggtcgacatgcatgtgatgtgctcctgtttagggtatcaaaaattaaggccataatcgtaagcaaggtgtaaagttgatcacattctcttcatgctaaggaaaggcgatccttgctatccacataaaaaatctcaccttccttggaaagacatcctgttcaaaaattctttatttgtcactgcttactaattgtgctaagaaagaagtcaatgcgaatttgtgagagaatttcgttgaaatgcacgagggattaaacaattcacaccacttgctggcttgctgcaaacgcaagaattgtaacatttcgaactggatataatgcatttgcattaacgggaatcgtcgcactggatatgagcagagagctcgtggctttgaattattgagagagatgaagagaggatttcttggcgagctaagctaaggagagcgcgcatgatccaaccaaacattccagccaagcagctcaagtcttttcttttcttttctgattccaaacaagagaagagaatgccttttactttagcatccacttgagttgtcgcgctccatgctctatctcatactactactcttccatccaactctacctagctagcttagctagctcttatcttgctactgtctcaactgctgcacaaataattcttcagtaaccaaccatttttttttatcgctgccattttgccgccatcctttcttcaggatcgcagcattttgctgtcattatttcttcgggattgaagttccatctacatgaaagatgagttgcaaatagtgtgatgatcaattatcagttgcacagctcatctggttggatttttttgttgattgttcagagtttcagcatttgagacatggtccatgatctgccgacatcacgtgaaacgagtgatttttttttaccacctgcaactgaggtaacatttgggagatgtaaagggccagatagattttgaccgaccaatctcgtcttaacatatagtactacattttttttactgcgattagatctgaaattattttactgcacctggtaaccacgcacagtaaaagcttcattttgactcagaacagtctgccatcccaaatctacagccgttgacagttaactgaactttcactagttcaatcactcaacttataaaactgccgtcagata

SEQ ID NO: 51760 - DNA, 3928 bp, Oryza sativa
  unsure (1)..(3928): unsure at all n locations
tattaacaataacgctgtaaaattacatgtgtctcttttttttttcaagactggtagcatgtccctgtttaaaggtgttagtttcataaccggaatgtctctttgttaatttaattcattagtactctccacaaactaaaattacaaattcttttttgcgagacaattttcaaaccctaatgctactgccaatggtggtgacagattaactcaagcccgtacgaggacgggtggatgatcaaggtgaagccgagcagcccgtcggagctggacgccctgctggacccggccaagtacaccaagcactgcgaggaggaagacgctcactaggctcttcctctctgttttttttcttcccattttgtcactccgacctaatttctccctgttgcaacaactgctctgtatccgtatacgattaataactgaatcttcaggctttgccatgtgttcagttggttctctgaacttctggtgggtctatctatttatctatgcttaattagtcacttcaagccagtggtctgtggaaaaaaaaaacaatgaaaaaaaaattggccatctatctgctcaggagcaaattataacggcttatctatgtattagaaaaggaaacagcaagttcttgacatgtacaaatcggtacgtgttaatttctagttttagaaatattaaataaaaaactaaattaaggatgcatgacaagttaacttggtacttgttgattttaaaatacttaaaaaaaattaattttaagtactgtaacttagtaatacttagtacttactattaattcttaatttaaaaatatttaattatgaaacatagaaagtaaccgaagattgaacattaattttttggggttttntttaaaggggttttttacagtgacattcacagttgacttcaataacacataaaattaggatgcatataggagtactaaactaaacgtacagccaatgcaaacgcaccgagaaaattcagatttcatcacaccatgacaccacaccggcgtttctaacaagtttgtaaataaaaaaaaaaactaaaataataataacaataaaattagtacgtgtaagattcaaatcggaattaaccgggggaggggtgcgtgtgcgtcgcgggcgaaagagatgggaggccggttttccgagggaggttgttgggcgtgccgtcgccgacggggacgcgccaccggtgccggtgcgcgcgcgggcgccgtcgcgtcgcgtcccccgtgaccgcctccgggcggcaccggcagcggcggcgtcacgggagcggcgcgcgggcgcgtcaacgtcgtccgcgacgtgggtgtgttttgctttgctcggctcggcgtgaggagagcagaggcatcggcgcgtggttggtttgggggcaaggcagagcgcgggcgcgtccacatcgggttcaggtcaaatcccctaatcatttcgctaatttgaccggaattattatcagcaaacacctctatacaccgtggtgtaactggttctcgtttttatttcaaactaattactccctccgtccatagtataagttgttttaattttctttctaatcaaacttctttacatttaaccaaacttatagaaaaaaaagagaaatatttatgatgccaaattagtttcactatatataaccttgattgatagtatatttgtcttgtgttggaaatgttattgtgtttctttataaatttgatcaaacctaaaaactttgactaaagccgtgtttagttccaaaataattcttcaaactttcaacttttccatcactcaaaactttcctacacacacaaattttcaacttttccgtcacatcgttccaatttcaaccaaacttttaattttggtgtgaactaaacacagcctaagaaaaaaaaacttatattatgaaattgagggagtatgtgccagtgtgttgcaacgggaacaagagataaaaaaacttgtaatttagtttcttttatatcggatttggaaataaaaatgaaattcggttttgtttatgctggtttttcacgggcttttctggagctgtttttctagggaaagagtagaacgactgtgcttttaaagtagttaagaaatgaagtcaggctgtttgaaccaataagcggtagaaacacggaaaaattagcataaaattatttataggtaaatattgtatatttatattgttctcagtttaaaagtcactgctgggaaataaatttcaatgagaagtccccaaattcaactgtaaaattgcgttttagattttatttatttatttttatagtcgcacatttttttagtttgctaatacatggaaatcgtcaaatgaattgggcaagtctgatggaatgcaggggaaatataatcagattagagtaggtagcagattatcaaatgtttgcaagttctttcgattttggcccgaaggtaaccagtacgtactagaggagtacaaatgtagaatacggttgtttgacttggagatacttcagcattatggagtagaatactgctcctactatagctggtcagagggcagcgaagactgagttgtcagtgagaaaagggaagcgaatatatgcgttcagttcagactttcagagacgctctttgaaatcctgggcgccatgatccaatcaattattagcactcttcggtacagcggaataaagttgtgttttaagttcataatgctgtatttattcttgatcatggactatacttaccagatttattgtttagtacatctaaactcttattactgaaccctgctgtcaatagtagtagcagtacagaatcaagttgaacatagaatatatacatagttttctggaatcccaactctggtcgaaatctaaatcaatcatcaacaatatgaacagaaacaggaggcactcggtgaactttacacgaacaaacgaaagaataaaaaccaaaatctctttggaatcgtaaaatggacgatccattttcataatcacctcaccctcccaaatcgctgccattttttttttgcaccacaatgtgatcgaaattcctccattagcacacacaaaccccaccttttgatgctccaaatcttttccaaatcataccactactactttttttctcctttttttgattcttttttttttgaggtgctcgcccactaccccgctttgttctaagctccacccagtaggaggggtccacgtgtgcaggtgacgccagatgacgtcatcgtcgtcatcgcaagttacagctcaccaaaagccccccagatctaagcgcctaggattcgacacgcctcgtgtgaatcacagcttcccgtggccgtcggatctcctcgcgacggccgagatggagccgtgcgcgccctgctccagcgcgcgcaccacgtcggccatcgatggccggaggctcgggttctcgccgacgcacgacgccgccagcgacgccacggcggaggcctcgccggcgtcgtaggcgctgcccagcctctcgtcgaccagcatgcgggcgtcgcaggcggcgcaggaggcgggcctgaggcgcggcgcgaggacggcggtgaggaggcggccctcggcggcgcagaaggcctccatgccggtgaggagctcgaggaggaggacgccgaagctgtacacgtcgctcttcttggtcaccatgccggagcggatgtagtgcgggtcgacgtaccccggcgagccgagcatggtgtgcgcggaggaccgggggcggacggcagcggagaaccccatccgcgccgacccgaagtcgcagagcttggcggacatggcctcgtcgaggagcacggggtttttttcctccgggaaaacccccccccccccgttgacgtcgccgtgcaccaccggggctcgcaccggtcgtgcaggtactccagcgcccgcgccacctgcagcgccaccgac

SEQ ID NO: 51761 - DNA, 3953 bp, Oryza sativa
cgccccagccacaccaccctttcccccctcctcctcctccccaaatcccccgccgccgctgccgccgccgcagtccgcgtcatcgtcgcaccccctgtcaccggcggccgaggccgccatgttcccgccgcagccgcagcacaagaacctgtatctctgccacatcctcgcgctcgatctcagctcgcgttgctccttctctgcttcttgcacccacgagaagaagaagaagaagaagaggaggaggagaggaaaggcgagaggaggaagaagaagaagaaaggaggagactttgtgtggcgtttggggctctgtattgtagccttatatattgctgcgtgtggggatttcagatttggtgggggtgtaaactgcaaaaaaaaatgcaaagacaaattaggatgagatgttgagatgaactggtgactgattaaaaaattgattattatgcaggagcagaaagcagagcctgggggtgagtgactggcatgtggggcccaccttactcactcactcattcactcactcgccagtgttaggttacaacaaatacacttgttaaacatgtacaggaaatccgttttgagctcaccttcttattccattattccaacatccctggaatccaatagattacactgaaattgaaacaattatggccctttttggatgggctaattattggattttagataaatcgatcactcataatgtgagctataggtacatgtatacgtggtagcttaggtagctccattggattagattacagctgaaacgccattatatgtgacacaggacagttatatttccttcaagatccaggatgtctcacaaccaccattgatcgtctaggtgaggtacgaaatgatgcatgcaatgcaaaagctttttcatcccatttattaatttgccgctgctacactgatcactgatcagctagctcaaaaccagagagatctagctgattaaccacccagccatgcattagctggtaattaaactgtgcaattaccagcagtacacttacactgacgacacaaatcctctctttctataaagttacagccacaagctcaacatgcgtgaagctaagatgagccattcgatctctctcatgcttaatctcaaccgttcatgttctatgcaattatattccctattaattactcaacttatttagtacctactttattgctaattgttcttgcttatttatttaataaaatttccatcctccttaaaaaatggagatatggagggtagagacgcctctccatttttttttaaagaaaaatatgtaagcgtgttggggattgaatagggacctctgggttgaaaccacacgtcccttctcactaaactattaagtgcatccaaaattttttttattcttatataagtgtccgcagcaatggatggggtttcatcgagtgacagtaatgacaaccaccatgtgatggagcttgggggtccgaggaggcgacagagatatgaccgggatggatttggttggtggcgtcggcttggtcgatccggccggtcgccgtgcatggcccggccggccggtggcggtggcggtggtcaagggggaggtgtggagctaggagacgacgacggctggtgtggtggccatcacggtgggcgcagcgatcgatcgatcgatctgagcggagtcgccgcgattaatgtgggtttttggttgcttctgatgatctgtcagcgacggattttgtggccgcgttagcgagcttattagcagaatgctttgatttgtccttgaatgcatgcatatgcatctaagaaatcatggggtgtgatactgagatgagtctgtgatgctaattaggctgcttgctgctggaagcttgcagattgcaatgctcgagtgttgttggcgaagtgaagctggcaggctcgaattaagctcgcatacgagtgtgctagatgctggaatgaaaactgtcgaaaacgatatcatgtctatggaaaatggttctcggttggtcgagaatttcatatactcaatttgatggcgatatcagtacaatgttgattccagaaatcataaaaatcaaagttctatatatatagggatagaataaaaacaattggaaatggtactacttttacaaaaattgtgatactcggtcgatcaggaatttccgccaccatgttccccttgtagtagtatctaggactcctgctgatgcagacgaaaatgcagtccttggtggtaaaagaaatatctctgttctctgaagtcacaaggttacatcagcaaaagcaacattttgcttgtaaaccctgactaaaatgtcagtatatagttatgcatcagtacttacttgccttctgctgttactactacagttactactacccgtctaacctttcggtgtttcagatttgcgagttaataaagctgagcatagatgaacagcttttcaaaaggagagagaggggcatgcattgcacacatcggattcctgaagctcacagaaagagagctagtatctctcttcacgatcgatcgcgttcactgaactcaacacatctgcatgggctgcgtacggggagcggttttaaaaggtgaaatttattgcttccaagctactgttcttgctacgagcagctagccatcctgttcttgctgccctctctttaatctttatggatcgaaccgtcttaattcttcttcttcttctgatcttcccctcttttgcaatgcaagggcatctcgccgtttggatgatccaacaagacaagacactgaaaatgtgacaagtgtaggagtcactggggtcaagcaggagtaagtgtgcttctacgtacagctgcacctgaaaaagtgagcaattgatctctcgtaatgaacacttctggtttactgaagctcaattcagagaaaagttcagaaaacatatatgtgaataaaaacagtgggaggagaggactggtgatcatttgactcggtttgggaccgtcggatgatggctcgttgcatgatctggaccgtccaccttgcgccgatatcacgaaaccatcaaggttcaacagtgcattggcttgtcagcattagagagaaaaaaacatccggtggcacgcagcaatcagcagcgtttggttcttgggagggtgctgctatgctacggatgctgcagcaagaaaagaaacctgtactgggaacaaaaagtcgctgaggctaagtcatcaggaacagtagcagcatcagcagcagcttgggccttactactaattgagtaggccaatgagcaatcatttggtgctgattcggatggctcactgaccacaaaacaaagcactaatctgcactgtgttgcaaaatggagtacgtccaaatgctctttaaggacaaagtgatggtcacagtgaagcatcttgatgagtgaattttgggacgccatagactttttcactctgaaacagctactagctgagatatataattgcaagtgctaccagtagaagtgtagaacacagaacagtgttcctggtgatggatgatgacagaattgcatgcctacaaagaaaatagtttcagtcagtgtcctgaatcactgaaaatatggctttctttgattcccagattgtctgtgaatccttttcagagatttagtcatcactatgttcaactctcgtgagaaagatgcaaacaaaagaatttgcatccgagattaggtccaagtattaatttaagcagttacacccagcgtcccggacaagaaattcagagctttcttcagcaggttactgtcatttttcacggctacctgatttggtcactgattgctgtcctgcaacagtgatctgcaaggtgacgaaagaaactagctccgaaagcaacggcagaagcgagttacatgtcacattttggtgactttccacggcgaattgcaccgtgtggatcacatgtgctaaactaactgtct

SEQ ID NO: 51762 - DNA, 1213 bp, Oryza sativa
atatgcatgtcaatcactccacattacatttcagttcatgaaaaaaaaatggagaacgatagccattcacccactaatttgatgaatctgccgccactatactacatgtgactattaagaaaaagctctaaaccaattcacaggaaagcactattgcttctaaaaattgtgaacataacttgaaactttgaaagaaagaattctaaagagtgatgtctaaagagtgatggacgtcatcattcttgctgcatatcttacctgtataaagaagttggtacgtcaaaggatatttgaccatctggtttcggatattgaataggcgagtgcaaactggccatctgttcacaagaatgtgtttggttaatgtcagtagtgaaaaaatgaaacaatgtgcttttcatttatgctaacaaagaatgtctatattagatgagcaccagcagtacttgaaactcacatctgttgcttcatggtcaggtatcccgtgctttaaggtaaagggggactttcctttgaatacgtatctaaaaattgaacaataacaacaaacgtcagcgaaccaagtagagtattgacttcatcccaaaagaagtatagaatattaagtaatattaacaaattagttgggcctcaccgttccagtgcagacaaggcaatgcctggaataaatccatattcaaatgcctgtaacagaatataaataaatctgtctgctcaatagcttcagaaaggaaaaaacagaaactgcatatcctcacttcaaaagcttgtatgacggaatacttaattagacaaaataaatgttcaggaagtctgtaacaaacataatcacatactggtctgtaattccgagctctataaagctcttcccatatccatgacttcttgagattctcccaatagagttccatcgaagatccttcaacaagagttttgaaagttgcttctgcagccagcatacctgttgtacacatccaaccctttagtacatggcttctcagcatactctacagttagcacacatgatctaccatttttggttgagaataatgtgccactttaaggagatcaaaatgtgtactctgaaagaaatgtaaagtaattgacataaaagtgaacaggcagcactacaacataaagctcaaagcatcacgtaaagagatacctgacttcatggctgtatgagttccttttattttgggaacattaagga

SEQ ID NO: 51763 - DNA, 1814 bp, Oryza sativa
ccaattcttcagctttggaggccatccatcgcaccatttggctcaagctggacaatattaagcattgtttctaaaatcagatactgtcgaataagtgaaatatactagaactttgcatagatgaagctaataattagaagaaaatctcagcaccttatcacatagtttcccttgttatcgaaaggagatggaagtgtccatgccttattctttgtcaacagccagaacttgtcagatgagacggggactcttattggggtctatcaaacacacagtaggcacataaatatcaatgccttatgtacttagaactaaatttactttgttactgaagtgtattttgctatcattattcaaggaactgccatatcaaaaggaccaggtcttattcattgggaatttgggacatctcatgatgcaattgttagtttgaaactgttactgagcatcaactaattaaatttcgcccccccccccccccaaaaaaaaaataaataaataattattattattatatatcgtttatttctgtgcatttgccctacgcaaagcaaaattagggagctgaaacatcctcatacaccaaaatatccatgatttcccatgatcaaatgaacctcaggcttctgatgaagggatcaaccatagttaatttgcacttggtctagagtctagacagcagaatggccaactaaaacatacttatatagcatatccagtttagagcagagaagggcatacatcctcttgcctccacttcgggatgagttcatccaacgctcgtggctcgaacacgttccccgacaatacatgcgcacctgcagcgagagcaagcaaaatcaaacaaacgccaaattacacgagcaggagtagagtaacgccatcgcgcactggcgtgctaagacgcaagcaaccggaccgaagggggaaccgattccggaggaagacacgcaccgacttcggagcccttctcgaggacgcagacggagaggtcggtgtcggcgtcgcggcagagctgcttcagccggatggccgcggcgagccccgcgggcccagcccccacgaccaccacgtcgtagctcatcgcctccctgcccccgctcagccacctcgccgccgccgccgccgcgccccacctcggcgcgcggtggcccgacgcgtggccaatccccgccgccgccgcgcggagcactcgttgcattgccgcgggaagcttcccgatcccgagccgaaagggaggaaggagaaggccgggaaggtacggaactgtggaggaatgggagtggcagttgagctccgcgacgggacggcgatgggattaggtcgctgaggtggaagaagacgaggacgaacagtattcctttttttttaattgaaaactaatactccctccgtcacaatataagggattttgagtttttgattgcaacgtttaaccacttgtcttattcaattttttttacaaatataaaaaatgaaaagttgtgcttaaattactgtagataataaagtaagtcacaaataaaataaataataattttaaatttttttaaataagacgagtggtcaaacgttgcaagtaaaaatctaaaatcccttatattacgggacagagagagtaataataattcgctctgttcatgggctgtttccgggctagctttatgggcctttgaacacttctactagtttttgggccttacataaatgggccgttacatggtgatgcaggctggagtttgggcccatcgaacaaggagcatggtattgctgggcttctttcggcctgccccgctgttcaagggggctgcagg

SEQ ID NO: 51764 - DNA, 1459 bp, Oryza sativa
  unsure (1)..(1459): unsure at all n locations
acaaccccctctcattttccccctctcctcctgagccaagacaattccctatcccctcatctcactgcagctttccactatactaccaccaccactgagctgccactactcatccagctaatnngagaaggaaaaaagaagaacacagatactttggtaacaagcaagaaattggcacagaaatggctctgaggctgtgggctagctcagctgccaatgccctcaagatctcatgcagtggagccaccagggctgcacctgcctactcaatctccagatacttctccactggtatagctagcttgagtagtagaattcatatcaaataaattttctgttgccttttgcaacaaagcatgtggttgttacaatgttctggttcctgtacagtcttgcattgtgccatgctatccttgcacccagttataaattgctgtggcttccttttttcttttctttcttttttacattctatattgttacattgactggtccatgctgtagttatacaccggagacatactaaatgattgaaaagggaagggaataaaatttagaaattccagttgttgaaaagagttgagtatacttgttgtaactatggtccctgttgatttaagccatggtgatgatttcatgctggtattgcagttcttgatgggttgaagtacagctcctctcatgagtgggtcaagaatgatggctctgtggccacaattggaattacagaccatgctcaggtgagccaaccaaaggagaaaatattccatgcctttcatgtgcaacaagattagttaaagcttaatgcatttctaaacagggcctaagtgtcaatttgctgttgtattctaaactacgtggcatgctacaaaatcaaatattctgccctctgctgcaacaactaacaacccttttcctgatatgtcacagaacattttcctttactacttttaagaaatatgatgaagtacctttgctgtaactttttttttcaaactaaatagaacatgtcttttgttactttaataagaaacaagataaaggaactaacttccactgcagaatgctagccagttactttttagtgctacacagtaatgatggcaattatttgaaaacaaaagtaacagtaagatggggggtaaaaaataatttgattggacctgactagatatatatttttttagataatgaatttttattaatccggtctctgtattcatgagggatatacatagccatgactagatatgtatgtatactcgcagggccatctgggagaggtggtgttcgtggagctgccggaggcgggggcgaaggtgagccacggaggtgcattcggcaacttggagagtgtgaaggccaccagccgacatcaactcccccatctccggtgaggtcgtcgaggttaacgacaagctctctgagacacccggcctggtatgtactcccaccgtct

SEQ ID NO: 51765 - DNA, 735 bp, Oryza sativa
cgcggctgggcgctcttcgtcgactgcgacttcctctacctcgccgacatcgccggcctcctcgcctgcctcccctcctccgaccccgaccaccgcctcgccgtcgcctgcgtcaagcacgagtacgcccccgccgaggcgaccaagatggacggcgccatccagaccgtgtacccgcgcaagaactggtcgtccatggtgctctacaactgcggccaccccaagaacgtcgccgcgctcaccccggacgccgtcagcacccagaccggcgccttcctccaccgattcgcctggctcgatgacgacgagatcggcgagatccccttcgcctggaacttcctcgtcggccacaacaaggtcgaccccgccgacccgtccacgcagcccaaggccatccactacacctccggcgggccgtggttcgagaggtacaggaactgcgacttcgccgagctctggatcaaggaggccgacgagctcaaggccgacaaggagaagcagaagcagcagcagatcgtcatggccaacggcgagaaggagaaagacgaggaggggaattgaatcgaatccaattgaattcattgtgccgcattgcgttgcaattttgcatcgaattggttcaaatctgttgtttattgggttggggttgggtggtaggctatgagtggatagctctagtattggtagtagtacgcttttgtgtagcggcaaatcaatctatctatgagtcctcaa

SEQ ID NO: 51766 - DNA, 2528 bp, Oryza sativa
aacctagtaagtatcacgtgatacatagcagaattcgtcggtacctgacatgatacctcgccgagtatcacgcgatacgtggtagaaatcgtctgataccttacaggtatcacatgatacctcacgagtatcacacgatacgtggtaaaaatcgtctgatacctgataagtatcacatgatacctcacgagtatcatacgatacgtggtagaaatcgtatgatactgtaacaccctaaaaaaaaaaggcaggcaagctagcagcagcagctgggccaggctcggtagcaggccggcccaagcggcagtagtagcaggtcgctacagtaccgtcgtggtactgtagcagccgattagtaccacctcgcctaactagcttgaggagcaccaagatataaggacgagagcctagaggctgttaactctgattctggaatttttgctttaaagcgaatttttgctttaaagcgaggatgaaaaacgtagtgagttgcagtattaggtgtggtccaactaaatgagccgttttcgggccctgcacaaatggtatcagagcagactctcgcggttgcgcgtgcgggcatatagcgcatgtgggctccgtgtgaggcacatggcatatggcgccggcattggacggtacggtcgtgcgccaagagagggcggcgtgttcgacagttcgacggggtcgtcgaacccctgagggtgggtggaatgtaacaccctaaaaaaaaaaaagaaaggcaggcaagctagcagcagcagctgggccaggctcggtagcaggccggcccaagcggcagtagtagcaggtcgctacagtaccgtcgtggtactgtagcagccgattagtaccacctcgcctagctagcttgaggagcaccaagatataaggatgggagcctggaggctgttaactctgatttcggaatttttcgttaaagcgaggaccgaccacaaatagcgctatctggtcccaaaactaatgattcggaaaccgacatgtttatactgtatcaagcttcggaaaccgaccacaaatagcgctatctggtcccaaaactaatgattcgattcggaaggagtttatattacaaaataataggggaatttacaaaattgtggctaactaatacaacagaagctataaaatgactcaatcctaatgttttaaaattgtggttttactatagacttaaaccatctaacaaatctagacttgaaaactaggttaaaatattgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagttgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagctattatatttaagtatgaatgtatgaaataatagtatttgagtagagctagatctatttgcagaaagctgagaaattagaaggagaaagtctataatgtgttgaaatgcaacagtatttaataaatctggagttatatttctaaccaagatgccatagtgagtcccgatgctcaatatccgtgagcacggctattcgaatagtttcagagatactcatactgcagtagatgtacgctttacccgcaatccatgacatgctaatattcatcagcttagtcatggcaaagcttttcggttactaacatcagtggcacctgttccatgaactctcatcctcatgcgctctgaacgtaacgttatcagcagcgagaggagttctggcgttcccgaggtctttagagagaactggttgagagacccccgtcgtcccaaccaggttttcacaatacacacacagcgcgcaataatcaatatatttacccgcgcctcggtaaatattataatcgccctgctcggcgtaaatttgcctcctgcgcgaggacttaaagaagaaccactatacagaggtaccacctttgttagataacctactttgctaagtctgtccccattctagaattgcggtcgtactcgttcgttcttcacatgtacttggcaatcttatgtcggttggaacagtactagccacccggaaatcaaccatttctaccgtactgttccaatctaagttcattatattttatgcaatctaactaggcatggctaagcaaaatctagcatatatctggtttgctatatgttcaagttatgcatttaaaatcatgaatggctaatgcatggaataatagagatatagaatataggataataatgctcaaaggggtggaataataacttgccttgctccaacgcaaacaaatccgagataggcaacctgattatccgatcctcgaaacat

SEQ ID NO: 51767 - DNA, 3980 bp, Oryza sativa
aaagaaaatatttgaaaaggcaaatataaattcaaacgatatttgaatagattcaaataaaattataaaatagcaaatttggtgtcaaaagatagggtttgaatttagataaatttaggtccaagttttattggaatcggatctacggtttaggagatatgggcttctaaagattgggttttgaattaaatctagaaaatgagaaaagtcactgtgcaggggacccacctgtcaggcttttctttttcttcttctttttctttctctccttcttcctctcgttttcctttcttcttcttccaggctcccagccgagtaacagaggagggagaggattgggcgccggtgctccggtagccggggatcggcaacgtcggtggcggattgcgttcccgaacaacgcgcatccggggaaggcagtttcaagcgaagggagttagagaggaagccggaacggcgagtggaagagcttgcctccggcggcaaaagaggtggctatggtggcttgatgaagtggttagggaagaggggaaataggtaaaatggattctccttgtcgaggcgaacccgatggtgcaagtatttggttggcaatgctccagtgagggagatcggccgatgactggtgagggcttgccatggcaggagagagagagaagcagagcttcaagctctgttgatgtgaggaaaaggagggtacctcgccggctatttataggcggcgaaggtcggttgcttatggcggttttggaggagtaggtgaaggcaaacacgatgatgcatcggcctgtaggaagggaagtcggcgccggctctgtcttcgattggccgatagtgtcggttcggctcggcggctgacggcggcagcgtgaggtggcggctgacgtcggctgcggttgcttagcagcgacggaaagacggcggcggcagttgatgaacacgacatggcgacggtggcggcgcgacttggcggcgacggaagaggagcttgcggcggcgtgcgccgtgcgcgtgtacgacacgcactgggaggagggggcggttcggctggggttggctgggccgaattgggccggctcggcttagctgggccggcagcccgagagggaggaggaaaatagaagataaaagaattgggccaaaaggaagaaagaacggagtttcggcccgatgacaaaaaggaaaaagtctaatttgaatacttaatatgcaaaactaggttttgcaaagaatttgaattcagaaagaattcacaaaagagatttcctaatatatttgagtgcaatatttagaggtggagtttgagggaatttatttggaagcactcaaataggaagggtgagcgatatatgaataaaatttaatatgtaaataggaaggtgggaacaagatagttggagaaggataaatagggttttagcctcaaaacatatggcatgggtttcaaagaattgtttgaggctaataggaaatttgaatgacaaagatataatctattttcttagcacaagagcaattattcacaatattcgtaataatattattcttgtgccgaggaggaaatcaagccacaggaattaaattgacggctagattggaagaaggaatttggatacaaatttggaaaggggactaaggataggtttggaatcaaaggatagattgacaattaattccaataaatttggaattgcttcggttttggttcaaggatagtgttggaggatttcttggaccatgattcataaaaataaaaaggggttttcaaactaaatttgaataaaagaattttagtcaaaagaaggtttttaaattaaaacccaaaatcaagaaactccttaatttaactaaatatatttttaaaggaaagacacaaaagaaattaaataccagaaagagatttaatgcaggttaattttaggaggtctctttaattataatatcctaggtttaggaggttaataaaaacgtaagaaccggtatgatgcataattagaaaatagctaattttcagtatgttacagatacttgataagtatcatatgatactttgcaaggatcacctaaaacgtgtgtaaaatcatctgatacctgataggtatcacacctgatacctactcgggatcttcccgttagaaaatgggattccgttatatagcagccccccaaagaaaagatggatagtacgcagcgcagcgattcggaagtatgtgtacgacgaggagggcgattctcaatttcaccacatcgagaagagaaaggcggaggctggcggcggcggtggcgacgacgaccttggcagtggccgtccaaggcgatgacggcgacttggactacgccacgatggtcgcgcgcacggctcatttcctagcggtggtccgtggtcgagcgctacgcccggatggtgcacaagctagttctgggactaagttgacgagtatcatgtgtggaatgcgatcgtctcgacatggagcacccgtcggccgcggctgtcgacgatgacggtgacgaccggcctgcccccatcgccacatcgacgacgtgcggtggactgacgcggtggagcggacacggtcagagatcgaggaggcgagcgagcgcgagtgcgtcgcagtctacgagctgtggaggaaaaggtggtggcagtgtggagccgtaggtgggatttgggagaaaacaacacccaatagctgggaataccgcgttagacacttagaaaacgcggtagcaggcagccgtcgtagccgtcgaggaagacctagctcaacaaggcgtcggagacctcgtcgccgcttctgccagctacttgattccgctctagtcctggaggcgcgcgaagtcatcgcggaggcgtggctgcgtcccaacgacgggcaccgatgacacgccattcccggcgcgcgtgggagagggagaggagggagagggagaagatttagctagagacatgtggggcccaccgcccacatgggtcacactcatcgcgtcagtcgggctactatattgtcgaggaccaaagttaacacgtatggtgaatttgaggatgagttataccttttgtttcggtatagggaagaattttagactctacaacaacttaaaggacttaagtgattctttccagcaatctagcccaactggcaagctggcgggctggtcgccgtcgatgaaggcctgttcagttcccactattagggctttttcggattagaggatcttcacgtgattttcggaggaatactgtgcataggaattttttttcctttcttgtcattcagatcatgaaaactgtggttgtaggaaatccaaagaaaagtttcctttgatgctgatttcacatgaaaagtatatgaaaaatccgtccaccttaagctctttttttttattcctgcatgcaaatcccaggcaattaatttcatgttatccgaatgtcctcatttttttttattcctttgtttttcattcttatgtttcacacttagattcctttcctgtttctatactttcccaatcctatatttttcctatcctataatctgaatgaacccttaatcatgatttggaaattccgaaccctggttattttacatttcacaactaatcatgcatatctattcataatttcagaaaagattacagtaaaaagtaccaagtaataagctagtaactagttgatacccccgcgctttgcagcaaaatatgtggataaatgcatgttataccatttctataatgtataacatgcataaatccacatatctctagcaaagcacgaggtatcaactagtgggaacaatattttagctcaaataaatatggaaaaagtactacacccctgaactatcgaggtcgaccgaattacacccccgaactcaaaaaccagacattctacaccctcaactattgaaaccgggcaaattaccccccctagcactgttttaggtggttttgggatagacttgctgacgtggcagtcctac

SEQ ID NO: 51768 - DNA, 4682 bp, Oryza sativa
gacctcgatagtccaggggtgtaattcgtactttttccaacaaatattaaacgaagataatatcctaatgaataggacacatacagaaccaaaagatactatgccatatcgttcgtattctccattgatagctttgttatcaacatatcgtattgactgggcataaaaaatgatcatgttaaaaaaaattgctactatcagcatggagcaagatatacttagttgttgccacttaccagtatagcaggccaaacgggcggcccggcccagcacgacacggcacgccgacggcacagcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagaacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatacttaccagtgcatgcctcctgaagtgaaactattcctaccgcttcacctctgttttaaaataaaactattttttcatctatctttttatctcaatcaattataactattcttcgttcgtttcttcacctacttctacttttcagccaattatgttttttcttcattattttcacatatgttataactatcggtatccaacttcagaaatacttatttgaatctgttcgcacatttttttaagctcgatctactgatctacactcttgtataagtaagatttaccttccttaactctgttaccagacgttttatacttatgaactctttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgccatggacgcctggcagctgttcgtccccgcgatcgccatcctcatccccttgctccggctcatcctcttccgccgcggcgacgacgggagacgcggccgcctcccgccgggtcctccggccgtgccgttgctcgggagcacggtgtggctgaccaactcgttgtacgacgccgagcccgtcgtcaagcgcctgatgtcgcggcacggccccgtcgtctcccttcgcttcggctcccagctgctcgtcttcgtcgccgaccgccgcctcgcgcacgcggcgctcgtcgagagcggggcctccctggccgatcgccccagccaggccgcctcggccaggctcgtcggcgagggcgataccatgatctcgcgcgcgagctacgggcccgtgtggcgcctcctgcggcgcaacctcgtcgccgatacgctgcacccgtcgcgcgcccacctgttcgcgccggtgcgcgcgcgggtgcgccgcctgctcgtcgacaggctgcgggaggagcacggcgaggcggaggcggcgccacgcgccgtcgtagagacgttccagtacgccatgttctgcctcctggtgctcatgtgcttcggcgaacagctcgacgaggacgcggtgcgcgcgatcggcgcggcggagcgcgacacgatgctctacatgtcgagcgagatgggcgtcttcaacttcttcccggcgatcaccaggcacctcttccgcgggcgtcttcagaaggctcacgccctccggcggcggaaggaggagttgttcgtgccgttgatcaactcccggcgggagtacaagaaaaacggcggcgagccgaagaaggagacgaccacgttcacgcactcgtacgtcgacaacctgctcgacatcaacctcccggaggacggcaaccgcgcgctcaccgacgacgagctggttatgctctgctccgagttcctcgtagccggcacggacagcacgtccgccgcgctgcaatggatcatggccgagctggtcaggaacccatccatccaatcaaagctctacgaggagatcaagtccaagaccggcggcggcggccagcacgaggtctccgaggaggacgtccacgacatgccgtacctgaaggcggtggtgctcgaaggcctccggaagcacccaccggcgcacatggtgctaccgcacaaggcggcggaggacatggacgtcggcgggtacctcatccccaagggcaccatggtgaacttcatggtggctgagatgggcagggacgagaaagaatgggagaagccaatggagttcatgccggagcggttcctccccggcggcgacggcgagggggtggacgtgacgagcagcaaggggatccgcatgatgccgttcggcgtcgggcggcggatttgtcccgggctcggcatcgccatgcttcacctggagtacttcgtggccaacatggtgagggagttcgagtggaaggaggtggccggcgacgaggtggacttcgccgagaagcgggagttcaacaccgtcatggccaagccgctgcgcgtgcgcctcgtgccccggagtacactcgaataattaatccattcctcgattcctagagaaaataattgtgcagtatattatatagagtaaattccttgtttgctcctgaaaagttacccaatctcttacatgcccctaccgtttggaacttacttgattccttctataccccaaattttcgattgaatcctctacatacccctaccgtttgggttccgtcagatgtttgtgttcatgtgtgtgttagcttgtcagtattttcataaaatgcgaaaatgcctctgtcaaccctaggtaacacagggccacatccgatccccaaatcctccaaaatagtatagttcccacacgcacggtgccgcacatcgccagctttcagccatcgttgcacgcgcatcgccgcccttctcccacatcccggcggtggcagcgggtctgcatcccgccgcggtctcggctctgcttgcggtcagcggtggcggctgggtccgcatcccatcggtggcgcggcggggtccgcatctggtgggcggcgacggctttgcatcctgccgcggcgacgagtccgcatcccgccgcggcctcgactctgcttgcggtcatggcgacgccgtctcctccctgcctcctccgcgccctccctcttgtcacctcaccctcttctcgggggctccgacgccggcctattacctccttgctccactgctcctcgccgtcggtaatgatacgcccttgcgttgattagcaaaatgcgaatagctgctgctgctgctagtgtttcttgattgatttgtttgactttatgcaggcggatgccttgaactgttatgggcttgtgccattatgctcatgatgtaaaaagtaatatatttgtgtactgctgatggtgtatgaatgcttttagatgtattttcattttcttcctattaaatggtgctaccgatcctcttgatatgctgatgaattgcaatggtgtttgagtaaacggctaggggtactgtcttttacccccaggctgtgtcggttagtggtcatgaaagatccaatgtcatgttatatttttttataaaatactgaatgctataacaaaagaaaatgaaattaattttatgcactaattttttagtctcacggaatacatactgtgcagtcatgaatgtttcaaacccagctgccaaacatgttcttagttttcagctcctccaacctcaagggtattatagacattttcaaccaaactaaccagggaatgctgctcaatctaacggtaggggtatgtaggggatccaatcaaaaattcaagggtggaatcgagtaagtttcaggggcatgtaagggattgaataacttttcaggggcacacaaggaatttactctattatatacggtacatatacgaatgtaagggaacaaacggccaaaatcatcgcacgtagcactggcagcttcctttctttaatgaatattctgtgagaaattttacgattctcgagagataccaagagaatatcctatgtgtgtactccctccgtttcgaaatgtttgacgccgttgactttttatcacatgtttgaccattcgtcttattcaaaaaatttaaataattattaattattttcctatcatttgattcattgttaaatatatttttatg

SEQ ID NO: 51769 - DNA, 816 bp, Oryza sativa
ttcgcttaaattttcttcacatatacgactgtaaagtttgttgatccacggcattttctatgtttacacattacgccgtgtcctacaccatggtacggaactacggtgtgaactactgttgctttctccggtccgtctctcttgcctgccactggagtctacacaactagccatggagtagcattgatgccatgaaaggctagctgaaagcaacacgatgcacttgctaagatacgtcgtcttcctcacggttcggacgtctgatggtcgatctccgacccgcggacatcatgctcatgctttctgaactgcttgcgcatccgtatcaaacagcttcttttcatcacaacgaagatatgtctcatcatccgggttaagcaaccgatcgatcgccttacaacgtactacgtgcccaaacatgaatgagttagatatattgtttcatctcaattttcgcaagattcggtcaataggaacaccttaattacaccggctatttttacatttcaccactaatcatgcatctctattcagaatttcagagcatggaagtaaaaagtactgaactaagtagagaaactaattaattaagaagcatcatatccatatcactatatcgccactgatcattcaaaacaaaggtattgtattgtactaggtagtgtttaattaagaactccactagagtagtaagaagcatgcatttggattgagctaagctactgaaacggtgaccctaacgcatacatacatggtgatctaggcccttctgggcaccagacgagcgcgcagcggcttcgccatgacggttgtgaa

SEQ ID NO: 51770 - DNA, 1509 bp, Oryza sativa
agaaaaatcaggcttcctgacactccccaacatgcaagattgtatcaagctagtttgtttctcttttatttctcctaactttaaatattttttttccaaactacttatccgatctacgatacggtaccattgtattgattgtaattaaatctttatagcaagatatcacgtgattatattctcatacctgataacgatatgtttcaagatgtgtcttctgtatgtttcacaaaattcacataaactctatctcctctctctccacttcattcatgcatgcatttaactatcttcaaaatgatttttcttctaaactacttatccgatctacgatccgatcacaccattgtatttgttgcaattaaatattacaacaagacattacatgactatattctgatgaaaaacatacgtttcaatccgttaacacttgatgcctcatatgcgataacgacatgtttcagtgtgtattttcattgtgtttcgcaaaatttttaaaatgtttcgatgctttaaaaatacttatatctgcagagaaaatgctaacctttagaaatttttatattcgtagacggagagaacatgaaattcctatcttcaaaggatctctttggatttccatcaggctccaggagcacagctacacatcgatacgaccgaggtaaactaaattccgtcagtccgtctccccccaccaaacgccggtcaaccccacgaacgcaaatcaacgacatactgccgaagccagccaagcgcccaagacaatctcgattgattcgtcaaaaaaaatcacaatgtaccacaacacctgggtgtgacacacacctccaggtggagccaagcagttggccaggcaataatgttttatatgaaatacttactactcccgtacgtagaacaaaatggactgtactaccgttcaggagtctgcatcgcatgcatgtcacgtgttgtagtacttgtactccatccgtccccaaaaaaaaaggcaaaccctatgtttccgtgtccaattttgattgtccatcttatatgaattttttttataattcgtattttcattgttgttagatgataaaacatgattaatattttatacgtgacttgtcttttttaatttttttcatatttttttcaaataagacagacggtcaaacgttgggcacggaaattagggtctttttttgggatggcacactacagttgcacccgtagaacaaaatggactgttcccagatggaagcttcccggccttgaccattgttccatcgttcaaaaacccatgacatcattacgccgacgtatgcaagatcaaccaaccgggacaaggattttctacttttccacacctagtgtcatagcatagcaccatgtgactcaataattatataaaaaataaaaagtatagtaacatcaattataatgatataagtctatacacaaacgtgcaagactatattttatatagagtaaagtgtacggatggtccttaaatttgtagtggtgtgt

SEQ ID NO: 51771 - DNA, 1292 bp, Oryza sativa
aaaaagtcaacggtgtcaaacatttcgaaacggaggagtacgttgtgagtttttcgctcagtcagattaccttgatgatcctggcatcgtctactctgcagcgttggtgtgtaaaataatgaatggtggaaactggaaagtaactcctctggcattgccggccatctgcacggcgcccccgtgtctcctgctacgcatacgatcggcccgtgcgagccttagccgtaactaattgggccgtttctcgcgaatcgcgggaagtttgcccagcccaagccttaggcgagacaatccagcccagcgtgaggtctcggcctgctgctttaattggaaaaagtatacctgagaccccttatcttgtcgacgatttatttataaaatcatccatgaaccaaaaaccatatatatgacatcagtcaacttataaaactaaatcactctaagtccataggcggttttgtttgacatgacaactgaatcagtgtggaacccacatgggcccacaggtcagtggctacttccccttctctctcccccagtcatccccttctttggcgatagttgatgggcagaagggctgacgcggcgggcgcgaccgatggccggcggggaagagcacagctggcgaagggtagggagaaccggggacagatcgatctgtgccgccgttgccctcatgtccgatcacaaccaaacggagattgctgtgcaggtgtcactaatggttgtgtttagggaggatgatgtggggaggacatggcgggcatggctcggctattccgaagggaggcgatgctggtacggtgctgtggctagcgttattagtagatgttgagaggtgaggggcaacggtgatatgacgagacgatgaaggtccacgaaggtcgccgggagaaatttttcccgagcttgggatgacgcgagtggtggaacatgtttcatgccgagccgccgggaaagaggaatgggagggtttcctatggggttgatgcgagctcatgctgaaggagacacaaagatatggacgacttgccttcttaccggggagatgatgagaggggcgagaggattcgagagagcgtgagatgggaggaggaagaagagcacagggaagaaaggggaaggtactgacaggagcaggacgtcgtcgcgcgtctccggttcttcccacccgtcgtcggccgtgctcctgcctcaccggccgccgaccatgcccctcatgcctgcccttctccacgtggcccgtgcccaagaaggagagtactagaggagagagagaagagaaagtagtt

SEQ ID NO: 51772 - DNA, 9387 bp, Oryza sativa
  unsure (1)..(9387): unsure at all n locations
gcaactcctccgtagagaccagcacatcaatgaaatggggagttgaaccccctaagagaaaccgtgtaggctgtagtccaaaacagggctaagcctccactaaggccctcgcagctcacagcaaaggagccggagaaaccaagtgaccacatcaaatttcttgcctgtttgtccctcatcttcgtttcagacaagaagacaagggagggtctcaaagacttcactaaccagcgaagttcacccactgtcgcagccgaccccaagccacgacagttccgaccccaagtcacaagcttgtttggttccatgggcagggacttatatttttttagagagggtccctctctcccaaacatctctttaggtcttagcaccgtatacaatacgactagggtcttgtttggtttcatgggctaatgtaagaatttaaacatgtgggctaattttgatctaaaatgaattagcccccctcaaaacattagcccctccaagagatgctaatggagctaattttgtgtgaggactataaaaaccagctctctctctccttctctcccctactctttctactctgtctctctccacctattagccttgaattaagtcatggatccaaacatgccaccctagactaatatttagccgaccaatttatgactaaacattggctcttaaaattagccctgggctaatctttccaacaggcatagtacaatactcgtacgtatcatatgcactatcgtgcgtacgagtactcttggcgtgtcacggtcaacatagatctcactgttggcgttattgtgacaatgcacaacttttttgacgtaggggcactgtactactagtagaaatactagcgttgcccaagagattgttcacgtgccacacacatgcggcgcacccgtcgatcgaatcgaggggagtgcacggcttttgagttgtgaccacgcgtttggtcgggcctgggctgaaatcgtgaaagtttgtcgggccggatcgcgggatcgaggcggatggaggcgcgcgcggccttcgaaacgggacgaattctcgccgaccgcgtttgggccgcctgcccggatttgcagaccgttttgctcgtctgggctttcactatgttttgggccgcaaatttctggcctaatgttttcctcgtccagactccagcgacgaacgaacagtggagttgcgaacttgcgatcaagctacagcagcagcttgtctgattttattcgataaccaaaacaaaggggtttatgcatgagtagtacatacgaacgtagcggaattcacgatgccagcatcaccatggctaagaagcaaaaaaaaaaaaagtatgagcgcttcgactgttcgacacgattaagatagtgtccagcgacgtacgtgcatgcatccgtacgtaacggcatatacgtagcattattattctaggtcgtcctcctgggcacgaggcgcgcgcggagcggcttggccatgacggtggtgaactcccgcttctcggcgaactccacctcgtcgccggccacctccttccactcgaactccctcaccatgttggccacgaagtactccacgtggtgcatggcgaagctgagccccgcgcaaatcctccgcccgacgccgaacggcatcatccggatctccctgctgcctgtgacgtcgaccccctcgccgtcgccgccggcgaggaaccgctccggcatgaactccattggcttctcccattctttctcgtcccttcccatctccgccaccatgaagttcaccgtggtgcccttggggatgaggtacccgccgatctccatgtcctccgccgccctgtgagggagcaccatgtgccccggtgggtgcttccggaggccctcgagcaccaccgccttcaggtacggcatgtcgtggatgtcctcctcggagacctcgcgctggccgccgccgccgccgccgccggtcttggccatgatctcgtcgtggagctttgactggatggatgggttcttgaccagctcggccatgatccactgcagcgcggtggacgtcgtgtcggtgccggcgttgaggaactcggagcagaggttgaccatctcgtcgtcggtgagcgggcggttgccgtcgtcggggagcttgatgtcgaggagggtgtcgacgtacgagtgctcgaacgtggtctccttcttcggctccgccgttggcgccgccctgccgttttcttgtactcccggcgcgcgttgatcagcggcacgaacagctccgtctgccgccggcggagggcgtgcccctttttgaggcgcccgcggaagaggtgcttggtgaccgccgggaagaaggcgaagacgggcatcttgctcgacaggtagaggagcgcgtcccgctgcgcgacggcgatcgcgcgcaccgcgtcctcgtcgagccgctcgccgaagcacatgagcaccaggaggcagaacatggcgtactggaacgtctccacgacggcgtgtggcgccgccgcgtcgccgttctcgtcccgcagcttctcgacgagcacgcgccgcacccacgcgcgcgccggcgcgaacagccgcacgcgcgacgggtgcagcgtctcggcgacgaggttgcgccgcaggaggcgccacacgggcccgtagctggcccgcgagatgaggttgtcgctctcgccgagcagcctcgtcgacgccatggcggggcgatcggccagggacgcccccttctcgacgagcgccgcgtgcgcgaggcggcggtcggcgacgaagacgagcagccgggacgcgacgcggagggagacgacggggccgtgccgcgcgatcaggcgccggaggaggggctcggcgtcggccagcgaattggtcagccacaccgtgctcccgagcaacggcacggccggaggacccggcgggaggcggccgcgcttcccgccgccgcggccgccgcggcgggagaggatgagccggaggaaggggatgaggacgaggattgcggcgacggcgacgtgccacgtgtccatcttcgagtgagcgcgagcaccgcgtaccgtgtggctacttcagtgggactcattttatatggttaacacgtgtcgtaattagcacgttattaggaggtttttaactgcttgtgtttaagtaaattcggttgtatttatcggtttattatgctttatgccaccgtcgcgatctcgattcgacttgcggacgaagtgaacggaagggtccacctccgctgacgtcagggatgatgatgaacaggaataaatacgaagaaaaaaaattctagaatattttcttatgcgacaccttgtttccacatgactcgtatgatccaaggtctaacgacatgttcaagaaaagagcagataaaagaaaaccaattctgaatacgatttctctctcgagaaaattgcatccaatccaacaagtcatagtttgttcagacttcaggactctaacacataataattttgaattaagatttgaaaattacatccgaacaacccgtagtttgttcagactcttaaactcataaaattatccaaactcaatcgtattcagcgttgacttgatgcgtctccctataaatgtaaagccgttttgtctcacccgacgtacaacaacgacaccaatcgacgacgacgcagatggataacctggtcatcctcgccggcgtcctcctcctcccgctcctcttcctgctccgcaatgcggcgtcgtcgaggcggcgccgcctcccgcccggcccgccggcggtgccgctgttcggcaacctgctctggctgcggcactcggccgccgacgtcgagcccctcctgctgacgctgttcaagaagtacggccccgtcgtgacgctccggatcgggtcgaggctgtccatcttcgtggcggatcggcacctggcgcacgcggcgctcatcgccgccggcgcgaagctggccgaccggccgcaggccgccaccagcacgctcctcggcgtcagcgacaacatcatcacccgcgccaactacggcgccatgtggcggctgctccgccgcaacctcgtgtcgcagacgctgcagcagtcgcgcgtcgaccagttcgcgccggcgcgcgtctgggtgcgccgcgtgctgatggagaagctgcggggctccggcgaggaggcgcccaacgtcatggaggcgttccagtacaccatgttctgcctcctcgtgctcatgtgcttcggcgagcgcctcgacgagcccgccgtgcgcgacgtcgaggaggccgagcgcgcgtggctgctctacatctcgaggaggatgagcgtcttcttcttcttcccgtggatcaccaagcacctcttccgcggccgcctcgaggccgcgcacgcgctgcgccggcgccagaaggagctcttcgtgccgctgatcgaggctcgccgggagtacaagaggctcgccagccagggcctcccgccggcgagggagacgacgttccagcactcgtacgtggacacgctcctcgacgtcaagattcccgaggagggcaaccgcgccctcaccgacgacgagatcgtcacgctctgctccgagttcctcaacgccggcaccgacaccacctccaccgggctacaatggatcatggccgagctggtcaagaacccggccgtgcaggagaagctctacgccgagatcaacgccacctgcggcggcgacgacgagctcctggagcggaacgtgagggacaaggacaacaagatgccgtacctcaacgccgtggtcaaggaaggcctgcgcaagcacccgccgggccacttcgtgctgccgcacaaggcggcggaggacatggacgtcggcgggtacctcatccccaagggcgccacggtgaacttcatggtggccgagatcgggagggacgagagagaatgggagaacccaatgcagttcatgccggagaggttcttggacggcggccatggcgccggcgtcgacatgcacgggaccaagggcatcaagatgatgccgttcggcgtcgggcggaggatctgcgccgggctcaacatcgccatgctccacctcgagtacttcgtgggatccatggtgatggagttcgagtggaaggaggtggaggggcacgaggtggagttcgccgagaagcgggagttcaccaccgtcatggcgaagccgctgcgcccgcgcctcgtgcccaggaggagttagacagtgagacagagtccagaattggtttagttttgtgttcattagttagtgttagcgtatatttactcgtgattaagttatgatccaaatgtccatagtgactagaagtatataattaggtttgaattaagtgccaaaagtgtgttttgttttagcaaattttgagcagtgcgtactcgtttttatcgtgctaatttacacgttttatatatgaactcctatcgaatcccaatcaaaataagcagagaggtttggactagagacaagacagcatgacttacgcacaagaaaggaagggtgaaaggttcatcttttatctcctatatactatcagcaattcaaaggaaagagtgtttttttatctcttaccagcaaattcatatcaccaattcgaatatccaaaacaacataggtgcctatgaatttcttttaacaacaatggaagaacaactttgagcctgtgaaaaactttaacttgtttacctcctagaaattgatgcacctaaaaaacttgtttagaaacatcttacaaaactaatgtggcacaatgtgattgaatattccttttctcatacccgctataacatatcagatcactaagagagtaatagatttacactagttggagagtgttagagtatatggtagttaaagtcatattaggataggattggtttgtttggattccttctatatctgtaattcttccttatctcttccctatgtactcctatatatatcgcccccctgaggctcaatacaatgtgtccaatattcacagtatcccctcttcctgtactatccaacatggtatcagagcgggcgatctagtgccgctctcacgcttccgccaccgctgcccccgggagtagcgatctcccgagggcggccacatttttttttctttctctgaggtcgttgtcgccagagggatcgccctcgatctccttcggtggcccccgtcctgttcgtcgtcagatcgatctaaagccatcttcagatcgttcgtgcgtcttcgcgtcatcagcatgcagcagtagcagatcgcatccgcggatcccgtcgacggcgcggctctccacgtcgctgcgccgttggctcccggtcctgcctcctctgttgccgtcctctccgtcgacctctctcctctaccgaggctgctgatgccgggggacaggagccacgtcctcgccgatcatccatgccgtggatctggcggccactccaggccaccgtttcgtccgtcgccccctggtcttctccaacctccgcgccagccgtcgtcgacctcgccgcccttctcaaccccggcgcacagggggagggagtgctcatcactgtcgcttccacacggcaattttctgccggcccctgcagctctgctgctggtctccaccacacaaacctgttgacaggttgttcttctccactgtctctcggtgtctctctctgctatgatcctgtgcgtggcagccatgtgaggagagagagactagatggatggtgtgaagatatacagcctattgccttggttgacttggtggtgacttgcgtcagattcaaagggttgtgatgtgaacggctggtatggactgctgctattgtgttgctgcttgtattttttcccctttcccaatcagtgattgggtttgcgtcgcccaccgcctcgttgacatctgcgcgtctccgacatcggcatcgattctgcttcaacttcatcgttctgcctcgcgcatcttcggcttgatcacccattccagcgcccagctacaacgacttgtacaaccgatcatcatcgagcacgcgtctacgccatcaagcttcgggttgccgctgcgtcgcccccctcgggccacagtgccgctgcctgtggtccacacctccactggttgttacagtgttgagacctgagaggcaccctcctcagtgtggcctcaccaccggtggacttctcgccgctgcatcgacatcgagctgcgttggtcccactacttcgccttcgtcttcgtccagcatgattcatcgccagtgtcgccgtatcttcctcgactatacttcgctcttctccggcaactgcgtgctgctccggcaattctccctctacgccgttctcgcgccgcgaccatcctagaggccttctctgctagtctcctccgacattggcgtataatttctggtggtcccctacctagcccgcacggtattggtaacaccgttgtgcgcgtttgtcccgagtcgtccccgggtctggcaaacctggtgtgacgtcttgtccttcatggttcgactatatcggctcttcgacgtcatcttcctcaacgaccgtcgcgatcgtgtccccgtcatcatctcccgcgcgtcctcgcgcacctcggttcacaacgctctcccatgcgtccacgaccactctacggcgtcctatgtgcgctccgcggctcggctacctcgacatcatcggctccccgacttcggctacatcgaccacggctactctacgcacggcttcagcgaccacggctctcccggctccttcgctttggctacatcgactatggcacaaagggctattatccgtgttgagcactcttgccggtttattctccagtccaagtgtccgcgctgctcacgcttggactgaggggggatgttagagtatatggtagttagagtcatattaggataggattggtttgtttggatttcttccatatctgtaatatttccttatctcttccccatgtactcctatatatatcggccccctgaggctcaatacaatgtgtccaatattcgcagtatcctctctttctatactatccaacagagagtacgtaatagattgaccttaggagagtgacagattaacgatttcgtatgaacaaanntaatgtntgnnnntnngnaccaaacgtccttcnnnaaggnnnnnnnnnnnnnnngnaannnagtagaagagatttgattggntttatttgttaacctgtacggaattcgaataaaaaactggtccaaatttgtcagatttggggaaaaaatttgggggaaaaaaaacccccaacccggngtctaagatttnaatcgctctgatttatatttaaacaaggaaaaagtacaccgaaggtccctcagcttgtcatcgagttacaaaatcatcctccaaccgtaaaatcagatatttcacatctcctaactaatcaaaaccggtcacaatcggtccctcggcggttttgatcccggttttattctacgtgactgctgagtcagcacaggacccacgtgggccccacatgtcagcgtggccacgtcagcctatctctctccccgtcttccccttcctcctctctctatctcactcattcttgtctctgtggctctaggcaggggagcaaggcggcagcggcggcgggagcaggggagcaaggcgtcggcggcggcagcggcggcgggagcaagggagcaaggcgtcggcggcctccggtctccccccaccctcttcactctgtccaaggcggcggcgacctccacgccccacttcctcaccgacgcgacgagcacctgcacgatcctcgttagcgggctgcccccggaccgctggtgcctgtacagcggcgtgccgatgaagaagctgacggcgacggccatgacgacggccgggatgccgaacccccacccccacccgacgtgcgtctgcacgtacaccagcaccgacgacgccaccagcgcgccgatgttgatcaaatgttctccatacagtaattattcagtaacctgtatagaaattgatgactactatgtgattacttaactaatagtacctgacagaagaagctcatattattagagtctgaatagatggaagtttggaggcattgcttgtcgctgttattcaaatgtctggttgctgataaataacaggaaaggaagcttagaactgctgtataaatgaagtcagtgtgtggacatcttcagtgtagaattttaaccagagaatcttataaggcttgttctgaaaaaggtgatggatgctgtcctcgacatgtattagaaccagttgaagaagctgctcttgctccgcttctccccctcgtcgttctcgtcgaactggtcgacgccgaacgacgacacacacgggttgatccctcccgttcccagcgcgatcaggtacagcgccaagaacaccacccccgtctgcgcttggtgcggactgcgga

SEQ ID NO: 51773 - DNA, 2579 bp, Oryza sativa
gccatgggtgctagccctagcatcggcatccccatgccgcccgtgcgagagcagagagcgagacggaggaagaaaggagagaaacagagaaagagaaagagcggaaagaaagcaggcgctgacatggacaccctgacatgtgggacccacgtgggtcccacgctaactcagccgccacgtcggataaagccagagtcaaaaccacttaaggaactcaagtgaacggttttgtaagtttagggatgtcatatacctggttttgcggttaggggatgattttgtaactctatgacaagttgagggaccttaggtgtactttttcctttaaacaaaatgaatagagagtaagcccaacagcaaaaaacatgttagcccaaaaccaacgaactgcatcttaggcccatttaaccagtcgaacatgttatctcaggcccgtttagcccacaaaattgcaatatgaatactagcagtctagcacaactagctttggctgcgttcgtttctccaataacaatagttggatgaaattttggatactgatggtacacttttcaaactactaaacggtgcgttttgtgtgaaaacaattgctctaaaatatcagattaatccattgtcaagtttataataattacacgttattaccacctcgttttacgtgaaacacttaatatttatcctcatcttcattttcaggatatccagagaggaacacacgcttgaaaaatctgtcacgtgctagttaattagcaaaaccgaataaggtacttataaaaactaaagtgtcattccttcttactaacatatatctttagggagagctcccaccttttcgcctcaaaagggaaaataaatatgtgcgcctaagttgatcctgatgcccttaaatccaaagttcaaacatgtggggtggcttcttaagaaagaaaagaaacctaaatacttggatgtaatcataaagattcccaccgaatcttcaccgatcaattgagattaattagaaatgacgatagccgtttaagcggagaaggacggcttacattattgctggttaccattcaaaacagaaagaaaacagtggcaccagattctgcggttttctacagagcttttttcttaaaaaaaactagacacaatatatacacaaactattctaacacacgcacactcacccttataaatgtacacacgcacaccttatccttatcagcatctccagaagattaggctgtcatattttaatattgacgaagccactgcgggcgtctcgttgtcgagggatacgtcttacacatgcacacattattcttatgaacatctctggaagactaggttgtcatatcttgatgtcgatgaagtcactacgggtgcctcgttgttgagggatacgtcgtgtaccattaaaaaaaacaattagccgtaaatatgagcacatgtgtcaagcctagaatttaaacccagatggactggtttcaccataagaaacttaaccaattaagttacgctcacttcacggagccctttgtcactctcctagttgacaaataagttttcaatgactggtccatacaggaatatgttcttccattatttaattttagttgctaaacatgttttcacatactataagttgttcgtccattatccatttttctaataggcaccttgttttgcatctttgaaagcattttgaatggctgataggagataaaaaaatgacccctttttttcttcgattgtgtttttgcccttctttctgtccaagactactataggataccaattcactacgtgcagctgtcatatgtttttgataaatctaggttacctattaatttagagtaatttagaaattatacactaagttttataagtatgtgatatatttttgttggttttttttaattttgggaaggtaatatgctttgataaatatgggtctcctattaatatgagagtaatataaattttcgacatgacctgcaccaaacagtaatgtaattagagattatacatggttcttttgaaagtaagtgacatatgtatatgaatttaatttattatttggtggtggtgatatgacgataaattcttggcacctattaattttgatttaatcttgtagttatggcatatgtttaagttaatcattttgtatgcagcgagaattgcaatggatcgacgataaatgtaccatgcgtcttgttcaggcctcctttgaattggaggaaaaatataggaaaaagaaaggaattgaaatcctacactatttatgcctttgattcataggaatgagaaaaggaaaaacgtaggaaactttcgtattcctacgattctagaggaaaaacatagaaaatttaagacaaaattggttatatagcatcgaaagttcacctttttttagctccaacagataacggttcactttaatagcatctaaagttcacccctttccatttttaacactttcgtcaattctcgatcgttttctatccgccttgatcgttattgactcagccactcacacgatatgacctttttacccctcattgccatgcattatacatgtacttgtgagg

SEQ ID NO: 51774 - DNA, 5432 bp, Oryza sativa
  unsure (1)..(5432): unsure at all n locations
aaaaacaactgtaccatatattaaaaacagagatatcagaaatttgcacaaacaaatcacacttcaatgttccctattgatttactgattcatcaaaccaaatgccatttgatatcagcattcacctcatgacacgtaaaaaacctgacactgatactccaaattactccctccgtttcaagatgtttgacaccgttgactttttaatacgtgtttggccattcatcttatttaaaaaatttaagtaattatttattcttttcatattatttgattcattgttaaatatactttcatgtacacatataattttacatatttcacaaacttttttaaataagacgaacggtcaaacaagtaagtcaacggtgtcaaatattttgaaacggagggagcaaatgagcagtgagactctgattagtgcctgactcctcctgggcacaaggcgcggacgcagcggcttcgccatggcggtggtgaactcgagcttctcggcgaactccacctcgtcgccggccacctccttccactcgaactccatcaccatggatcccacgaagtactcgaggtgcatcacgccgacgttgagcccggcgcagatcctccgcccggcgccgaacggcatcatccggatctccctgctgcccgtcacgtcgaccccgtcgccgtcgccgccggcgaggaagcgctccgggatgaactccattggcttctcccattctctctcgtctcttccgatctctgccaccatgaagttcaccgtggcgcccttggggatgaggtacccgccgacgtctatgtcctccgccgccttgtgcggcagcagggtgtggctcggtgggtgcttgcgcaggccttccatgaccacggggttgaggtacggcatcttgttgtccttgtccctcacgctccgctccaggagctcgccgtcgtcgccgcaggtggcattgatctcggcgtggagcttctcctgcacggccgggttcttgactagctcgcccatgatccattgtagcccggtggaggtggtgtctgtgccggcgtggaggaactcggagcagagcgtgacgatctcgccgtcggtgagcgagcggttgccctcctcggggatcttgacgtcgaggagcgtgtcgacgtacgagtgctggaacgtcgtctccctcgccggcgggaggccctggctggcgagcttcttgtactcccggcgagcctcgatcagcggcacgaagagctccttctgccgccgcagaagggcgtgcccggcctcgaggcggccgcggaagaggtgcttggtgatccacgggaggaagaagaagacgctcgtcttcttcgagatgtagagcagccacgcgcgctcggcgtcctcgatgtcgcgcacggcgtgctcgtggagccgctcgccgaagcacatgagcaggaggaggcagaacacggcgtgctggaacgcctccgttacgttgggcggcgcgtcgccgccgccgccgctgacgccggacgtcgtctcacgcagcttctccatgaggacgcggcgcgcccagacgcgcgccggcgtgaactggtcgacgcgcgactgctgcagcgtctgcgacacgaggttgcggcggagcagccgccacatggcgccgtagttggagcgcgtgatgattctcgctgacgccgaggagcatgctggtggccgtccgcggccggtcggccagcgtggcgccggcgccgacgagcgccgcgtgcgccaggtgccgatccgccacgaagatgagaggcgccacccgatccggagcgtcacgacggggccgtacttgtcgaacagcttcagcagcagaggctccaattcggccgccgagtgccgcaccacagcaggttgccgaacagcggcacggccggcgggccaggcgggaggcggcggcgccgcctcgaggtgacatcgcgcaggaagacgaggagcgggaggagaaggacgccggtgaggatggccaaattatccatcagcgttggcagctgttttcgcttgcgttggttgtcggacgaggctaaactgttgtgtacccatacattttataggtcttcggctcaagtcagtagcagtagactcagtactatgggatgtaatatgttaatcttattcttttaataaaactagctgggtggcccgcgcaattgcgcggctagcatccaaataaaatcatatattttttaatatgattttacttaaaatttattaaatagctatctcattgtcttaagactttgaaagaccaaaccttatcatcctcgtgtttctaattatatagtttttaaaagtcacatcagttgctaccccttatgtcatcttcttctttatttgtttgctcgatctaccactatttctatttattcttcttggaacctttaaaaattgaattttatagtttttagagtttattgtcacattgggtttcgtttttataatttgtagatgtctcgtcaaacgttgtcattatactcctctaccgcccgtccactgtttcttctttttattgtcattgaaattttaaaaatcaaagataattatcatttgggtttatttttactttctagaagtcccgccaaaccgtcagcggctttgccattgtactcctctacagctcacccgcagcctccgttctttattgtcattgagattttaaaatagaacatgattatcattgtttcttttttactttttggaagttccgaaccttaaaaaattagacttgtagttttattatttttataatttttagaagtcccatcaaacgatgccactatgcccctttacagcccgtccgccgcctactctttattgtcgttgtgattctaaaaatcaaacataactatcgttggaattcattttttattttctagaagtcccgtcaatcgtcggcggctcagcaactatactcttatacaccccgcccgctgcttctcctttttattgtcattaacattttaaaaatcgaatatgattatcaatggggtttattttttatactttctagaagtcccggcaaccgccttacttgtttgcttcacggcctgtctgatgtccctccttttaatcgtcattaggattatatttggtgttttattaataatttttatatgtcgtatcaaccgccaccactctactcctttctaggctgttacttaatttatctcgtcatgtgttgtagatggtcttttctttcaatagtctttatttttatcacaaattttagttatttataaattgtatttctaattgaaatcttatttttctttttctaatttcagaatttattttttttaaaaaaaatagttaatacccgtattgggttcctttaatggttttatttttattttcaatttcagttgtttgaaaattggtattcctacttaaattctcttttaatttttctaattttggatattattttatttttttaattcgaaattttaattattcttggattggggtcttatatggaatcctctttcaatattgcttattttttaatccgaattttaactaattttcaaatggattcctactttaactcttcttttattttcttttgctaactttggatttattttattttaattcgaattttaattaatctcatattgggttcttatatggactcttctctttaatattccttatttttaattccgaatttcaggtatttttaaattatattcctacgtggactctcctttccttttctaattttggattttattttatttttattccaattttaattaatttcgtattgggttcttatatggactcttctctttaatattacttatttttaattccgaatttcagctctttttagagtgattcctacttggactctccctttctttttttttctttttctccgattaatgtgggaatttctagcctccacagcgaacgtggtgtcttcttttcgagctgtcttaataatataatagattttagaacatgttctgtacatacggttttgctaactagcatatgatgcatgttttaagcagccttcctgtttagtttttctttttgactgtcagaacttaggtttacattcgtgctgtggctggaattttatttagaattgatctcaacaccttgggctcgttcttttccacaactaaagactgcaacttagttctttttcattagcatgcttctcgaaccgttaaacgatgtgtattgtaaaaatattaccgtttgaggctaatccatttttctctgtgtcaggttgtgttagctatccaagcgaattggtgtttcaagcgcatagcaatgggagatagaagattgagcttatatggaatagcaattgtgttcgcacatctgaaaaaggggggatgtagcctagtggttgcagtgacctgagtaacaccctaaggttctgagttaaaatcttcatatgagcgaatttcaaattgagttatttgcagtgctaagttctcaatttaaattgttgcatatatccatttggatgtagatgctggataaaaaaaactattctctaacaaaagttgtgttcgccgaatccactttctgctgaacactcatggatgtaaatgtgttatcacacgtgggattaagaccttgtccagcaccacatggcgggcagccctaatgggctatcgatcgcccgccaatggggggtngcgannnaatnnnnntacccccctccccctccctcctncacccgancccctatttaccaaactcattcccctcacgtttatacacctcaagtttacacatttaaagtttagagacccaaagtttataagtcaaaagtttatatatccgattcaaatttgaatttgaattcaaatatctttttatatatagtatttatatacatctaaagtttatacacctaaagttagtttatagacctaaagtttatacacctcaagtttacacatctaaagtttagatacatgtttcaaatttatatttgaattatatccgattcaaatttacctgtttcaaatttgaatttgaattatatcgattcaaatttaaatttgaattcaaatattttctatatatggtatttctatgcatctaaagtttatacacctaaagtttatagacccaaagtttataagtcaaaagtttacatacccgattcaaatttggatttgaattatatctgattcaaatttgaatttgaattcaaatattttctatatattgtatttctatacatataaagtttatacacctaaattttatagacccaaagtttataagtcaaaaagtttacatacccaattcaaatttgaatttgaatttaaattttttatatatagtatttctatacataaatttttctaactctttattttttttaaatttttgtgtggtgtactgtagtaggggaggagtgtatctagtagtatagggagggagcgggcgg

SEQ ID NO: 51775 - DNA, 1802 bp, Oryza sativa
  unsure (1)..(1802): unsure at all n locations
cctgcagccctgacttgtcggtggggttcgaaatttcagaattttccgagaattttgaaccaaaatcgctatcactagtcatgcgagcacgaagaattagggaacaattcaatatgaattcgggttaaacccatttatgcccaaaaataccagtccaatccaaacccttttttcttttttttttttgcctcagtccaaaccgctccggtccgttagctcactcaacccatctccacccaaataaagcccacccgtagtgaaaagggtaaaatccagaagaacaccacgcacaagcacaaccttgaaaatctgaagagcacacgaagccctaattaaccaaaacctccgccgccgccgccatggccgccgcggtcgccgcctccccggcgcaatcccgcaagacggagacctacaccgacaccaagcgccgcgacgacgtccgcggcctcaacattgccgcggggcgcgccgtcgccgccgccgcgcgcacctccctcggcccacgcggcatggacaagatgatctcctccagctcctccggcggcgaccaggccgtcatcatcaccaacgacggcgccaccatcctctcccgcatgcccctcctccagccggccgcccgcatgctcgccgacctctcccgctcccaggacgccgccgccggggacggcaccaccaccgtcgtcgtcctcgccgggtccctcctccgccgcgcccagtccctcctttccggccggcgcccaccccacccggggcgacgacgccctccacctcctcgccgcgcgcgccgtggaggtcctccacggcatggccatccccgtcgagctctccgaccgcgaggccttcgtcaagtcggcatccaccgccctcaactccaaggtcgtctcccagtactccaccctcttctccccgctcgcggtggacgccgccctcgccgtcgtcgacccggcccacccgtatctcctcgacctccgcgacatccgcgtggtgaagaagctcggctgcacggtcgacgacaccgagctcatccgcggcctcgtcctcaacaagaaggccagccatgtcgccggagggccaactcggatcggggacgccaagatcgccgtgatccagttccaggtctcgcctcccaagacggacatcgagcacagcgtcgtcgtgtcggattacgcgcagatggatcgaatcctccgcgaggagcggaattacatccttggcatggtgaagaagatcaaggcatccggatgcaacgtcctgctcatccagaaaagcatcctgcgtgattcagtcaccgatctgtcgctccattatctcgcaaaggccaagatcatggtcgtgaaggatgtcgagagggacgagatcgagttcatcaccaagaccctcaactgcatgccaattgctagcatcgaacatctccccgaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51776 - DNA, 1533 bp, Oryza sativa
tcctgcagcccagttcaaaccagggtatataggatcgacaagctccagatggtggatactgatgaaaggagcaattggatgagcagccaatataccatgggcattgcctctgatatcccactgattacaatgcaaagggacaaaagtaagattaagagagtagagtttagttctccatacacacgattaataaaaaaaagtaaatatgacttgttaatgtgcaaacagaaaaaagaacttgctaatcacttattatcatattttcaaacacatgcagcatgctggtacctatttgacagaaattacaatagtactataaagcaagcaggcaagttcttgcaaaaacttctgctggccataaaagagcccaaagaaaggtaacattcaagtactaccaaacttcctttcactatcaatctaacataaccactctggcaagaccctactactattgttcatgtattctgattgaacatataacagccagctaggttggcacaacagcagacaggctacacttcctttctgccataatgaatcaagcatcacagaaatggtaaggttccaaagagtggatcaatatgcatgcctcccaagatctaacgcaaattctaaattgggctagttcattagcaatcccccgaatttccgtgagcatagacagcatgctatttcgcactaaattcatgcatgggatcaggagagagtggatagtccctgaattcaagtcactgtgtcactggtaactagtctatcagcagatcgtacaaagcagaacagaataagtgctccaattgctgaggcgaataacatttcataagaccactcaataatctaagcgctgttaatacccaacccacatttctgttgaatggccacaaaatgttgaaaaataagctcatacctgatggaatccgtactcgcgggagaggggcactccgagctcggtgatgcaagcatggaggcgatcgtcacttccgtacagcttggggtacctctcgatgcagacgtcgagcgtccgcgcgagcgccgtggcgagggggaggctgagcgcgacgccgccgcccccgaacgccatactgtggctgaagtaggtgttcgccgagtggctctccgacggcgcgccgacgtacaccatctccctccagtcgtacttcccgagcacggccaccaggttgtccgcggacaccacggtgtcgtcgtccacgagcaccacccaccgcgcgcccccgccgccgccgcccacgagccgcacggcctcggcggcgatgcgcgcgatccggaggcccgaggggtggcccgtggggttcgtgtaccggaaccgcgacgtgtcctccgacacccggatcggcgggaggagggacccctccccggacgcgctcggccccggcgccgcgggcgccccggcgtcgagccacacgtgcccgcgcatggcggccgggtcccaccacatccggacgtactcccggcggcgcggccagaggtgcgcggagcccgcgatcccgaacacgatgtggccgagcgactgcgggg

SEQ ID NO: 51777 - DNA, 3415 bp, Oryza sativa
gtggtgcagggacaaatttaagactcggcgacaaattaagggacttcaagtgaacttattcctttagttagatggcagtatgggacgtgaaggtaagatgagtggcccaacagtaagtctgaagaataagatgggctcacttatgttgcacatcataaaagcccaaattccctaaattatgattttccaaagattggccgagctgtggatgtgcagatgcagaacacacccaggtcgatgaactcgcgtcagcgatggaggccgacaggtggggtcaccgtacacgctagtgtaccgcggccataccgggttaattggatccatgttattattttacagttttgaagttgttattcaaaatatgccactctttacccttttactatatttctctaaaatttttggaccatattacccttttcattctcctcatccacttttcatctctagttcatttctcaagattgaggcggccaacctgatgaaattaacgaagcgagccttggcgatggcacggatgacgagtccccatcatctcacggaccgagggccggtctcccctcgatcccctttctgctgctaccgtacctctcccttctcccgcaagctcctcggcgcactatggcgtatggcggagtggatcatgaaggcgcaagccgacaagctcataccattgcccttgcttctcccggtgccaacaagtggtagatcagggactcggaccgacgagttccatgtagtgaaaacggtgcagagtagtgcgacaagctccacgatgggagggccctcttctcttcccatcccctccctcactggccacaccattctcccatcctcccatttgtcgcgtccaaccgcgagctctgacacctatcccacttcaccttcctccttcctaggtagcggcaagagcacatcctaacccatatcgcgggagagctcaaaggtgagtgccttcttggggtttgggactgtgagttgggaagctcctcgtgcaggtgagggttgtgggcttcgaggtgtgaacatgcaaataggtcaatgagcagggtcaaccaacgagggaaaacaacgctgccctattcccaccacatactgcttagagctaccattcaacgacatcagctccgtcagatctagcggtggagaagatgaatatgaaagagagtagaggatgaaggaagaatatgagggtaatatgatctaaaaattagcgtatttttaataaaggtgaaattataatgacatgaatcgaaataaccactcaaaaacagtacagagtactaaacagtaagaatgttttttttccccaaaccacaaaaattataataacaaaaccacaaaaattataataacacgaatctacccaaataaaaaagctgtcggaaattcccatcgtgcggccgcgggggtcgtgccgataaaatccaaagagaaagcaggcgtccgcccccttttcctttcctgcgtctcttcgtggaagacacgctacgtgccataattagcacgcaggaaatggcacgattagcagctaatccccacagtctaatcggggattaaaagcaaaccaaagcagctccccccactataccttcgtcctcctcgtcgtcgttgccttgctgtctctctccgttaattaataaatttcccccctcctcttccttccttcctccaccggctacgcgctccgtctctctctctctctctccgtttgcttcgaccaagctagggtttcgccgccgaatcgagctcggtggcgcggggattttgcggtggggcggagcgcccgcggcggtggggaggcttcgggtggcctcggcctccgtccggctcgatccgatcggtgagtgccctcctcctcctcctcggcgtgcctgctctggaaggcgcgcgaattcggtttgggcggcggcgtttcgcccagggctgtggtgcgagtcctgtgggctgtggctgtgggatgcttttgccttctgatttctgtggttaggtagacgcagtttttctgtgccaaggttgtacctaacatgatgttctcttcggttgcttattagtcttttccttggccactatccattggttgcagatccttaagagtcatttctgaactggtttcttcattcccgtcctggacgggtgatgaatccagttgatacgcctcatgtgcttcatgtactatagtttttattgttgttttttcattgggcaatgcagcagatagctttccttgagcaatatttgttcctaacccacaagatttaggaacatttagtgtccatcacttgtgttttttcacaaaccaaggatcatgtagatgctataggtgtagttgtttcataatcggaataactcatgtatatctgtacaattttgtatagaatggaagttaatttccctaatgattgatggaagttacaccgacatctgtagttcaccttcagacatcttactgtaactctataagagtaaggtttgcaccattgagtaagtttactataagacagattcatatgctgtatgaaaagtaacaacatgagatgtccctttgattcctttgttcattgagtataaaacatatagttgagtttgctatgaatgcccacttcatgaaatcgtaaattctattgttcactgtgggatctcttaaaatgataagtaatgcctactactctttatttgtatggacctatgatgcgtatatttataaataaattctataaaggttgtcaaaaaaatgtttaatgagtaaaatgcatggagggtcacccaacttgtttaggtgtcatattggttactctacttagaaaatgcacatttaagtcactaatgtgagttaagtgagtcatttacccatctaactatccacatgagcataccttgtacacatggcatgccacataggattaaaaaattgcatctagaaatgtgtagaaaactctttgtgtattttttcctttgtcagagcactactaattggcaatacacggaattagtgaaactaaattatttcatgtgcctattttgacgagttcaagttctcagttgccatcaaaccctagcagcttttattttcactatgtttttgttccactcaattacattgctaggtctgcacgttttcagaagtaattttgtcagtgatagatggcatgtcatgtgtaaggtatgcttacatggatagttagatgaaaacatgactcatttaactcacattagtgacctaaatgtgcattttggaagtagtgacctatatgacacacctaaacatgttgaatgaccatgcgttttactcatgttattatcacctaatggcatgcatatgtatatgcattaagtttctgtcatcacctttgacaggccaacaacggaacctttcattttaaaatagtttttgttggttacaaagtggcactat

SEQ ID NO: 51778 - DNA, 2306 bp, Oryza sativa
cttcatacatcgatatttgtatgtctggcatagttcaaatagagatgaattattgatgcagggtagctcctggctatggtggacctagaaaaattcacctgtaggatctgttataatttattcctcaagtactatggtaatggtctagggatcactcccacctattggtggtccatttagtattatttgcactcaaatgaactagaaggggtcaatgggtcagcctgatctggtccacttgcatccctagctaaactatcatattaggtaggcaatttcttataaatgtataggatgatttaactgaacactcagtagctgctactcatccattgcggctttcatttggttactgatgttgccacagccaaatcaattaggcgcaaatctgttccattattacctgcttgatgttctgttacatatgttttgcaggcacacagccataagttggtgttccatgagcttataagagtgatgccattattggcatgtttctatagcatctagcatctcccaatgttatgcatgtactgggctcccttaaaagatggaaattcagaagtctgatcatcatgagcagaatcttacttcaccaagagggctaatccataaagtgctgcgtcgcacaagtagcaggcgttctccaactgcagcagaccataacccttctcctgtattcctggagacaagcaattcaaaattcttaaagcaaaaggatattgatgatgccatcaaggatccagagaaggcaggcacacacgacaacagaattgaagatgagaagtctgatttgttagggtatgaaatttgttctgggaagcttacattggataacaaagccaaaagtgcatcaggtgaacagtctggatcagggtccagtagcaattgctttgatgctagactcactactgaagccttggtatggggttctaatatccttaagctcgaggacattgtatctgtgagtttttagctcattgactttattctgtaaattgcgttggtatgtttctgagtttcactgcaagtccacatcatgtgagagcaattctaagatcttttcaactttaacattgcaggtatcatatcattccgggctccgtcacttcactgtgcatgcatgccctcttgaaaaaagatccagtggactttcctgctttatgaagcctagaaaaattcaaaaggacttacgtttcctatccacttctccacacgaggcttttcggtgggttaatggttttgcagatcaacaatgctatgtaaatctattacctcaccccatggcatctagcaagaagcattcatctgaactcattccatttgataatatgtttgatccatgtgttaaatgccggtctcccccaaagatacttgtcatcttgaatcctcgatctggacatggtagatctagcaaagttttccacggaaaagtggaacctatattcaaggtatgtctagatgaatagaatcatgtgcattattttataatcagagctgtgatgtctgcctcatcaactcttaagcatgtttgcagcattagctatggtcatatagtcattacataactttaaaaaaaatgttgcaatgagtgtgctttcatgtttccttatttaccattgacattggttaccgataaaaatgcaagtcatatacctaatcgtgttgacctttttatttgtagtaatcaagtaagatgctaactttgcataggtagatgaaaaggcacgaactgtttctttattatgttccttgatccatctccataaaaatgaattcgtttgtagtagaggaccatatcaatattcatgttgtcagtatcttaccaagatgagcttctctatgtataaattcatgtttgagttcatattgtgccctaagaatcatctctcctgttgaactggagcatgctttgctatccatttgttgccaggagccattttgaaggttctctggctctagtagttcacattatctgtcaaggtccgctggttggtatgattcatatgtttgaaatgttcctgaactttaagggattttaaatctctctctctctctctctctctctctctctctctcgctgtgtgtgtctgtagctgttgtatcctttcatccagtctatttgaatcaagatattggtattacatagacacgtgtgatggagtaatatcttgatacactgttgtctctactgcgttacatatcaatcttgctgcttctagtgccatgccttgaagattatttctgccatgtcctatcatctctgtaatgctgaatttattagggatgaaaatgggctgcaggaa

SEQ ID NO: 51779 - DNA, 12147 bp, Oryza sativa
cctcttctacgtggcggcggccgttccatggaggccgacgctccagtctaagccggcccggcttatcctcggcttcgccggagtcgagctctaccggcaaggcgctagcccggtggccgtctttcggtcggccctggtgggccctcgccacgaccgcctcaggtcggagccatccaagcgaagcacggcctccatgcgctcttcgccttcaagcccgaggcctcctccggcggtctgcgctccttaccttgaacctcccgtcgctgttccccctgcgccgagcagcctcgccgactgcacgacggcgaccatcggcgcgcccaacgcctcgtagcgccgcgacgggtcacgcacgtggatggccgctaccagtgtgatgcaggcgccgccctcctccgcgcctctgcttgcaagccgcctcttgcactaagcacacgctgacacgcataagttaacagtttaggacttggcaacatcagctagcagtagagcacacgatcagatggcaatcacaagcagattaagcatatacatggacgaacgacttaatcattacagtttttttggttgtcacgtaccacgaagcataccatatatactcctacatgatgatgccattttctttcttaccatgattttctagctagctagctaatcgatcagctgcttgattgatcagtaggcagcagctgcggcggcggcgcactcaatgtcgccggccttgtcgtcgacgaccttgccgccggccatgacggtcttgtacgagtatctggtggcgacgaccacgtagaagacgaggttggcgatgccgatgcatgcgagaagccagtagaagaggtccagcctgctgttgttcaggtccttgccgaaccagccggcggcgcggccgccgtgcgaggtgacgcggacgagcggcgtgagtgggctgccctcggggaccctgtaccggtagtggcgccagccggcgaggaagacggcgagggagacggccacgacggcggcagcgccccagccgaccttctcctggaggtagacgatgatggtgacgccgagcaggacgccggcgcagagccctcctcctttcccgcctcctcctccgcgcctccgctcgcaagccgcctcgccggccgccacgcgctcgcaagccggccgccgctcagccccgcaaagaggagaggaaaaagaagagaaaaaaaaaagaaagggaaagagagagggtgacgtggagaactgatttgtgggtcctccgctgactcagccgtcacgtagactaaaaccggggtcaaaaccaccaaaggacctcgggttaccggttttgtatagttaagggaccccgtatatctgttttacagtttgaggacgttttttatcccgatgacaagttgagggacctttggtgtactttttccaaccgtaatattcgcacgggctttaactccgtttaggccacggcccaaaactatccccggatgggtgcgactgcaacctatttcagcagcaactccggtgtccggtgttcgatgccggttgccctagccgccgccgccgccgtcgccgtcctctctctcctgtttcctcgttcgtaggatcgatgatctagtggctttgcggacaggtagttcgtatttttatcgtcctttcctgggcgtgttttaaattcatcttttgctgctggttttcacttttcagaatatgcatcgatgctctctgcgggttctcaagaaaatacaggagaaaagaagcattgatcttcttctgtgatcgaagtgatagaaatcaatggaatatcccttgttttcttggtttctgagggtaaatttccttgtttttccaaggataaaccgattcgacataagttaattaccaagtcggtttttcaatttcagtatgaatccaattcgagcatatacaagtaagtgccctaattcgaatcaggctctgaggctggtgaaattccctttataaataagctcgacaataacactgatctcatatttgcataccatccgagtggaaaagccccattgtcagtagtcatgcagtccaatagcatccaaagctatgtaagtctctttccctctctctgttagtaatttttgttagtagtttttccagtgtaaataaacctaataccatcctttatatgtttagtatttcttgtaaaattaagagaacattttaaacttcagtttaaatgattgagcactttattggtgtaggaccaaggtagattcaaccaattgccggatcatatcttactctctatcctagaaagagttgatatgcgcacagttctaaggaccagtgtcctgtcgacacggtggaagcacctgcctcttttgctctctgatgtcgacttagatgcagatgaattcatccaccaaaattcctcaatgtcggccgatgaagcgatggctgttctagttaaattgatgagcagtttatttggttctcctcggagcgaatctatcattaaaaagctaaacctcaggttctgcttgctcactgatttggagacatcattagattatttgtttaacatcggtgagctagtttgcaatgctattgacagtggtaaagtaaagagcgtggagcttgcgatcacaactgagaagcggagtgtagattgcacgtctagtgatatgctgctgcatgcaaagagcttagtggaattttttaatatatctcgtagtctgtcatgttgcctcacgaaactcctcctgtgtacggcaaggttttctgaacaagatctgcatcaactaataatcagctgtgatcagctgcagcatctaactctctattattgtgaacttcgggattcatcaacattgaagctggatatgccgaattcaaaactccgcttcgttgaactcaactcgtgctatgtcaagaccgtagagtttctctgcctacctaaactagagcagctatactgtgactcatggcgcttatcaggggctcccctatcttttggtgtagttccttgccttgaggaactacgccttgtttgcgacgtcacgtatccagtcggggttcaaattgactgatcttcttcatggtactgcaaatgtacaggatattgctttggatttccaaggagaggtggtaagtaatttactaatttaattacatggaaagtcatctttattaatgtcatatggtggtggctgttggctacatgttgctatgaaatttgcactgaaactgaaagagcattttaaaagcttttttttttttgtgtgtgatttgatcttaatggcaggtactgtttgatcctttttttccccgaccaaatctcaaatactcagattatcttttagagtacaccagggttactattggcaccagggttattgagtacacaagtgttggcctgattaagagctttttgtgcatagaaataattccttgtttattttgttaattttacctagatttggattacacctgaaggaaaaaagctacgctccgccttgaacaagataacaaagttatttctgcatgggatctatgtgaaatttgatctcctatggacattggttctccttgaatccgcaccatccgttaaggtttttggtgtcaaggttatgctgtcattttttcttgtttttttatcatgatttggtttcagctatgttctcattcaagtctttctgatgattagtacgcatgatgtcaaatgttttcttatatctgaatgtaggtgtggaaccatgcatgtgacgagggtactgagaatagaaaacaattgtatgaaagaaatgatttgtgggatgctgcacagttggatggctcgatacattatttgcaactagagaggttagaatttggtggattcaaccaaataataagagaacacttggatttcataagagctatcattgagcgtgctccaaacttaaagtcagctattttagaagacagatccctgtgaagactgtgaagcaatggacaacccaatttatcctacaatatccatgtttccacagaataatgatgaaaagatcacttttgtaaagcaactcaaagccgggatgaatcgccctgttgaaataattttctgctaacaaagaatgtatttctatgctattgtgttcctgtaaaaatgatgattttttttttcgttatgcgtaatgggctagtcagatacctagcttgattggtaaagttatcattggcatagaccactgagcatgttctactgttcttcagtgctgaactggtcgtgatagtagttcattagccgatgaacttctcacgtagtagtagttcattagccgatctccctgatgtacaatgataccaagttgcagatccctttcaataaattatataattgtgagcatcgttcagaatctgtatataccatcctggttttgccaaatcacaagcagatactatgcaaatactttacaacatcacaaccagatatgcaacttcgcaaatcgcaacatcaacataacaatcagataggtacttggcaacctaacgatcagaaatcaatctgatatagattggaaatgcatcgcgaaaccagatactatatcacaatcagaaatctgacatatattggaaatgcatgaaaccagatactatatcacaatcagaaatctgatatagacaggaaatgcatcacaaaacagatatatcagatacttggcaacatcagcatcacaatcaggtatatcacttggcaacatcatcacaaccagatatctgtcatagataggaaattcatcgcaaattgtacttcgcagcatccatggatcgataacctgggatagttagtacggtagttcctaagcaacggtagctcctaagcaacataagactagcatccctaagcaaaattagacaatagctgatcgcatcagtggagatggggattcacgcagtggcgatggcggtggtcatggagtcgcgggcgaggccgtcgacggggtcacgggccgggggcgatcgcgtcgggggcgtcggtggggacgggggcgatcgcggcggggacgtcggcggggacgggggcgatcgcggcggggacgacggcgggggcgggggcgatcgcggcggaggcggcagccttcttggccatggctctcgcgtggatcctgttcatggcggcctcttccttctctgagaaggggacgtcctcgcgatccacgtcgccctcatcgtcgcttgggatcccggccttgatccgcgtcgcgtccttttgcgagctgtcattccggtacggcttccctccgacgccactgaaacgaatcgaaacgaaacaagggttagaagcctgcgaaaccagatgagatctagagcgcgcgcgcgaggccttcttaccgggtctttgggctcgcccaccgccccatcgcgactccggaggtggacgacggcagcggcagcgggcgccgcggagattttaggtttagactttaaaggaatggaggcggcgctgtcgggacaccagtacactactgctctctgttctcacacgggccagcacttcgaggagacgaggtcttactatatatatactcttgctattgggccggcctgtggtccggcctttgaacaggtcccggcccattagtttgttccctgtgatattttgcgtgatcgttgcggttgaatttaaattgatttatgcataccagaaaaatccgtcacgtgattatattagtactagctagtttgcaacgatattgaattattgctagtggtaaagtgaagagtgtggagagattttgatacgctgattgctgttggcactatacttgtatgtgctgcaaacatgtgatcagccatgattcatggcaacaggatttccaagccgatgcatgcatcatgccaccattactttggacttattttcagagccctgagtgatgatggtgttctaagagatgaaaaacagtggacgatttgttagaacgtaactctcctgtgtcatcagatatattcagacacaatggcgccggctcatcacagccactaatttttctccctttcacgtttgaacctgaaaggtcgctattcaccggctcacagctgctccatcggtgttgaagtggccgctggaggtggcgacgccgacgacgacgttgaaatgaggtttaggatttgggctagctgcagctggtaccgacgacaatgtgcgtacttctttggctgagatccctccggtgaccgatgccggccgatacccgattcgattgccctggccgcgcgcggccgctattgaaaaccgatacgtcacgtcacctaacacgtggggtacaccgtacacccagaaaaccgatgcactgtccgtctatatggcggatgcgggcacacggtgcgcggcgaccttagcggagggtttttccggcagaacgtcgcactgcttctgcggcgtctggggtaccgcgtagctatataggctggcccatctggatcattagcacagcattagtcacatggcttcgagtacctttagcaccgggcctcttagctgacgcaaatgattaatgatttataactattcttcaccacaagaaactagagcaacacagatttaactttcatttatgagattcaaactttgtattctgtccgaagctacaagaaatatgatcatcaatagtttgattccacatgctatgggtaaaatatacgagtagtaatcataaggatgcttcaaggcatcgtatgctttggccgagtctagaccacgtcaaaaaaaaatactgtcacatttacagttcccgcaatgaaaaacgatggtgaaaaccatcaactaaagccctgtcaatccttgcatatgcttcttcatcgcacggtctctccggtgatggttatcccggccaccacctctccttccacctctgcctccacgaggtgcaggccctcctcgagcgaagccctgtgctgcatctggatcttcatggtcctccgctggatggtcatggttcctgcctcctcttgttgcgccacggccaaatccacgttggccattcgggttctcgtttgcctctggctggttgccgtgatttctgccccctcttcttccaccacggccaaatcctggtggcccgtttgggttctcgccctccggcggtgggtcgccgtgatcccttccacctcttctgccatgatcgccacggggatatgagcctcctctgcctatgttggagcctcctctgccgaagttgtttgcattgctaccctcctcttcctccatgtctctgtgttgttgcctgttgggaactccaagaggtacatttccaccacggccaagaccatgaatggtatctttctgaacattgcgcaggacagccgcttctcgggcactagatacagcaactgaaccagcaaccttgtagctgtagttcttcccgtccttaacataaaactgtgtcttcttttgtgagctccaccgtgggccctgtgaggaactctcggcatcattggcaccatcagtttcctcataacttgattctaccacactgaagccaagatcatcgaacgagtcatcatactcatcatcatattcatactgggattcaagcacagctgatctaacagcatcttttgctttctgtgagtctagagttgcagagtcaggcacgtcgtcattggtcttccttgtaaatctaccttgcgggactgatggtacagatgaggatggtccctgggatgctgatggaactgaagaagatgaagaatgttcaacatagcgatgcatctcagtattaaccttatggggtttgttcataatttgaggctcagtctccacaagtattcctttgcccttatctttcccaacagtggctgcaggctttagctgcggcatctcttctaatgaagtatccagagctagaagatcttgatggagggttccatctaaaatcctttggataacttcctctgggttctggttgtaggcttccaggcatgcagcgaggaaacccttcccataatcaggaaagaggtcccttatttgagtaatcttggactcagtgatggcagtatcctcattcttatgttgtagttcaccaccataggaagagacaggcaaatcaggcacactattccaagatgtcagagtagatccacacaagcgtgcaatgaactggaactgctcatcatccatgtgtatccatcctgtttacgattggaggaacatattgaatacatcaaccaaaggttttggcatcaatataaaactatgacacaatcaataaacttgagataacaagaaaatacagcatatatgtcaacagaataatgctgacagtttagcaaactctttcagtcttcacaacagaatctagccaaaacagaaaaagtgatgtcttatgaacacaactcaaaagtgccagaatgatcaaacgcgagcagaaataaaatcaaatgtagggtaatacgggaatattattggtgaactttatgagaacaaaacaacagaagctagagcatcttttccttttactagccaaaagtccatgcgttgcaacggaaaacaaattgagtttctagttaagtcaattaagcacatagttaatccaagtagtacttttatgattttccttattgaacaagtaggtgattcaaaatttggggagaaccagcagtgaaataggaggacttgttggagggtgatgtaatagtatagattgtgggacccaaatgtcagtggtaaggatggtgtggcagaacagacaccaccacgtatacattttaagtagtatagatataaatatagataagattctgttttggctctttctctttccattcattgagatcaatatgctggatcaagctggaagttttaagctttctaagaaccactcatgcatagatggcgagagcaggcatagtaacagaatatagaatcataggcaattcagtacatatatgtagaataattgtatgacaacttctgaataaagttcctagatcgtatatgttgtttatggatgaaaaactaaagagacaattttggctgaaataataatagtgggatactaaggttgtgtggaattttacaaacatgaaaataaccaagcatttaattgagattttttatcatttacctttctttcgaatatctccaatccggttcatcaacttgaactccttttcaagagcttggaggaatgtctttccaggatgatcttgtgaaaatgtggcttctctattgatatccttgagtgtttgaattatgatgtcacccctgatcataggatcttcgactttagctggaaacatctttgtacaagcttcaacatcacgctccacaagttgattgttcaaatagcagaactccaataatctccatccgaaactgacagttctccttgacagcatccttataccaagaactatgtcactcagtataatgtcagatgcagtctctccattgctttgggaactggacataacttgaaacccatgaagcaaagatggcaacaatgagtcatacaatcttggaagagtgttcagtagttcctcaactccatagctgcaaattaagtggtagataagcatcattgcctattaagggaacagcgaacaaatattgtgttggatgagtagaagcgcacctcgtctcaaaagaggtacaaaataataaagcagcaggttgataagcatcgacaaaggcatccagagtgacaattgcatcgtttacaaaatccaacacctgaaggaagttggatttacaacaatatagaaaaatcagatgaaaggacagcagacatatcataaactatgcagtataggtaaaacttgcctctgagaaatctttctgaagttgggtatatccactatcattcggtccagatgaagtgagcgcctaaaatgaatttattatggttaagttctttttatgcatagttctccaagatcttctgtaaactactaaactgtcatcagatcaggaaggtgtgaaactacaagatcaagtttatatcaatatcataggtcctcaacttttaatcgtggtgagaaaacatacttcaatctcaatttaggataaaaaagaacagagacaaattaatagtaaacatcataatcgtcactttctatctaacctaccaagcaatgtatcatggttgttgaaaggaactgggaagaaagtatttgaaacaataacagatataacaagtaataacaagtatattcgtcaatagcacaaatgaataacctgaatcctttgcagaaaacgataaaagttttagcatatgcgattgggactacagactaaagtgaaaacagctgttataatgatatcatatggatgttcataccagataaaggaatacagaatcctataacagctatgtgcagtgatttatgaagaagatcacaaaataacctgtaatgatttcatgcacctctcctgcattgtgtggaaaatgcccaggaattggggaaggacaatattaatgccatccagaatatttggctggacattgatagcgttttcaacctacagatacagaaaatgtgcacttgttattaataaaattataaaagtattcatgccaatgaatagaaaaaggttatctgagactaagggaatgaattagaatttgcatttaagttagcatctgtctgcaaaatgaaaaggagaaaaacaacaacaataataaacacttcaggaaccaaccagtgaacttgtcaatttgcaattgtcatgcccataaatagcacaaatgtccaacaacttgggtaaatcaagcaatcttttctcctgcaggagggctacaaccgaacaacgtgaatatagtatatttgaaccaatggtcactatccattctgctctaaaaaaaggtaaactcaaacagtgatcatatgagtagttctaatctcacctgcatgctccttcatgctaagggattcacccctgaatgctccaggatccttgtttgaagatctaccacccaaacaagagccatatcatgacaaatctcatgtgaatctgaacagtgtgcattatcttatgaaaaatatgtatacaagaaagatagcgaaatggtataaatctcacatgcggtacaggaccataaagactcgacggcaaagctcaagctccccgacaactaagccagcaactgtccctttgggtgcacgatgaggcaagtcataccaccgatgcctgaattgtaggtaactgtccaggaactcatgcagggaagtattctgtgccactgggaaaaggtaacgataagcattaggaaaccattggtaaagttcaaatgcacgcggatttattcataagttaaattctaggagtgaaacaatggataatcacagatctaggcgtgtcctcaactcaagcttttatgttgactcatctactcgctcaattattgttcaggcttagtttgcataagaaaaaatgccaaattcctctgattgtagggtagttattcctgtcaatctgaagttcctgtcaatctgaagggactaggattaattccttcccattaaaactatttcaaaggatcataggtcatgatagtgataagaatatgattgcataggctttgctttgcttatgcaactactagccacttcaactgcaaatgtagtaataaatttaactgcacgcattttatcttgcgcttaaaagtgcaaactgacatttgaacaagcatacactagaattttacacataatccgtagccttagataatcacagagaccgaagcatcagaagatgcattcaacaaacacaattgaagcaaacaagcagtaaacaccgaacattaagtggttaactagttatcgcttccaagctttcagctctgatttcccaatcccaaaataacaattcacgccttccagctacacggtttcatgagcacagtaatgcacaagcgagcgtttcggttaccctggcgccagaactcgcggggcttagcgcggaggagcgcggcgagggcatcgttgaggaggtcgacgacggcctgcgactcctgggcgtcgggcccgccgagcccggccgcgaccacctcgtcgtgcggcaggtacgccacgaacccatcggcctctccgcccaccctgccggcgccagatgcagacggggaagccgatgatcggagggcggtggtgagcgtcggcgggggcgagggtttaggtgcggcgggcttggggacgtagcgctgc

SEQ ID NO: 51780 - DNA, 4960 bp, Oryza sativa
agggcaaaattgtaacttttctcttggtgtaggtctgatccgaactagatctggttgggttaaaaagaacatgcaccataggtaaaaagttgtcttttttgaaagtttctctctccatttagatccgatataataaaataatacgttcagcatccaccagctaattaccatgtttttagtggtgtcatgtaataaatacacattctttggatgtcatacaacaaataccataaactttgaggatccttttttgcctgatatttatggcgaattgaggataccttagctactagtaaggtttcttatgatggaacctgctaatctaagtttaagttctaattttagcacgaatacttgtatttacagctactacctccgtttcaaaatatagcaaactatgatgggatgagacccatctaagactatgaatctggacatgagacatgtccggaaggagtaattattttcactggtagcgatatacatgttgacagcgagtctatgatgtgcttgtatttatagctaattatttttagtggtggacaacgtaccatattacttgtggtgacttcgtcgaactcaaaatttgtaggtatatacagacaccagtggtgaccggtaacctcgtcaatcttaacatattactaactcaatcttcaaaagtattcattagaaccaaatgtacacgtgtgtattatataagagtgagcttatatgtctgtgatgttttcatcgagctcaagatatacggaccaatttttttagaggtgctcatgagataggttaagtacgtatgcattaagaacaaattcgataaatgaatgataaatcagcaaaaattaattatcaaaaaaagacactaatattacttcgccatttggtgagattgtggttgcatagagctagcgtagaagattaagaagcaataattcaaaaaagatgaataaataaaataaatttagacgattcaaaaaagatgaataaataaaataaaattagacgattaagaagtcaaaaattaattatcagagccaggtttcgatcctgggacctgtgggttatgggcccaccacgcttccgctgcgccactctgatggtgttgtttaggatgttaaacgtttctaatttaaacaatgctctataactaatcattcggctaagaacactaaggcatcgttcgtttaggggtgataggggagattggctctcgttttccgcgcgcacacttttcaaactactaaacggtgtgttttttgcaaaaaatttctataggaaagttgctttaaaaaatcatattaatccatttttaaattttaaaatagttaatactcaattaatcatgagctaatggctcacctcgttttgcgtatcttcccaatctcctcaatccccttctcctcaaacactccctaactcattcattattaggtataagaacactaactcatccattctcgaacactaactcatccattatccattctcgaacactaactcattatacattctcgaacactaactcatcattctcagtataataacttcactaatcattcggtattcagatataatataagaactttctatctcagattttttccgtttgtcaactgagcacagcctgcgatgtgtaacaatcgaatgctatatatctcccataaatgctcgaagaaaagcgaaaaagtacaaggacgatattacagtgctttggtatgttaagcatttttttatacaaaaagtcagacttcataagaatacaagtccgcgtaatttataactcagatagcaaaacatcgggaacaactagcactacagcaaaactaatactatgaaaatatagaaatctcagatgaaaaatacacttctgattctagccagctgttggctcctcacataacaattcgattcaagggttcaattgttcgttttgcattgctctggcctctggagcacacttaacatctatagttagaacacattatctactgtaaatccatcacttggaaattccaaggtgtggggatataggatgtcgtggagatagtaaccatctgattcttcagctcaactcgttaattgcatcaagatgagtatcgtatcaatattcacagtttacatcctacggttcaagctctttgttttcctgagttgatttcccagttttctgtgcttgactttctttcttgcgctgcatcgattattagagagaaaaaaaatatgaggcaaagcagaactcaattgaggtaatttgatctagcctaagctctatgtgcagaagttagaaaagcggagaacataagccacataaacaaataacaatggcaaaattggttctagagcatccaaagttcatgtgttttaattttaaagcaccgaaagttaatgttcactttaatagcactgaaaagttccctccattcccgctcttagcactcccgtttctttgggtgagagatggggttccagctgcttgatttagttgatctgaagatgtgttcggctatttcagttgaaaggaggatagggttggaatctcaggtgcttgaatgagtcaatctcggtcaaaactgacgtcacatgcaagaaaagaaacgggagtgctaagagtgggaacggagggaacttttcggtgctattaaagtgaacctgttacttccggtgctataaaacaaaaacatgtgaccttacgatgctctagaaccaattctgccaataatttaataaaagatcccatggattcagttcatgcagcacagagagctaaaagggcctcaggtgctgttttatcaaatatatatatatgattaattctggtttaaaaaactgtggtttagttcttgaagtcacaggcacacagtggaaacctatctaccgctgtcgccatctcctcaatatcagcaatctaatggatgaatttagatatctcctcaatattagtaaatgcttatcattagtaaaacatgacaaactcttacaaagaactgctattctgccagtcatgtatcaaccaaaaaagaaaggtacaagaattttaagcaatagagacattaataactgcaaccagttaataacagcaagagattcagcactcaataacaagacagattaatctcccatcatctttcaattagttctttttttctcttgcatctataatgaactacagcatttggttcatggtgaaatatcaacagatcacttaatggaagaataatgatgaggtcagcagctccaagagaatatttaggggaaaatagcatcagaagtgtaacatttcattttcaaagtattagcatgtcggtgagcggcataccttcggaagaagtccttctgcagacatcagctcatataacttgcgcatgattgtttcttcttccacctgtacagaccaacattttcaaagtattactatctaaaaagttacttccaagacatagtgacgcctcatactccaatactctccatataaagctcacctgaactttatgcaactcgtgggacattgctcggtaagtttccattagggcttgattttgcttgtccaaatgcctgcagatcccttgtaagtagtgtaatgaactaaaatcctcaagaattaagggacggaaaagaaattcttacttggacatttcagctgaatgctttggttccattctcaccaacagcctgataccagttcctgcaaattgctttacattttaaaaatcatttaaaagcaagctagaaagttgaccgttattttatattaattgaggaattctgagttcacgccttgagggtgcagtgaggatggaatcgtactgctacattatgatctcattcaaaaaaaaatgaaacaaatatatgcaattgtatttgtttcttacgcataggagagctgccctggtaccctaggatgcaaggctcaattcagcaatgaacgacacatgaatgacatgattatttgatttgacatctaaaaacattgcacatatagtccgatgtcatcttgtcattctggttttctagaatcaagacacattttgttctctctttattggaaatttaaaagaactaagaaatagctaagatgaaaaaaaaaacaacatgtaatcaaatggacatggcaggctgctatttgacatggctatatttcaacggaacacaaagctcgttgaggtgctagagaacagtttacatactacacgggcccagtaaattttcgtgggggcatggacacatcacgagttattaacaccactgttcataaatcatagtagtatagtattattttgagaatatcatgcgtccaaaatatcctataggcacagttgcaatacaatctgcaggggcaatggcgggactaacatgggggcaatggggttgagatgaaccctaaataacaggaatcggcgtatgaaggggatgggctaattggagggaaactgggggaaaaaaaatcgatctcctatctacgcgacgctgactcatgaagtgggcgccgaggagggaggagggatacgagagaagaaccaataataccttagttcgattcgagcagcgatggaggccggccgtgcgcgcgaggaggccgcacggggtggaagcctgaagcaggctagggcgagttcaggaagaagaggggaccgtgctcaccgcgccgccgatctgctcgccggccgcggacacgatgaggcgaggcggagcaggtgcacgacggcgcggagcggggcggcggcgttggagctctggctcaccgtgctcaaaagtcaagacaggcaggaggtcgattgtggggcggggccgtgcagcgctctgctaccgcctgcctgtgggtcatatgcacaggcccatgaggctggaaagaagaaatttttcatctcggaaaaagttcacctaaggtcccttttcttgacgtcgagttttaaaaccgttcctgaactgaaataccaagatacaatgtatgtcacatttggtccca

SEQ ID NO: 51781 - DNA, 1825 bp, Oryza sativa
gccagccggcggggacaagctcgacggcggagactgccggctagtgtggctcccaatagccgggagtgctcgtgtcatgtacctgactgcgcacccaactgcaattgcaatgtattcacctgcacacacaggggctggggcttccgccacgtcatgctgcccaagctcttattccccaaactcagagccatctccactgagctgctcaaaagccgatttgtttaggtgtcctcgagctttgtctctcccccgcggaggcgcacgcacagctccactgcatcatcttcgaggtcaactccatttactccacgctgtggtcgcgtcatcctcaacgcttccgcccttcttcccgccacccgccaccgtcaagcttctcgccggtcgccagccttctcccacccattgccggccgtcaccgtcaggcttctacttggcgtcgccgcccaacggccgctactcttctcccctcctgttgtcggatgccccagaggtttgggttgagatgggaagagagagaagataaatggaataagactcagccgccacatcatcaaaaccgaggagtaatattgccttgggacctaatgtgatctgattttacaagattagatatgtgttatgtctagtatttcggtttagggatgattttgaaacttgatgacaagataagagacctcacgctcactttttcctttcatctctctcgttgcttttcttttaagaatagtaaaccgactagcgaaggtgttctgccaatttctcagtagttttcacattccgttgcccaaaaataagttcttccatggcaggatctgctgtacgaggaggcaaggagcgaaatggtaaaaaagaactcgatcaatgaggtatataattaaggttggccatcctttgggaatgaatcaaatggattcaggatggaaaaatgtactgtatcaacagaagtagaagaaaaaaaaatatgtatttctgcgccagctgcaaagaaccatagcttgagctagcgtccgtggcgccatggctggagtacgtggatcattgctgctgcggtggagagatcttgaggtcgagcccgacgttgaccccgttgtacgcgatcggcgcgaacatccacatatcatccgagctcagaagctgcgcaaaacgatgaatcccattgctttagcttatggaagattagagaccaacgcgcgaattgaagcaaaacttgggctcttggattcgaatcaggggtcttatggttaccttgatttggagctgcaagaacttgacgtagtgaactgcttcttcaagcatcgtgctgatgtccacctgaaaaaaataacaagtcctcgcatgatcagagcaattcagtatcgtggaggcttttgtggagtattgtgattgatgcggttttggaatcagatggtttttaagtaacttaccttggttccatttgggataagattctgcagtatctttagccgttcattgatcctttctctcctcttctgttcaagcaagacagttaaaaaaaaattcagattcagatgagcaacaaaaatgtgcagcaactcgcgcatagttctacctaccctggcatagaggctttgcggatcggtcgccgccccgcgcccggccctcgccttcgcgccgccgtgcccggtcgccggcgatgacaacgacgacttcttggacgccgagctcacgttgctgcacgaagtcatctccagcgacagcgagtcgtcatcagagaggtagttggtgctcgagctctgcacattgccgccgtcgccgccgccattgctctccttctggttgctgctccggctgcacgcgcccttct

SEQ ID NO: 51782 - DNA, 1131 bp, Oryza sativa
acccatgaattcagaaccccagagtccgcacatcctcaaatacaaagcacttccctagttagatgtaggttagattcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaatccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtcccatgttgtcctcctctggggcaacaaacagcaggccgagttggctctggccggaaaggtggccaaatacacggcctgca

SEQ ID NO: 51783 - DNA, 2764 bp, Oryza sativa
atgacctgcatataagtaacagtaagtgatttatcaaaaaccctatcatttctactcagccacagagcccaacacaaggcagaagctccaacaagtatcagtttgctctttttgtttatgactccctgaagccaatcatcaaaaatatgagatatgctagtaggaatatataaaccaaaagaaaactaaactgctctccaaataaactttgcaaaatgacaatcaatgaacaaatgttggatagactcatttttcgtacaaaagcaacatcttaaattaccattccaattccgtcttgctaaattatccttggttaacacaactcccttaagcaaataccacataaagatcttgatcttaagcggcatcttgagtttccaaattaacttatttctgtcaatgtaaccattattaattaaagctaagtacattgatctaactgagaattggtcattctgatgatagttccatctaaaacaatcagaagtattattcaattgaatatgaacaatagatgcacacaattcatgccaaagtgttaaattctgaccaactaaagctctcctaaaagaaacattgagcggaacagaagccatcacactagcaacagaagaacttctccttctgacaatagcatataaagatggatacttttctctaaaggccatatttcctagccatctatcttcccaaaatcttatttgttccccattattcacaatccaagaacccatagttaagaaagtgtttttgacattcatgagtcctgaccaaaaatgggagtcaccttgtttcctgtcaacttgggttatagacttattataaagatactttctcttcaataggtcttgccaaacaccattttcatttattaacttgaacaaccatttactcaaaagacatctattttgaatatctaaattatgaacccccaaactcccctgttctttgggttggcaaataatatcccatctagtaagtctataatttttcttatggtcatctccttgccaaaagaaacgaaatatataataatcaatcttttgaagaacccctttcggaatctcaaagaaagatatcataaacatagctaaacttgaaaggacagaattaatcaaaaccagtctacccccaacagacatatgttttcctttccggctgctaaattttttctctattctttgttcgataactttccaatcattattacaaagctttctaaaatgaattggaataccgagatatttaactggaaaagatcttaacttacaaccaaagatattagaatattgctcataacactccttttcctgaccaaagcaaaataactcacttttgtgaaaattaattttcaagccagataatttctcaaagatagacataatcaattttaaattctttgcttgttgtaaatcatactccagaaaaatgatggtatcatctgcatattgcaaaatagacaaaccatcatccactaggtgaggaaccaccccatgaagagatccattatctttagctcttttaattagtaaagctagcatatcagcaactaaattaaagagaattggagatagaggatccccttgtctaagacctttatgcgtttgaaaattattaccagtttgatcattaactttaataccaacatgaccaccttgaataaaagaggcaatccactcacaccatttagtagagaagcctttcatcctcaaagtctgttgtacaaatgaccatttaaccttatcataagctttctcaaaatcaatcttaaaaattacagcacttttgtttttacgatgtaactcatgcaaagtttcatgcaaaataaccacaccttccataatatttctcccaggaatgaaagcagtttgagtaggactaattgccttttgggcaaccgtcatgactctatttgtggcaactttggtaaagatcttaaaactaacattaagtaagcaaataggcctatattgctggattttcatggcctcaacatacttaggtaaaagaatgatcgtaccaaaattaagagagtataaaggcaaagtatcattatgaaattctttaaaaagatctaataagtcacattttatgacattccagaaaacttgataaaattcagcaggaaatccatcaggacccggtgctttgttatgttccatttggaagatcgcctcattaatctgtttttcagtaaaaacatgcgttaaagcctcattctccaactgagaaacttgaggaatgtcagcaaatttattctcatcaaactgaagagtagaatcattaggaggcccaaataaacctttataataagtggtaatatgcgatttcaaattcgcatcaccatttattaattggtcaccatcatgtaattgaaaaattctagtcttcctatgttttccatttgcaaccaaatgaaaatattttgtgttagaatcaccctctaaaatatccttagatttcaccctctgataccatttaacttcctcttctctcagaattgtagataatctatttctacaaaaccatctaaaatccaactcctcctgactcaaaagcatagtttctgcctttttatctagcaaatccaacttatctaaaatctccttttttttcttttttgtacaagccactagtatgtttagaccaacccctaagatgctgtcttaaacgacgaattttcgcctgccaccgctccatggcagaattgcgttcatcaacactagaccatatctcctttaccatatcaacaaagccatcacgt

SEQ ID NO: 51784 - DNA, 1442 bp, Oryza sativa
aatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactgaagcaatcacacaccttctctgcaaaaatcccaatctaccaccgcacccaacgaagcttaagacagtggaataaagcagagagagaaatcaaagcaagaaagagagagaagaagcgaggcaagagtcaagaccatctcccatggccagtggtgatagtagtagtagtagtagtatataaaaggggagcgcgccacggcttgccaatccgccgcgctggtgtgatgctgcgatcgacgcatccgccgcccagtagcccgagcagcagcagcagcggcggcggcgggggcggggggtcgtcggcgtcgtcgagctcggagaagacgatggtgggcggcgggggaggagggggaggagggagcgggtcggcggcgccgagcggggcgaagctgctgcagatcctgaacgtgcgggtggtggggagcggcgagcgggtggtggtgctgtcgcatggcttcgggacggaccagtcggcgtggagccgcgtgctgccgtacctcacccgcgaccaccgcgtcgtgctctacgacctcgtctgcgccggcagcgtcaacccggaccacttcgacttccgccgctacgacaacctcgacgcctacgtcgacgacctgctcgccatcctcgacgcgctccgcatcccgcgctgcgccttcgtcggccactccgtctccgccatgatcggcatcctcgcctccatccgacgacctgacctcttcgccaa

SEQ ID NO: 51785 - DNA, 1314 bp, Oryza sativa
ttttttttttttgcgggaaagcagtgttacaacttgcaagcctgttgctacagtgcactttcattatttcatatttgttggattgaaatcaagcctagctcagctgggtagtttcgttgactcgttgtggacttgtaacctgaccaccggtatgatttagcgatgtgtaaatgcatggacaaggggggtggcaaagaaacgaagaggataggtgaaaaaggaaaggagagggattgggaaagacgacacatggccattttggatgagaccaagttgcaatttggtgcatacactttcgtctaaaaaatcaacttctaatcttctacagacgtatatggacaaatatttgttcagatatatctttgtgatgatatgaaacaaagaagaaagtacaaggtaatttttttcatctcaatatatagtaacttagaaccggatgaaactataaatatgaataaatcataattaggagtagatatcaagccagctcgcctcgatctagctcgttaggataacttatccaaacgagttaaaaggttgactcggttgccggctcaagccagctcgtttagcttgtgagaccgaacaagatatcgaaattaggatggagcaagatacaactttttttttgaacgactcgcacgagacggtgcgaagttctattgatagaataggaaaaaaaatacaggattaaaaccttggtagatcgtaaccaagaaaaaaggggaaaaataccatcacccacacaccgacagcgccaacacacaggtccaggagaaggctgacaccggaccggtcgccactacgccaacaacgaatcatagacgagatcgccaaaaaaacacccttacaaccaacacaaagcccaactctatccacgtcttccagatttagggagagagggtgagagagaagaacatctgtccccgcccctaggctctccgacgtggcaaatttgtagaaactaggacgccgccacaagaggatgagaatctagagcgtgcatgcaccaattgttcgagtggttcggcaaggggatgcctaaacgacgtctccaaggagagaagcgacgaaaagccgctgacgtcgtccgtcagggtctcaaaagagccaagactgggctttcacccggcaaccacccttaagggatgagacagcacgacaacgctctcaggagagggaatgacaccatcgttgtcagtctggccaaggccgggttaggttttcagccgccgctcaccacctgctccaccaccgaccgatgctccaccatcacccaactctgccgacatgtcggaccactttaccggcgcc

SEQ ID NO: 51786 - DNA, 1917 bp, Oryza sativa
gcatctgccacgcccccgactagccattcgagaccgtcgtgcctccttccatcgcaaccacggtcgccaccgccgtgcctcctcccactgcagccacggtcgccacagcagccgatgctgccgtcggccagccacctgctgttgccgctgttgccaccgtcgccacaagctccgcgccactgtcgccgctgcgacggcctctcccgccacgagttcaccccgttgacgctgacgctgtcgccacgagctccgcagcaccgccaccgccgcaagctcgccccacaccagatctgccctcaggagggccggatccgtccagggcggctccctaggttacccaagcgtggtcccgccggcgagaagcgatccccgccgccgccatccttgcagccgctgacaaaagccggcggccgctcaggcggcggcgaggcggaggagagaggtgggggagagggggtggccggagctcgcctccctagccatccccggggagggcgacaggagaggtggggttgacgttccttgattaattccaagatacatcaaattcataatactatgccatcatatatggggagagtgggagtaaggttctctgctctctagcctgctctctagagcgggccccctctccgttggggtatcgaaggaatcccgatccctgtacgcgataagatggggccatgccatgaaccgggtcggcgtcgtgcgtgccgcgtacgtacacatcgccttggttgtgcctagttgccctatagccgcagcttatcctccccgtcgtagaggcgacaaccgacggcgagccatctctcgagtccgaggcccttccgcttttgtcgtgcccggcgcgacgttccgtgccacattcatcggccgcacgtcgcgctacagcgggcggcgctgtgtgcctgtgttggctcgcggccaaaaagcccaagagaggggaggctgggagaggccccccatctccatgtcgagtcgccacatgcagtgaccagtgatacagtcatatgtacagtagggcactatgcaagtatgcaggtaatgtgttggaggcacacgcgcacgggcggcggagccggcgggaaacactgcaaggtgcatgagattgatgtgagagacggcattttgatccattgttcgtgaatgtggataatttttaccgtaattttgacaatttgacccttttaaaaaacttattttgaaattgaatcatcccaaaaactaatttcaaaattaggccgttttctcagcgccatatagattagcgccgagatgtcatccgaagtgtcacggattttacacgtcatccgaggtcatcgccaaatactctttgttcaatttacaaatattagttatctacaagcttccattgcacacacaaagacaagaaagcttggtgaactctaggtgctaaatactgcgaggtaatgggttcgatcctcagccaagcaagtataagcatcttttgctgttctatttaaaaatctcacatgcttttcaaattcattttatttttaaatatggatgttttttaatttattttatttttaaatatggaaggagcaaaattatgtatgtggtatttatagcttaatagttggtataaaattacatctttcattttttttcaccctctattttgctacataattatgtatgcagtattgatcctaaaaggaaaaaaaagaaaaataagaagttacggggttcgaacccttgacctcttgttatgagaggcagcccttcaccaccaggatagaccttccataaggctagaatgtacatgcatactatttatacaactataccatggaggttagcaccaaattctttagcgctgacatcgcatcgcatgacgtgtgatttacgtgacacgttggatcgcatctcaacgccaaagaaagtggcgctaat

SEQ ID NO: 51787 - DNA, 1187 bp, Oryza sativa
ctgtttctttttttttttcttttttttcgccgtatgttgttcctgccgtacggataaaagaaaaaaatataattagtttagattagtttcctatttttactagtggttggtttactagtaatttttaaattttaactttaaatttttcaaatttagacatgaaaattttcaaatctcgagctgaaagttttcaaatctcaagggagagagggaggagaaagaaggatagatagggtcatagggatgacatgtgggtcctataattactttttgtgtgaatgacaaatagggcccatatagtttttaattctaatgctacctaagcgccacgtcagtaccacaaaccaagtcaacatcgccacatcagcgccacgtcagtaaaaccgccgtccaaaaccaatgagggagtcaaattgcactggtttgaatagttcggggagtcgtcttatttggttttatggttgagggtcacggattagattcgggtcacttttaagggagtcaaagtggacttattccaatgcacgatgcacgaacgactcaagccaccggttggttggaccgagcctcgctgcgaggcgctcgggttggtcccggcacaccgtgcggagtggaggcccgtcaccgtgatgcgccgttcactttccggcctttcccatcgcagagaacgacgggaagtccagaacacgcaacgtgtgcgcgtgggggtgcagaccgtgcagcgcagtggtgggtggtctcgtcgtttccaccaccttccccgcggagaagacgcggtgcacgttcctatcaaaagcgcggtccttcagtactccttcgcatatcgtcgccatgacgttgaccctggaccttgagagtcctgctaaaacaggattgagatcctcaacatttgagtgcaccgtgactttatcactaacatgtgaatccggagatcatcagatccacatgtcaataataaaggcacggcgcagtcgactgcaaaagattatgttccgctaaaacactccccgaggaaaaggagacaggaactggtgtactatgtcgtcattgacaccttgtaattgtttcctgattgtctctcagatttgccgtacagggtatagatgcctgtggctgtgtagttagctcgccttggagtttcgaatataggccttcccaggatgaggagggggagggggaggcctgga

SEQ ID NO: 51788 - DNA, 3884 bp, Oryza sativa
agcatcggcagtggaatctgaattaagggcatagaaagggtagagacaaacacatagagaagggggagatgggtgtgtcactaacatgttagggccaccacctttttttatttttcgtaactaaaatgtcacataggccgccacttaggatgaacccgtcatcgaaaccacttagggacgctaatcgatctggtactctccctatatctggtatcgaggttcatgacagtattcaaactcgacgtgtggacgagatatctaaaatgaacttattccatatgtcgcggacctcccgttcggccgtttggtctgggcctacgaccgtgcggagggaggcacaccaccgcgggggaacgaccggctcgttgaacgcacgaggcacgacacggaagaggagtgggtgggcgcgtcgcgtgggcgtggtggcctcgttgtttctttccgcctccccgcgccccgcggagaagacgcggtgcgcgttcctctcgagcgcggtcccatttgcgtcggacggcgacgttgaccgctggacctggattccggctaaaatactccgcgaggataaatgggaatcggtgctctaaccacattttcctgtgtccttgtctctctgattatttacagaataagtaagatgctcgtatggtttagctttgctttggagtttccaatttatgcattcccgggagtcctgtcctgatctcctggaccctctctagagaaatgcgaagtcattttctatggtagttgcacgtttacgacgacgcggattcgaggacctcatcaggcgaggattgtaaaatcgtgccatcgtgggaccatgttctagttacttgaggccccgtttagagggttcaccttttcctctgtttcggtaaaaatcaaaagttgtttgccacgagaaatagcgttcagccttcaacttatgtgttctctctctctctgaagactttatgtgttctcttcaataatattcaatgttaggcgcgtccgcacatgaggctagagagccggtaaggaatgaattttccgttggtttttccaatttgcacacttctacgaaggcaacacctcgcgatgacacaatgatgacaatggcacaaatattgcctacaagagatgctcaagtaatgctcaagtcactggaaagttgaaggaaacgtttggggctttctcatccggccgtacaagagaccaaaaagaccgaacgtctctcctacgcatgtacgtacgtgcagcagagctgcatggaatgtcttgaaaagttgccccccaagactcggttcgagttttgacccctgaattgccggcgcattgccagtagcgaacgaaataggagagaggagctgcccctgcatgcgcgcgatcatgcatgcacgcatcccctcccgctgctgctccctcctcctcctcctcgcatccgtcaggtcacttcctaaaaaaacacaggaaactacgcaaaaactcccatgattccgaccagccgaacactttccccacaaaaaaaattgcgctgaagttgccgtcagagagtcgccttcacgaacgccattgtgcgagttgacgcgtttcttcgcggaagaaaccaatgcccgcgttggctatatagaaagggtttgggttggcggtggggaggagatcggaggagggggtcgttggattgggacccaattgaaagggaaaggttgaagaggcgcaatggagagctacctgaaggagaatttcggcggggtgaaggcgaagcactcgtcggacgaggcgctggggcgatggcgcaggttggtcggcgtcgtcaagaaccccaagcggcggttccgcttcaccgccaacctcgacaagcgatccgaggccgccgccatgaagcgatccaaccaggtaactgccgccgcattcaacgccgatatatgttatgttcgtgtgttgcatcggcgtcgtaattgccattgccattgccaccgcttttcttggcatacttcggatgtgtaaactatcgtaatatatatatatatatatatataatgaaaatcattacgggctggggctgtcaggccttattagttcatctgtaaattactgagtgtaagctgcaatttttaggccgttcgattagattttactgtttcagatgtgaacctgattctgcattgatcaagaaaaaaatatttttaaaaaagatgatattcaaacgtacctgtttgactgtttaatctttatccagtttgaatgtttcactgttatccattgagctgtttgtgaagtttgtatcttaaaaaaaagatcattttaactgaaaacttaagattttgtttagcacctcccttgaacatggtaaatttaaaattttccataacctctggcaaacaaaatttatagtgagtaacatgttcctctgttacaaacttacaataatacaatccacactatgtttcttctggcaaaatcgcaagtataaagtataaacacgttacacgtctgctgcaagtctgcaacacatatacacatgtaaaaggtgcagcatttgtgcagtactgaagcttccacaacagtttccaggacaaagttctgcatcactttgtaaaatcaagtagtactaacgcgattaattaagtattagctaattttttttccagttaggaacccctcctcccatgcacgcaaaacgatgcttgcattaacgcgtgattaattaagtattagctatttttttctaaaaatggatcaatttgattttttaagcaactttcgtatagaaatgttttacaaaaaaacgcaccgtttagcagtttaaaaagcgtgcacgtggaaaacgaggaagaagtgttgggaaaattgggtgccgaacacattgcagttgagcatggtggccgtgtttagattcaaacttttttcttcaaactttcaacttttccgtcacatcaaatgtttggacacatgcatgaagcattaaatgtggatgaaaaagaaaaccaactgcacagtttacatgtaaatcgcgagatgaatcttttgagtttaattacgccatgatttgataatgtggtgttacaataaacatttactaatgacggattaattaggcttaatagattcgtctcgcagtttacaggcgaaatctgtaatttattttgttattagtctacatttaataattcaaatgtgtgtccatatacttaaaaaaaatttggcacatgtactaaacacagaaactcagcctgtgtcctgcgtcagtgtgcgtgttgacaaaccttcagccagctcgactattcattgtgtgcaatctgctgctaaaactgcacgttctttgagcactggaagattaaacgccagcaaactcatgtttttttcatgaattttcatgcaattgttccactgtaaaattcacgaggcttaccatcaatgcacatttttctgtaccgatttcaggagaagctgcgagttgctgtgctagtgtcaaaggctgcacttcagttcatccaaggtatgaacgatactgataccagttcacaatcacatcccagaatgaaatcaacatttttttctcttttccatggagcccaatcatgacattggcacgatcctgcaggacttgctccggcgagcgagtacacggtccccgacgacgtcaaggcggcgggctacggcatctgcgccgaggagctgagctccatcgtggagagccacgacatcaagaagctcaagtcccatggcggcgtggaggccatcgcggcgaagctgtgcacctcgccggaggacgggctcccgaagtcgaggcgccggcaagccgtccgggaggagctgttcggcatcaacaggttcgccgagacggagtcgcgcagcttctgggtgttcgtctgggaggcgctccaggacatgacgctgatgat

SEQ ID NO: 51789 - DNA, 1740 bp, Oryza sativa
ggcctcttccggcgcaagatcatggacgcctcgtacctgagctggaccggagacgacgcgatggagctgctcgagttcttcgccatcgccgtcaccatcgtcgtcgtggccgtccccgaaggcctcccgctcgccgtgacgctcagcctcgcgttcgccatgaagaagatgatgaacgacaaggcgctcgtccggcacctcgccgcctgcgagaccatgggctcggcgaccaccatctgcagcgacaagaccggcacgctcacgaccaaccacatgaccgtcgtcaaggcctgcatctgcggcaagatcaaagacgtggagagcgcctcggacaccaagagcttgttctccgagctgccggagtccgccatgacgctgctctcgcagtccatcttcaacaacaccggcggcgacgtcgtcttcaacaagagcgggagtcgcgagatacttggcacaccaaccgagacggccatcctcgagttcggcctctcactcggcggcgacttcctggccgtgcgcaaggcgagcaccctcgtcaaggtggagccattcaactcggccaagaagagaatgggagtggtcatccagctccccggaggagcaatgcgtgcacacagcaagggcgcgtcagagatcatcttggcatcttgcagcaagtacctgaatgatcaaggcaacgtcgtgccactcgacgatgcaaccgttgctcacctgaacgccacgatcaacagctttgcaaacgaggcgctccgtaccttgtgccttgcctacgtcgatgtcggtgacgggttctcggcgaatgaccagattcctgaagatggctacacctgcattggcattgtggggatcaaagatccagttcgtcctggtgtgaaggaatcggttgccatctgcaggtcggcagggatcatggtgaggatggtcacaggtgacaacatcaatacagcgaaggcgattgcgcgggaatgcggcattttgactgaaggtggcattgccattgaaggaccggatttcagaaccaagagtgcagaggaactgaatgagttgataccaaaaatacaagtaaagttttcgttgcttttgctggtcagtttaactgaattttctggatttcatttgctgatgtgttctggtttcatgtatcaggtgatggctagatcttcaccacttgacaagcacaccttggtgaagcatctccggaccacttttgatgaagttgttgcggttactggtgatggcacaaatgatgctcctgctcttcatgaagctgatattggacttgcaatgggcattgctggaactgaggtgattttcctcaaagatagttgatagtgttccccttgcatgaacaatataattaatgaattgcatcacttcgatttttttagaagtgtatttttgtggcaatttagccgctaatttagttgtcttgagttgtactaccatccatttcatgccctcatagttctatgcactttttcactcccaaaatttctcactgtgctatctgtttgcaggtggcaaaagaaagtgctgacgtgattattcttgacgacaacttctccactatagtcactgttgctaaatggggtcggtcagtgtacattaatattcagaagtttgtgcagtttcagctgacagtcaatgtggtcgctctgatagtgaacttctcctcagcttgcttgacaggtacagctaaatgttgatgttttttacctcattctactgtatagaattgat

SEQ ID NO: 51790 - DNA, 2269 bp, Oryza sativa
ggtattttgattttctcatcgtgcagcttggcgcacgaagttgagccctgagcctgcttagtcgatcggtctacgtccatcggtccatgacagacaacagtgttgtctggttgactgctcatgcacttggacgccaccaccatcatgtgcaccccgatgctcaaaccagtacgccaccaatcaccatcatttgcttgcaagaaaacgacctctatatccagtcaagaacacgtactctttttcattacaagagtcacaaccgattagcaatcgtatagaagttttgttgtcacttggtcgatcgacaggtgtccacaggatgagaacacacatgacatatagtttatgctttccattaattgctaagcgtgtgagttagtggtgcattagtggagttaagttttttttttttttgagaaagagttaagtattactagttaagtgatggatctagaacagcaaattaaacatgtcttttgacgactgcatttgagcagaaagtgaaatgatagtcaggattccggcaaaacacaggaataattaagagaatatgagttaaagaaaaggagtccgatcggatgattagctaacagataccttcgctctttggacataattcgatatccaaatgttgccgtaaggccagtcacaatgggggtttcactggtgtgtcatgcacatttaataggggtaagactgaataaaaaatgattatttgcatgaaatggggatgagagagaaggaaagagtttcatcctggtgaaactcggcagcgtcgtttccaagtcctcggtaacagagtgaaacccccgttgaggccgattcctttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaatgcaaattgctaactatgttttgtcaggccaatcagtgtgtccacgcatgatattcttcttcttcaacagcaatcgttctcgaaaaaaaaatactacttcccagtgcgaatattcagtgaattttgcccaccatgacttccttttttttgatcaacttgcatgcggaggacacgtaaatttgatttccgtatcaaatctgtttagaccattgtactgtctacagctactctgttgagtaagaagactgaggttgtgtccaaacttcagccctttttcatctcatcaacctgtcatacacatacaatttttcagtcacaccatctctaattttaatcaaaatccaaactttacgctgaactaaacacagcctgaggtattttgtgcagccaagcaatgcattgcaggagtttcaaactctaaactctatttaggttgcgttcgagatgaggggttgggaaacctctttctcggcatgcaaaacaaaatacatattattacatgattaattaagtattaactatttttttaaaaaaataattaatatgtttttttaaaacaacatttatatagaaactttttgcaaagcagtttgaaaagtgtgcgtgcggaaaacgagagaagtgagttaggaaatctgggggaagaacacaatacaaggggtacagctatttagcgcacttgcattcttagcttatagtttttttctaaagactttcatctgcaaaactttcatccaaaaaaactttatctcaaaattttcataaaaaaacattcaacgaagaacttttatatgaaaactttcatatgaaaaaagtgtgcgtttgaaacacatgtgctctaaatagagtttagagtttgaaataactggaattgctaaccagggtggtaacagcttagctgcaaattgtttttatgatcctgcaaactatcaacttagcatatttcaagtctacataaccaaacactttcagcaaaagtacttaccagttaccagctaatcaaatgcgttgggaaaatattgatagacaatatacttattttgaacgcatgtatatcaggcccaaagttaaaaaaaaaggaagataagtagagcatcatgtcttgaaaagctgtgagtcgttacccagttccacagatatattcagtaactcggtcaagaaagaacaacacgctttaaagttctgtttgatgtctt

SEQ ID NO: 51791 - DNA, 835 bp, Oryza sativa
atgcacacgccacatcccggattcccagtatcccaaccgctgtcccgccgccgccagcgacggcctcctaccagacgcaccggggggacggtggcctgcgccaacgagagcacgagggggtgctgcgcgctggtcggctcgcctgttcgcctcgtggtgttcccgtcgctctcaaccggaggcacccaggcagttggtggatgcaggcggctgctgccgcggcgcctgcgtcatccgtacgtgggcatgcaaaacgggggcgccctgacttgacggtggcgggttggtttccgcgacatgtaccatcgccgatgatgtgacgatgcgccaaccgaaacctctcgctctcccacagaaccagggccttccatttacggtacgtgtaatcttctcatctcctcggatttttctttaaaagttttttttgaacatttttttattttaattttaaaaataaacccttccaaattttattttcaaaatctgaaccttaccacgtcagtctatctagcgtggcaaaacaacattgatacgccatctacagcggacgtgacatttttatcatgcgatgcccagaccgatgtgaccaaataacaatcacgccagcgccagcgagatcggtgtaactaaataacaccagtgtaacaatattgttttgccactccagctcagttgatgtggccaaaaagttcgaccgatatggccaaaaagttcggatctaaaataaattttagaatggtttatttttaaaattaaaaaagtttaaaaattaaaaaaaaatctcctcgccctcacgccgccaaccaagtctagactctgcattgcacgtctcaaa

SEQ ID NO: 51792 - DNA, 2516 bp, Oryza sativa
tttctcatcatcattcactggtgataaacagtaagtactagtcttcacatatagtcatttggtaactttggcatgtgagtgtgcatcacattcggtcgctgtacttgttaaaattcaattccaacccatatagatattgatgatacttatctggatcaggacattagcacaaagaggcggaaaggagcatattgtcgatagcattaaatcaaagagggaaatcaatcctgctgtcttcaaatccaatcccactagtagttctagctcaattaagcctaacaacagtgagcctttggggagttttggacctgatgttgagacatatcgtgatgagagaggaaggattagagtaagtagggtcaaagcaatgggaattcgtatgactcgtgatattcaaaggaatttggattttatcaaagagcatgaacaggtcagaaacagggggcatgactctgtagttgaaggattagctaacaatgaagagcctccagattttccagaacatctttttgaaggtaatgggctgcggagttctcttcatctcagcgaagattatgatgaaactgctagcgataaccatcacacatcatcactagtaggatctgacaaaatttctgagggtgattatcatggaagcaaagaaacaatagagatatcctttgctgacgatcaaacagaagtgaaggacaatgatgaccaaattttcttgcatttagcttctggagcttcatccaacttattcactacagaacagactgatggctctgattgcattacaaaagaaggcgtacttgaaagtgaaacacctcctatgcaagttgatgagaaggatcaccaagcatcactgatggacaatttctgtactgatgatgagatagagtgggaagaaggtggttgtgatgttcctggaggtccttccagtaatgaaaacgatcaatctaaagtaccgaaaggagatctagaagaagatgcccttgttcaggaagctataaggagaagtttagaggattttaagaagcaagaacatgaaaatgtgacccctgaagatttacaggcatcttttgaagacaaacctttgcaatcttatgatgatgttcctaagccagctggagctgcaggaaagacagctgataaaattgggaaggaaataaattgtgaagagaatgatatagtgcatggatcacttgtagttgatggacgagaaaacgagaatcagactcaacccgagaatagtgatgggcatgccgatatgaagagagcttatttgttggatcctctccctccatgtaatatgaccgccagtactagtgctgcaaaatcacctgagggctcagaagttcagcaccacaattcaatgttacattcaatcagaactcccgagtggcctaagaacgatagcgataaagttatgacgcaatacagtttgaattctgataattcaaagtgcaaaatagatgattcttgtactggagaaacctcgaggtcactccaaaatgaccttttgatggatgaactggttcctgacactgctgtacaaaaagaaaatatgatccagagaactacggacttatccacatctgagataaactatacgaaactgaacgataatgttggtatatatagtgtgtcagctagtaatctagaaaaggaattatctcttctgagacaggaacaagaatatctcggaaatgaaaggcggaagcttgaaagccacgcagagtctgtcagcagtgagatgtttgctgaatgccaggtttgaatacaatcaccttttccctttgagttgaggcaaggtttacctcagaattgagatttagtggaagtttgaagtaaatggttttagcagtacaaaatgttaacatatgtatgtcttgtattatacaggaattgcttcaaatgtttggcttgccatatataattgcacctatggaagctgaagctcagtgtgcatacatggaaatgactaaccttgtcgatggagttgttactgatgattcagatgttttcctgtttggtgcaaggaatgtttataagaacatatttgacgataggaaatatgttgaaacatacttaatgaaggtcaattttctttctgctttcaattttactctcatttttatttcattgccagctgaagcaatgggaagtccatgtccttgctggaccttccacagctaatattgtaatacattttcaggacattgagtctgagcttggtctaacaagagaacaattaatacgtatggcaatgcttcttgggagtgactacactgaaggaattaggtgatatgctaacaagaatatgtatcctgtaactttttttgcagtttgtataaaaataagatcagaacttcatttttcttgttgagttgcatttttcgttgaaaggaaatatgaactgaaaaacttgctgttccagagatcaagtgcatgctctgttttgttggacaaatttgttatgtatacagtcattaagaatacagagcattgtactttaattatgccatctcaatttc

SEQ ID NO: 51793 - DNA, 8431 bp, Oryza sativa
  unsure (1)..(8431): unsure at all n locations
gaaagtggtagcagctcaaagaaaaaaaagtctggcagaaatcattcagacggaaagggaaacagccttgagcctgaatacgctaaaggttctgatgacagccaatcttctaatgagacccaacgcatcaaggaaatatttatgagtaagcatgtaagtatgttgtctttatagactgaattgtcaattgctgtaattgcatggtgattatagatactgctttactaatatttcttttgcacttgttatcatttatttatcagaggaatgtgagcaagaactggcatattccttctacttttcctagtgaagcagtcataaacgcatatatttccccacaagttgatgattcaacagaaccattttcctggggaagaccagattcaggcttactgcgcaagtaagctttcttgaataaccttatgttctcatggatgcgagcaaacaataaaagataccgttcatttcatttccctgcacttttttgtattgaatcagtttttaagagcagcaatgtttttcttgctggaaagtggtggacaatgtagtccaacatattggcagtggcattaaccgctcaaaaacctaaaatatatccgatatgccagcaccagcttgtttctggtaggtgttcagactggtaccgtggagcgcaaaaccctagacaagttttaccagaaagcagagtgttctgttacttttagctgcctgatatgttataatcaatttgtttttatgatgtggaatgtgctttttagctccttatcattaccttgacaatttgttctgatctttttcttcacaagttagttctgtttcaaaactaaggattatgattatgaaaaaacacacatgctctatttcttttctttggcgcaacaacagaagatctaatgttgagttccttcaggttatgttgggaaaggtttgggtggagcaaggaaaaggctgatgaactgctaattcctgttttgagagagtataataagcacgaggttagtctctggaagactgtaactattatttatcctattatagaatggtttgatgtgataatatgtttatggataccattgaattctgttccctaaaaaaatgagttactagtaagttagttttacggtttgagaacatcaattgttaagatgtcagcatttcacctctattttacattttttttggatcggctggtgctggtttgccatgttctgcaacatttgcattttaggcatctgtaaaaagcaagtttttgacaattcgtttcattgtctttaagttattttcatttaggaaatcgctgccttttgaaaatagaataggcatgcttttctgcttggatttcatttaactaagagtgatttaaccggaatgtcagcaatccaaagtctgcaaaattgggttatttaaattttacagtttcatgtgtcacacacatgcagactcaactacgcatggaggcgttttactcattcaatgagagatttgcaaaaattcgtagcaaaaggattaagaaagctatcaagggtattacagggaaaagctttctagagacagatgaacttgatcatgatagtcccagtactagtaataccagcaagaagaaagagagaacctcctctggtcgtggtagggctaaagggcaaagaaccaaagatgttgggcctggtaacacaggaaatcaggactatgacattgctgatagcttagtagatgcaggtgaacatactacagaaaaaagcacgtccagtaagaaaagaactgcaaactcctctggtggttcaagaggcaaaggaagaagaagcatgaatgctgcacatgtgataattggaaatggggaagattctgatgtctctaatttagcatctgatgaggattcccatattagacataccaacgactatgaatcagagggattgacattacgcagggtaagtactccttatggttttctgcacttcttattgtatggttctttctcatgttctctttgatgctgttattgaaggtctccgtactgtaatattgcccactaatttgatgtgatctaaacctttctggcctagaaaattagcttccatttattgctagctgtttagcatatgcttgtagtcctcaaaatatcacacatgcttgtctttgagaatcaattcttttttgaagtaaagaatcagaattgtttatgcatttcttctgatctgcacatgaagagcagtaatatttgcactggagagtaacattattatttttttcatgctgatgttgtttctgcagtcaaataggaagcgtaagcaggtcacatacgcggaagatggtcaggaagctgatgataatgatgtttccatacatcaaatcgatgaaaatcagggccaaggttctttggaggaggacatgtgtcacatggctggacttgacacacaatctaatctgctccatcaggatacgagtgaattaaacatcgatcaaacgcatacagatccctctgatatgaacgaagatccttcgggctttgagttacccgaggattgccatacggacactgcaccaaaagactatctcttcaccggtggtggattctgcatggaagagggtgacgagcaacataccggagtggatcaatctggtgcagaaatggactatgaaacacgtgatgcctgtgaaggtattgacgaggtttcttgaaagtcaaagcggtaaaagcatgagctattcggcgactggagagggcacagagaatgcaaatacagaggcccgaggggcgtcttcatcgcagggacgcaatgcaagccgtggttcaggtgccgtgccgaagcttacaaagcgtaggagaaaatcatgactcatttgcagcagatcatgcctcgcacatcatgccgttttgttcaactgggcaaggtcacgtttcgatttgttcggcagccaatgagttgcgggcttgcggcgttgtcgtctgtaggccaagtctgaagactgaacaaaatgcaggtcggcattctgcacaccgttttcaggctttttcaggtttctgtccattgtttttctaggacagttatcgtatatcggtgtaaactgattgaagtgaacatttaaacctgacgtgattccttgcatcaggatgtatgtgtaacgcaggcttaccaacaaaagcaatgcacccgatgaaaatactgataaaattgaaatacacccaaaaaaactgacaattgttctctatctgaatatgtttattttttcatcaataagttcgattatacagtaatactatttgtttgtttttttaataaatgatgttgttgacttttaaaataacgtatggccgttcatcctattaaaaaattagtgcaaacatgctaagtataactcacatttaaagttttttaatgatacaataagtcaaaataaaataaataactttgatataaattgtttgaataaaactaatggtgaaacattatactattaaaaattaacggtatcatctattattaaaaaaaacggagcgagtacgtcagaataaaaattaaagtgcactactgtcgcgtggatcccgggcccggcccactggcccagtcaactaatcctcccgctccgctgccttcgcgggccgtccccttccactccgacgagctcccgtaaaccaactcgacggtcgccaccgtcgccgttgccgtcgtgtctcaggccctcgagggttcgtcagtctagtactgtgtgagcggtgaggtggcggcggctggtggatctcacgggagcctgaggtatggtgcttggcgctcgcctcctcctgggcctcgccctcctcgccgcgctgctcgccgtcgtcctccagctctaccgcctcaggaagccggtgcgttctctacttctacttctcccgaaattttccactggcttacctgtgagtttgaggttagatattgcgtgttttttgttatctaatgtgtggaagctgcctttgtgcttgcaactgatccggaattctggatccgaaatcgcccgcaaaatcagctggttgctagttgctattagtactagatgttcccagttgcaacttcgcagatttctggtgaaattaatgatatgccccgtaaggctgtaactgtatggtgtatgctggactttactgctgctacatatttagatttactactaccttcgtcccaaaatataataattttttactatgaatctggacacacagttatccagattcatagctaaaaatgcttatattttaggacggaaggagtatctgttttaggcttttggctatgttccttttgatattgtgaatagtaaaatttgatcgtatagtgagcactattttctcttcttcctgtgttatactcggcagaggttgtggaccaaggaagagttagcagtgtacaatggaacggacgagagcttgcccatactacttgggattttggggtattcacacttatctcacgtatgcctgcaattctattaacacaaattatactagtattgtagtggcttcaagtggcaatccatgatgcgaagtttgtcctctgttgtttgtggattgtaatacctatatccatatcatagaaacttattgtgttcagttgtaaatgcaaattcttataagcccgttcgctgtttttaagttttgttatgcattatggattcacttagttgttctctgttgtattttccattccactgcatggactatttacaaacttatttttcccttttgtttgataatgcagctcggtgtttgatgtcacaaaagggaagtcgaattatggtcctggaggtggttatcatcacttcgctggcaggttattatctttcaaggcctttggaattctcacaaggagcaatgcaatagcaatgctttaggataattctcaaaaggagttaacatttactagcagtattaagccttgttaggataattccagagaacttatctcatcttgctgatactaaaacagcatttccataacagggatgcatcacgtgcatttgtttctgggaattttacaggtaaatctgctatcttattgcttttggcttgcatagtaataggtttacatagttgatgttcatttacattacccacaagccacactctatatcattatgatatccactgtttattgcacagtattaggaataaattacactggctgtgttgatcattttagctaaatttaggacacctagatctttatcgaattataaatgtttactgcagacatcataaaacattgcttcctagcaaagcatcaacaacatacatctacatatgaaaacagaagtaggtagcacatgggtattgggtacatttaagattgatttgtgtcgaagctgtaaatggggcttggatacataaaatgcagttggtcaggtgcgatgaagagtaggatacataactttgactggtttattttcattgttgaagttcttggaagctcgccaaatttcaatttctgccagaaattgatgtaataggatctgcatccacatctttcccttcaagtatgttcataattttattgagggtagtcgagatgtgaagtcgtcatggctatagaagttcatatggacttacattagaatatcctcttttttctaattcaacaggtgatggtttgacagattctttacagggcttatctagcatggaggtacgacaagagaacacagttctcatagtttatttatatttataagtcttgtagaatctataagaaaaattgtaaagtttacagctagatggtcaagaataaattgttgagagaagaccatacataaaaggcgcaagcataggaatattgtgaatttcaattagtttggtctcttgctcctcgtaccagctaccaacatttttataatttggaagttcatatagtaactaaatcttcatcttatgtagtcatgtcactagtgtgcctagcttgcatcacgatctgtagaaaatgtttacattgatatagtgatcagcataacactgtaaacagttgaagaggtcattagcatattgatctcatgtatatttaaataactaatggaaaccttaaacttactacctccatcccataatataagtgggacggtgggagtagtaaactgaagataacacatcttgtagttatgagccacttctgcagcttatatttgaacatatgttggaggttgctctgttatgagccacttctgtagcttaaaagcccaatctttttttttcctgtttccttgttgctgaatttttcataatcagtattatgcctgtgtgttctctaaaaaaggtattattggttttgtaacttcctttcaggtaaacagcattgttgactggagaaaattttacttcgagagatacatgtgagctgctttttcttcattgatttgtcaagttacttccatttcatttgattacttgtcaatatgaggacttcatgtaggacatcttcatgctcttgaatcttgatgttatttctcctgatgtgatctctctatcctgatgaatgctttaaatttcccgtgtttttaaatcatgtttatgtggtattcttcatgttagagcgcaaggtcctatatgctatgtgaaactcgctaaagttatcatgcaaattgtggatcgtgtaaaagaaaaccttgctagatgatgtgtcttaccataatatttctgtgaacctgtaatgcagattcgctggtaaaatcgttggacgctactacgacgatgaaggcaaccctacaaaatatctcaagggtatagagatgaaggcaaagagaggtgctcagcttcttgagaaacagaagagtgaagaagctaaaatacccaactgtaattcgaaatggagccagcaagagggtggtgaagtaagtaccctcatatcgattttcaactgctgctgttttcagtttgattttttattagaacatctcatgaaaaaattaataatgaaattaaacctcgcattaccaattgtcagattcacacatgaaaattgaactgaattgtgattttccctaatttgacacacaaaaatcatgtaagttgcactgttggccattgggagtatgctcacagttctccatacagccattcgcccattggcagggcagtagtgcactgttttgtactaggatttatcattcttctagtgcactagtcttctcaagcccatttttggactggttactaatgggtctttgcaatctcgatgagcattagcaaggattatgctctatccccagaattcaaccctgctaattactgatgttcaacaaagctggcaagtggcaacaaaataaatcatggagaaatgtgttgtagccagaagaaaagcaaatgaagcaacgctattagggcctgtttagttcacgaaaagaaaatttttaggtgtcacatcggatgtttgactggatgtcggaaggggttttcggatacgaatgaaaaaactaatttcataatcgcctggaaaccgcgagacgaatcttttgagcctaattaatccatcattagcacatgtgggttattgtagcatttatggctaatcatggantaattaggcntaaaagattcgtctcgcgatttcctccctaactgtgcaattaatttttgtttttatctatatttaatgcttcatacatgtgtgcaaagattcgatatgatgttttttggaaattttcgcgaattaaacagggccttaatgaaagtccggaatggagtaactattttctcttgagcaaagcaataatgtagcactaacttgatgcgacttgttgagattgctcgaaaaccagagcctttggggtgctgttttctgatctttcccctgcacttttgtccttgcctacctactgtaggaatcatatctttgatgggtgcttggcagtggtattccagcctctgagatagcatcatagcagtatatactctctatacctaaggactacggctttcctgggggtgtgctatgcccgtaaggccttaaatttgttgatgcttgacatccatagatcgagttgaactaatatttgtctattttgttagtacttcttaaaaaaaaagagagtatattttatggttactcctcgttctagagactgaagtctgaactctagacaaagcattttggcttaacaaatttgcctaatgtgaaaccttctttaaaactctgctatgtgttaggtttggtgcgaaacaggctatccaagattagtcagaagaccaggtgacatagctctgacggggcaagttagccagcggtgtgcctgttacaaggaggaggagttggacaaggctggcctggttgtgtacgaagggtgtgattatttgtctacatcttgcaaagtgagttaggatatgtacatctccttctcttgcccatgtagttgtctacggctgcccactgcttatctgcaaggctgctaatggtaatcatacacgaaaagc

SEQ ID NO: 51794 - DNA, 4285 bp, Oryza sativa
tattaaagtctgaagaagtatcccacgacagatccagatttggctcacgtgagcaagaaatcaactaaccacaatgcccgcaagtcctaccgaattctcatcttgaacgatcgtgttgaatcaaatacgggatttataattgatcatgttgagtagaactacatcttttgttttgcatctccttacttatttcccaagcaagtctttggtagggctccaatttctaaatttgaagcattctgaacccaactctatctctttagtatatttcgttcagttcgcttcactctcttttcgaatgaaattgaaactgtttggctagcatttttaactccagaaaagtttagagttgaagttaaagctacgcccaacaaacccactccctccgtcctataatataagggattttgagtttttttttcattgtttaaccactcgtcttattcaaaaaatttagaattattatttaattttgtgacttactttattatctaaagtattttaagcacaactttttgttttttatatttacataaattttttaaataagacgagtgatcaaacaatataaacaaaaactcaaaatccattatattttggaacggagggagtagaatttagagtcctggcgcacaagcctttcttcttccattaccaccaagcacctctccctctctctcgttattgcaggtggtggcaaccagtactaccaactcgcctaccgaaattattcggctgggtgtgcatcaacccatcgtcccatccgcgcttttctccgagcgaagcacgcatgatgcgtcacgccaccatgggcagaacccgcggaagcgaagcgtagctagcatatggcagcgcgcctcctctgctccgcgatcatctcacccgccaccgctttcctccgtttcctcagatcacacacaccacgtcgcaggcccctgtttttttgtgtgcgcgcaagggccatgatgcccgatgccgatgcctcgcttgccgccgcgaaaggcgcgacgcgatgtgatgtgatgatccctcgcgtcgcgtccatccagcgtccacagggagagctgagaactcccatcccgacgctcctctggtcggtacggcccccgccccccggctctgctctcgccgagacagcaaatcagagcaatttggcattgggctgtgcctgtcacactgccacgactgggctgcatctgcttgtgtgtgtctgtggtgtgcatgattctcccgtgcaagaaaacatatggatccactcagggttgttgccaaactttcaatgcgcactagaagtactcccccggtcgtcagattcggatacctgagcatgatgcgattcggatccacccagtggaaagagaaagaaaaggcaaggcgccgtgttggcattattcgtcctctgcgatccggctcccgtcgaaaaatcaaccaaactctcgatggtaaggaggaaaagtagtttctgaggcttccgaactctggtgttgatgacggttggcgccaaagttttgatcgggcaaccgaaagttttgatatatgaacacggatcatctgcagtattgcatctacaatagaagtggttgatagtatcgcaaacaatctccactaatgatatacctagaaccaataaaaaaccattattgacgagttatgccttgtctcggtatttgtagagtatggagatcgttagtatcaggacatacgcgagattacggtaaaaatagatgggtgacaaggatttttatacaagtttggacaccccccctaactagcaggtaatagttgtactcctattggccaaagccaattgcagcaaaagagacttcactatttgtctaactatttgaatctatttgtatcgaactatcatccgatccaattgtacaacaagcttacaactaatcgtccacagccccatcaacatcaacgatcaaaagcgttcatgctaagtactagcatcggatcctcccgttgattctgtaccaaaccatcgactatcggctatcggctaacacatgcttttgacacactcgagactcgagcttgcaattgtcatcaacgttcgtgtctccaactctccaacagccgattgttccaccgtgtcagctagtcgttgctacatcgacatattgtcagttacagaatcaaactgactggcacgcctgcacctcatcaagatctataatccagcactaaatcttagtcgatctccggggcctcaatgctggcatgattgacacacatctagtacgtcaagcggaaaattttgcgtcaacgcattgaagtaacaaaaaccattgagaaaataggtgaaatgcgcaagggcataaatgatattatttttctttagttagcaccgctatatatgttatcttcacggaataaggttacatctaatcttacctgaccttagtttatttggtgtaaaagttgattattttggaacatgtgagatgtttcttgatctaagagcaggtacagtagcatgttataagtcagctataaacatattttaaagtgataaagaaagagagagaatagcagcggtttacagatttgtagtcagctgtagtacggactccacgacgtaatgtgtgtatgataggtaggaccagatattaatagtatagtaagtaactattgtatgaattggctattatattagctatacataatatgaagctagtagttggccgtactattaaacttgctctgatgttttgatgttccttatcaaactcacaagtgccaaaatttgatgacatgtccaaagaagagccaggatcttgtcaaacacgcatgattgacaccacggagatccagcacgtccgggctaacgtcggtctccagcacgtactagtagtagtcctccactagcttcgcagcagcagcgacgacgtcatgggcacgccctggacggcaaccaacaggagaggagcctccgcgcggtggaccgccacgaaaacacaccgtaattcctcctcacctcctctgcatgcgtgcgagtggacggacggacggagagctcgtttcacccgcctacggctacgtacgggaaaagggggagggaaaaagcagtggtggaatatgtgtgtgcggcctggtgaaaatgccctgccttcgtgaagcgcaacatcatcataggttgtcgcgggcagagcgagcaagggcacgcatcaaaagactggcacccgagggctatcatgaggttaccgcccacgcgctcacgctacgcagtaaatccccaccctagctacggacgtaacggacccccccactgccatcatccgccgtccatccctctctacgacggctaccactgtaccaggctaccacgagcactggcacggtagacggtagaagtagtagtagccgtgtaggaagcgctagctgttgaacctgaaaccccggccaatttcgtgtgttacccaaagaaaatgttacttcctacctctcaaaagatcaatacaataacaagactataaaccagctctaaacatattttaaaaagataaaaaaaaaagagaaaagtagcgggccatagatctgtagccagctgcaacacggactccaaaacataacgtgtgtgtgataggtgagaccagatattaataatatagtaagtaactattatatgaattggctattactcctacattggctctagatgatttggagttaatagttggctatactattagacttgctcttatgtagcaatttaggatgtgttcagaacccagggtccctaacccctttctatcgtattctgcacgcacgcttttcaaacggctaaatagttcattttttgcaaaaaaaaattatatacgaaagttgcttaaaaaatcatattgatccattttttaaaaaaaattttagctaatacttaattaatcgcgcgctaatagaccgctccgttttccgcgcacactgtttcggatgggaacgaggtggtgcgaacacagccttagaatgggatgagacccaacctaaaactatgaatctggatttttatgtctcatgtttaaattcgtagtcggttgctacattatgggacgaagggagtagcgtgttagacagagcgtgacatgatccaatgtaatactctctccgtcccataaaaatccaacttattatcagatgcgacatataaccaagatatgtcacatctggttctaatttgttttttacaggacaaagagagtaatgtattacagcgctcttctgttccataaaaaagttaacagtaggtattgaatgtgacacatatgcagattcattatta

SEQ ID NO: 51795 - DNA, 1574 bp, Oryza sativa
tgcgatcgatctgggaccagaggaccagcttacgtgtgtaagcttgtactgctacgtacttactaccgttttctaataacacagcttccttttccccacttgttcaattatgtgtgtcaaatctcttcatccaaaataacttaacctcaaatcctaccataggttatatggagagagtagaaagtaggagtctggagcgtcccggtcaaatcgggtccccgtgcaaaatattaaaataggccctagtagcctagtaaattttttatagtaaaattaaaaatgggcgtgacgattaaccgatcatcagcgatgaagcagaagcggaggccggagagaactggggagaggagacgaagcggctgcggcatcaggacttcggcgatacgagacgacgcagactcttggacgagagtacgatggaagatggatcgattcaccttatgcagcgttttgggccttgtgtttgctactatttggactgcaaattaataaaattaaagcctctaatattattatatatagggcatacttaatattttaggggtccttaaaatttgggggccctattcggtcgcacggcccgcacgggccccctggacgcccctgtaggagtatatgtctaagcctatcccaaattatcatattgagctcaacactaagagcatgtttggaggggtttctggcaactgtaacttctcctacaatcagaaacttcccaaacagttcaactttttgtttaatttttgagaaactgtagctgtagattcataaaatgaactagaagctaaaaacacagctttttttaattctcagaatctactccatccttctaaaaatcttagacctatttcattatttggtttttcaaaaaatctaagtcttatttgtagttactatgtgctaaattaaattgttgatcaaaaatcaagaagtcattcgtacttattggttgcatgtccattatttttgccacatgatgtatgagttaattgctttttggtattgatgaaaaagaaataggtctaagatttatataaggagggagtacttcctttgtcccacaaaaaacaaatgaatgtgacatattaagactgtccagattcattatactagaatttgttacatccagttttaaatttgttttctatatgaccaagggagtaactacctagctgctgcttatcttaatcttgagcttcctcaaacagccagcctcttaacttgagttcattttgatagttcagctagaggagttggcggctttaaaaaaaaaacaaatcattagcacataattaattagattagatattgacaattataacattacgaatatatttcacttttcttacaaaactatataaactatcttttaatttataaagcataccgtttagctgttaggaaaatatgctaatagaaaacgagaaaattaccgtgacttcctctttccaactcagccttaggcccaagaccggtccaattcgagcagaaccgaccgggttcaggccgggtttccgtcagttacccggcccaagcccgaagaggacgaggacgagcgcacgcacgcacggaca

SEQ ID NO: 51796 - DNA, 4507 bp, Oryza sativa
caacagcagcagcagaggcaggctggaccgcggcgagagagctttctattcccctctcgaaatcgcagcgaaagacgacgtcgtcctcgtcccacccgcgcccgcataaacgctacagtggtggtggcaccctgcaccgcccaacgaacgccaaaagcaggctgctcatttcaaaggcggaggaggaggaggagaggagacaggaaagccttccatccaaccatcgctgcccccttgccccttcttggcctcttgcggtgagcctctagcttactcctcctcccaatctctctctctctctctctctctctctctctctctatctctctctctatatctctttcttgttctagcctggtcgactcgtcctacctcactgcagcaacactactggcattgcgagggtggcgtggtgagctttgtgtgggcactcgaggaggcacgctggcccggcttcctgactcctgggtgctgcggccattggaggaggacggagtacaccaccctgcaaggccactgaggttaattgccacaccgtcttttctcacaagcatgcacgcttgacaaagctgaagtgagcgataaagagagagagagacatgcacatgtgcaagcacacggcggatggatggatggatgcgcacacttgcgtggctgcatccgggaggaggaggaggctggaggcgccactcgtcttcctgaccagttcttgggttgagattgaggaggaagagtagaggagaggggtgggtctcactgttcctctttccccggtcatggctgatgctgccctttagctttgcctttgttcgtgtgcgccttgttgcgtaccctgttttgttgccttccccgtgttagctataaaatctcgatgcctcctcctcccacatgcctcctctccctcatggctgtcacattgtggccgcgcttgctgtgtgctcttcgtttttaattctccccctctttcttttcttttcttttttaaatttctctagatcatcacatctcaccgtatatactttctattacgcatcctctcgtgtcatcgcgatctcaggctccggcacaaaaactgtgagatcttggcacattggtagtaaaagattccccacacaagcacgcacgcacggagccagagcttgagagagagcaagtggccgttcttggtctctccattgcctcccacaccttgcattataaaagatgctcggtgtctcctgctccaatgcgtgataaagaaaaaaatatatactgacccttgtgttttgccgttgttgttgctgcagagatttgtagtagagagatcacctgcttggggaacagtgttggtggagaggaatgtggactcgttgtttatgagagagcggtgctgcattggacacaagatcttgcgtgattcttggttaattaaaacaaagttgggcgaggtggaagaagggaattatactaatcgcctctcagatcagcaaggacaggcagcaattaacaggtagcagcaggaggaggtggggttgtgtcagctttgtgctttgtgggtgttgtccctcctggctccttgcctccctctctctctctctctctctcttcatataggagtagtttacttccattgaggtgcttgtgctcctcaccattcttgcctcattgcctacgatagcagcagcatcagcccgcataagtaggttcaacttggagtgtgcttgaagcagcagtttgagtgctgtgctgctgttgctgttactggcttgctgctagccgcatcagggcctgctactatctcgtagtctgttcttgttttccgttgtacgaacgatctcccgggcacgttgcaatattcggtcgccgtctcagccgcagccaccagcagggtgcagcaagttgttctgctccttgtacttgtttgctcctgggtactagttgctgttcatcttgtgtagataaatatgggtagtagtggagttgttgcattggttgcagcgttgttgttgtgttagtggtggtggtggtggtttgtgtgtttgggcgtcgatcaggagagataagatttaagatcagcgcgtgtgcgtctgttctttgcctgtttcaagatgaaattcatgaagcttggatcgaacccggatacttttcaggatgatggcaatgaagtcaggtgattgttcgtcttgtcttgttcagttcctttgccttgttcttgtacatgatcttaacttgtcaactgttctcttttttggggggtttacctggtagtagttttcatcagttcttactcttctctgagtgtactactgttgaacgtctgaatatgtccaagaaatgtgtaatacatcctgtttggtatgatcttgaataacttacaaaatgcagatgttaaataacagagaaatattctcctgtttggtttagtactgtaattatagaaactatatttctcgatcccattatataggcccatttattccaaatagcctagatgctagatgcacaaaatctactgttcatttaggcacaggctgcttgttcttttctcgtttcctgacttatcacttacgagaactgttccatctttgcagcattgtggcaactgaattagtgagcgatgtcactgttcgcatagggactacaaagttttaccttcacaaggtaaaaatgtccttcctttccattcatgcagcttttttttttcagagaaatgccttcataaaacttattgcaatagtaatttcttgtggttcagaagataatggcctcatgtaaggtttgatatttgcttgctggcatattctcttctctaaatgctaaaccacttataactagagcaaatgcttccattttttcttcttttgtggtttatctgtttattgaaaccttaagtaatattttaactttatgctacttttttttccttgttctttcaatgtttaatatatacttttctgagcgatgtcactgttataagtttatgctactttaactttatgcttccattttccacccgtgcagttcccacttctgtccaagtgcgctcgctttcagaagatgatcccaactactggtgatgaaaacattgagattcacatccatgatattcctggtggcgccaaggcttttgagatctgtgccaagttttgttatggtatgattgtcacgctcaatgcctacaatgtcattgcagcccgctgcgccgcagagtacttggagatgcatgaaactgtcgacaagggtaatctcatctacaagattgaggtcttcctcagctcaagcattttccggagttggaaggactctatcattgttcttggtactacaaaggctcacttgccttggtcagaggatcttaagctggttagccactgcatcgactccattgcttcgaaagcctccactgacacctccaaggttgagtggtcatattcatacaatcgcaagaagctcccaactgagaatggccttgatttggaatggaatggagtcaagaagcagcagtttgtgccgcatgattggtgggtcgaggatctcgcagatctcgacattgattcatacaagcaagtcataacagcaatcaagaccaagggtatggtgcccaaggatgtgattggggaggcaatcaaggcttacacatacaagaagctcccttccttaagtaaggtttcaatggtccatggcgacgcaaaagttcgggccatgctagttaccatcacatgcttgttgccatcagagaaaggatcagtttcatgcagcttcctcttaaagctactgaaagcaacaaatttgctaaaatgtggagagctctgcaggaaagagcttatgaagcgtattggacggcaactagatgaagcgtccgtgtcggatcttctgattcctacagtggatggggagaccacagtttatgacattgacatgatactcagtatagtggaagaatttgtcaggcaagacagtaagaatgctcagaaacataatggtggtgaagtggacagtcatgtccaagcacctagtgcatccatgatcaaagtgtaaaagtggttgatgggtatcttgctgaggttgcaaaagatccaaatacacccattttgaagttcattcatctagccgagacaatgtcgataaattcaaggccagttcatgatgggctataccgcgccatcgacatgtatctgaaggtactcttgcaaatttcaacttccaatcaaaaatgcactactcataggacatgttcacaagcacactgaatatctagcacatagtcctaatgcatttcagctcgtgacatttttgcttcaactcacgaatttattcatatgcattgctcatataaattcttctgtatttacggttgtacaaaatttgtttttaagtataacatctgtttatttttcttaaatgagcaggagcacccaagcttgggaaagaatgagaagaagaagctgtgcagcctcatggactgcaagaaactctcaccggacgcgtgtgctcacgcggtgcagaacgagcggctgccactgaggac

SEQ ID NO: 51797 - DNA, 1070 bp, Oryza sativa
gctcaccggaggacgacgacggtgccaaccggcaaagggcagtccggtgagcgcagcagctcggactcgtcggacagtgcgatcttgcagaagctggagcttcccaagaggaccccctccaggagcacgaagccggctgctgtgtagcgttagcttcctgcatgaattctcagtggattcgtaaggatcgttaggttcttagctgctgcttcttttctttctttcttcatgaatgttgcatagaagcaagaactaatggtttacacgtctgttggtagggatgttataatgtgaggtctgcttttaggtgatcttgttagtagcattgtaggcttgccatgaaacctatgaaaatgttggttgctactttgaggttttatgccatactcagaagttagtagctgttatgaaaaaagtttagaactttgttagaacttggaagcataattcatctgctgctagcctgtttatactggtatagtggtatgatctcagttcagatcgtgcaaagtcttgtgtaatttgtaattagacaatgctgtcctgagccaagaataacagagctgcggaccaaatagggatatcttgttgaaaggtagccagtgatgttcagtgttgtcgcaactgggctcaataggcattttgcagccattgttacctgagcgacttgggcctttttagtatttggattatacctctaaaaaagaagtatttggattgtagtatagtacgtcatactagtatcagctatgtcaagcgcatatcgttgtagagagttaaaattagtgctccttcgttaaaaaaaaaagaaacagtactctgaatatgtacacacttttgtaagaagcataatgtataatcctgtgaacgcatatgcaggaaaggaactatttttaaagtgtgtcttattgaacatagacaattacatcaagatgatagtataactatacagagaatatttttagcctatgtattgcaggaaatcagctaatgttttttatacttatcaaggaatctcacgcacgacaaactgctcaagaaaagacctgaagtcgatgatcatcctgatc

SEQ ID NO: 51798 - DNA, 2164 bp, Oryza sativa
ctcacatgctccccaagatgagcaattcatcagaacctcggcagctggtgagaggaagctgaagagtgaagaagagtctttcttttggcctgttccacgtgtcctagtggagtgtactactactggagtagtgatttgcattgcatgatgcacaattcagagagagctaaagaaggcagcgttacagctgctttcatgcgagagagacaaaccaacagtggcagtcacctccaagaaggcaaagaacagcaaagccattgctgagaaatagcaaggcagggtgatttgatgacacggcacaaaggcaacatcagaaaggcaccgagcaaacgcatttcttcctttcgtcccacagatatcaataaacaattcccaaccactcatggtcagcaattgcacacgagacacgagagagtagagtgaagtacagtgagagagatggcccctgccccctggctatccaactactatcaatcagttcttgcaacaaaaatgtactaccactgtttggctttagcatcaggaaattgctaatgaaccaaaatggcatgactcaacagagagtaacagataaccatacagtatccacaaaaaatgacttctactcaatacttgggaattgggattccctctctctgtctccacatctcagtgaggacttcctccctactttgagcaagagctctttatcagttttcaggccttttcctctgctctttacactagtacctttctgggccagggaaagatctccacaaaaccagaatctttccattgctaactaatcaatcaactgtaacaattgcataatcagaagaagaatcaaatgttggcccctccatttggccaaccccccctgaacttgcaagagcactgactagggctcagctgaaacaaaagaaaaagggtgaaaatgatcaactaaaaattgcagagctggactccaaccaacatgctgtccagctccagcctccagctcctccctctactggcgctgaggcgagtgcaaccttttcctcttcttgtccggggttgcctccaaggtggtggcattattggcccctcccatggcgctgtcctccgatcccccaatgtgggcaacagagacacccgaggaagctacctccgtcgtcgattgcatcgacctgtcctcttgaatcatcatcttgttgtagcaggaatacacatgcccctgcaagagaacaacagcgttgcagaatttactctcgacattgtcatttctaccaagaacttaaacctaatgggatgagatctcgcaaaagagaaagttgggagtgcttacggtgtctagttgctgccataacgagcccacgaccgacttgagctcgtctagattaggcgccgtctccttgttccgagcgatgaggattgctgctagagcgatcgttgatggctggtaccccaccgagctaatgactacgagatcgcggatatgaaatgagattcttgcgatccgattcggtgaaatgaatgcagagggggggaatgatcgacctttgatcgaggcgaagatgcattcgatggcgcgcaggacgatcgccttccgctcgtcgtgccggaatttcgcggtgaagcagttcaggtaggagaagggtgtctcggtgatcatctgccacttgagcgtggtgaggacgaggagctccatccgcatcaaggacgcgcagtcgtacatgtccagcttgaactccggcagccgcggcggccggcgctcctccaccttcgccgccagcgacaggcacgccaccgagaggagctgcagcgcccactcctgtccctctaaaacacccccacacacaaacacaaaaaaaatggcaatacggagtcaggcattacgtcgaacacgcactcggcatcacgacaacaagagtgaggcggcgcatcaaggcaagcagggaggatcgtcattacatcgacacaccggcgcgccaagaaccgatcgagatacgtcaccgcgacatacgccgtcttcaagctgaaccggaatcccgcgttcgtctgcaaccagcaaagcgaggaggaagccccccccccccccctccgaaaacaagagtcaatacaaagatccgatctccgcgaaaccgtgtggagagtaatctcaggtcaagggggcgacaaagagaggaggagacgcgaaacgacctta

SEQ ID NO: 51799 - DNA, 1255 bp, Oryza sativa
tggtccggatgattcacggggtcacaggtggcgcgcgcgcgcctagccgagaggcgcaccgcgcacgcacgccggagctagtcggtcaccacgccgccaaccgcggtgttcgcgagggaagaagtacgtgtacgtgcgcgacatgacgcgacgcgacgcgcgcgggctcgagccaaagccaaagctttctcttgtcgcgcgcggcgcggggagcgattccgaagaataatgctcggagcttagcatatgcgcgcggcgttttctggtacgtggtaggataggaggctcgtgcgatgccgccagaggccagagatggctgctgattgattcgcgagcttggctgtgtgatgagttgtgtgagcttgtgctagtcgacgcgccaacagggtcgtgatgatctgggtctttggcggttggggactttgtggcaattggcaggcggacagagttggatttggacgatcaatgtcgtctcgtcgctgcttggttcaacaggtactacacgatttggacctaatcgatctgaacaatgccgctgctggcttctcgcttgctgtcaattaagattgtttctttattctaactagggacgtcagatgtgtactgcctacgtatactgtagcaggatccgatgaaactagcaacccgcaattaaggccaaagcccgattaaggccaggcatccaaggtacaacacgagtaattatagccgaggaagagtgtgccgtgcaggcgtcaacacatgcggttgcttctccgatcgcctgcatgtacgtacgtacggtcgctacaccggtgcatgcacccccaaggtagtatagtcaagggtatctacctgttggttttgtgcgtactgtacgcctgtacgtggagcggctgcgtgcgcgtgtggaagttagcgacggatacgtatctcgtgtcgtgcgcgcgccgccgcgagacgggccggccggatcgtgtacgtgttcgacagatcggtgttttctcacggacaatgtcaagtttttctctggtttttgtaccacgttttaccagccagccagtacatgtgcgtgagttgaatgaaggtttcagtacagtttgaagatgaggtgcatgaggatggcgagagtacagaagaggagagaatatgcagtgcgcgtacgcgcttacttgagccacacgagctgcccattacattaacggatacgacaatggccagaaggcaatgctatgtacatgtcgtagaaagtactccctccgtcccattataagtg

SEQ ID NO: 51800 - DNA, 5683 bp, Oryza sativa
ggcatacgctacggtggcgcatgcactggctgccgggcgacgctgtcaggcgtgacggctgagcaagcacgggcagcagcggtaggctcggaggcgcagctgctgtggccggtggctcgatgcctggcggcgacggcagcggtgcccccagatccgtgcctctcggctggatctggaggatgggagcagtcggcgacggcgacgacggtgtggcgacggcagcggcggtagttggccgatggcagttggcgacggcggtggcggctgtggtggctgccgtgtcatctggcaacggcggcggaagacatggcgtcgggctgctagctgttcggtggtggagggcgacggcggagcagcgatttgcagaggcggcggttggcgtcggtggcagcggcgacggcggttatgactctggaggcagtggcgacgtcggcggcggggaaggagtcgggggcgaggtggctgggtgttcggcaaccaaggctgtggtggtggtgaccgtgtttgcggtcaccggaggcatggcggcctcggttgactaaccgagggcatgggagacggctgtagctggccggcgcggcatcgttcggtgaaggggtcggagaccggcttggcgcagagaagtgcagccgatggcagcggaggccggctcggcgcgagaggcgcgggcggcggagatggaggccggctgggcgcgagaggcgcggccgatggagggaggccggattggcacgagaggcgcgtccgttggaggaggccggcttggcgcagagaggcgcggccggcggtggaggaggcgacctaggtatgaggaggagctgccggtgggtgcggcgcggtcttcggcgcacgaagcctggccagcgggggacgccggtgcaggggtcccacatatcagcaaagcttgtgcggtggtggagcatcggtgcgccagccgtgcctttgttggtctactagcggtcggccacgcttagcggcggccgatccggtactagccttctcctgggcgtgtgtgttggcgatgtcgtcatgtgggtggtggtatttttttcttttcctgcttacgactctccagggttgtaatcttatacttttttttcctgctctatcaatagaacttcgcaccgtctcgtgtgagtcgttcaaaaaatttcacatagatgccatgcagaagcaactttgttatcttgttcaaggcggtgcgtagttcttttccttgaaatttaatccaaatctatgcaaaattaacaaaataaacaaggaattaattgtaagcacaaaaatctcttaatcagtccaatcattatgtactcaataaccctagtcgcgatagtaataacacaaatatactctaaaagataatctgagagcatgtattacatatttgaaatttgatcaagagaaagaagttaaacagtagttgccatcaacatctaatcacataaaaggtgcttttaaaatgctctttcagtttcagtctaaattgcatataaacatgtggctatcagccaccaccacatgacagtaaatacgatgattttgcatgtaataaaataacttgcctcctctccttggaaatccaaagtaagatcctttacatttgaagcaccgcacataagatcagtcaatttgaaccctgattgattactatacgcagcacaaacaagctttaacccctcaagacatggaatcacaccaaaagataaaggggcaactgaaaagaaccaagattcacataatagatgctctagtttagggaggcagagaaactctacagtcttgatactgcacgaatagagttcaacgaggcggagttttgaatttggcatatccaacttcagctttgacgaatcccgaagtttacaaagatgcagaattagttgctgcaactggtcacagctgattagtagttgacacagatctgcttcaaaaaacattgtcgtagatagaaagagttttgtgaggcaacatgacagactacgagatatattaaagaaatccactaagctctttgcatgcagtcgcttatgaaaacctatgaaatttatcctcggaaaccaagaaaagaagggagattccattgacttctatcgctttgaatcacagaagaagatcgttgcttcttctctcttgtgttttcttgcagaactcgcagagagcatcgatgcatatattctaaaaaatgaaaaccagcagcaaaagatgaatttaaaacacgcccaggaaaggacaaaaaaaaaacgaactaatacctgtccgctaagccgctagagcatcgatccggcgaacgtagagccaggatggagagggaaattacagcgggcgacggcggcggcggctagggcaaccggcatcgatcgccggagttgctgctgaaatgggtggtagtcgcacccaccaggggatatgtttgggccgtggcccaaacagcgttaaagcccgtgcgagtattacggtttggaataagttaactttcgatccctcaacttgtccccgagttcgaaatccatccctggaattgcggtctaatgggctgggccggatagtttgctagtggctgtcgccctcgctaaattactcctcgatcaaggcctaacacaatggtccataaacactgtaaacttgggtaataagtcaggttattagtgacaaaaaacgagacaaaaatatcgcaaagttaacactactgggcttacaatactccttatatctgattgtgatgttgatgatgcaaactactccctccgtattttaatgtatgacgccgttgactttttaacaaacatttaacatttcgtcttatttaaaaaatttatgtaattatcatttattttattgtgatttgatttatcatgaaatattctttaagcatgacataagcatttttgtatttgcataaaaattttaaataagacgaatggtcaaacgttagttaaaaagtcaacggtgtcatacattaaaatacggagggagtatctgatatcacctggctgtgatgttgcaaagtatttgcaataaattcaggacgcgttgtgcttgtgatttggcaaaaccaggatgatgatctaacgagttctgctaaaacgtaggtggtatatcatggtgcatcagggagatcggctaatgttcagaaagtcagatttcagaattacgacaaatcagcagtgaagaacatgttgggtgacgtctatgccaatgataactgtacccaatcaaggtaccagactagcccattacacatcgaatgaaaaataaaaatcatcatttttacagggtgcgagaatctgttttacagtgtacccaatagcaaagaatccattctttgttagcggaaaattatttcaacagggcgattgatcccagctttgcgttgcttcaccattgtgcttttctcatcattattcccgagacatagattttcacatcattgtgcttcaaatacaagtttatagacaaatatagtaatatttataatattaaattagttttattaaattaatatttttttaattacatggtacaacgcagatactcacaacacacacgcaaaccatacccctatgagcatcttgccatcttcgaagactgggctggcaaatctatcctggagattaatgaagtcaccacagacgcctcgctgtagacaggtacgtcacttaccactgaaagcacaaagctattaaatcctggaaaattcgctcccattttcttaataaatttgtcttgggttgaaaatgctattatttttgtacaaacttagtcaaacttgaagcagtttgattttaaccaaagtcaaaacgtcttataacctgaaacggaggtagtaaaagataaattggattgtccattgcttcacaatccttatagggatctctgtcttctaaaataacttacactcgtcctccgcctccacttcttccccttcgcgtcatagtccggcaaccaatccacgatgcggttcagcgtctccgccatgggcacgtacgtcctcctcgccgctgtgcgtggcatgggctttgccatctccttagttcggccgccaccgagcacgccataggaggagactaggaggccttccaatccgccgtggaagccgctcctctccctgttggtcgcggtcctttccactccgccgcgggaagagcgagcgacgtcgatgctcggtttgcatgcggcgtgcctccgccgactgttgagcctccttcgccgccgtcgttaggcacgccgcacaccggccgccatctcctcaccccgcacgccgccgccacatctgtcgccgccgagactcgagacccgaaggatggggagagaaataagaagaatactatattgtttcactgacatacaaatctcacatgggtttttatttttcttatagcgccacgtcatccaaagtcaccttaatattgtcttgggacccaatataacctgattttataagattatggatgtgttatatctggtattctggttcagggacgattttaaaactcgataacaagataagaatcctcaagtgaacttattcctattatgtttagctgcggtgttatgggttgggtcggatagtttgttagtggctatagcccttactaaattactcctcacggcctaacacatagatcaaattaaatattgtaaagttaaaatataacttaaatcgatatttaataaatttaaataaaaaaaatcatgccatttagtaactcgagaaccgagtgaatttatccaccattctaatcctttgaaaagaacacaccaagtaatcaaatactcaagcatcaaactactttcctcaatgagcgcaagtatgtaaatcccctccaatccattacacccacatatacaactaaaatattactacttcaaagggtaggttatcatggcaccaccattcgaaatggacccatcaagccttctttttcccattgcccattgcttccctatgttgcagaatggcatgcttcctttgttttctctcccagatgtagagcctctgttcatctgcagacaagaatacgagagggactcatcaaagtcgatcatgagtcctggaatcattctcacgagaagaggggaaaaatggtcagatggatactttctccgtagctatgctggatggatgctgacccacattgctttctttacctctacgcaaagatggcatgctcgattcatcacttattatctactatctcctgtacattgcagagcaaaggccgtgacagcgacgaagaaggctgggcgctggcgatggagcagattatgatggtcgctttgctggcagttattattcactcgactgctactttacatccatcacaaacatagtgatggtttactttttcttttttacctttgctttgctagaagatatctggaaggatggccattgcagcccatgttatgcagtacttgtgatgttgatgtaaggcattcatccactgagtattgtcgaaaaatgagagagatttgctattgtcccaggctcccagcatatggccaacaaatctgaaagagggaagtgcagagaaggcctgaatataagttgcttcatttttttaagacaacaacagattatgggcacagactaaagattaccatctgtgaatggtctccaggttatagttactagttggcaaactagatgaatataataattacataagaagattgcagttat

SEQ ID NO: 51801 - DNA, 1666 bp, Oryza sativa
  unsure (1)..(1666): unsure at all n locations
tatgaatgtggnaaatgctagaatgacttacattgtgaaacggagggagtagttcatatattgttctgacttctgaggatgaggaagattttggttcagacagtgtagtttttaagaatgtgattgcttagaaaagatgaaatatgataacaatgagaaaaacaccgatggcttgagagaacttaggattcacgaaacacaacaagtttagttttccaatttgttttgtttccaaaggaaaagttgtgcaattcgaatttaaaacaggcacaaccaagataactgatagttttctagctgccgttgatgttgtcaatattattaactcgataaattttgcagctgtatactgtatagagagtagtattactattacctcgacaacgacataaagaaaaataatgttcaatgtaacatatgatggatgtttcaaacttccaagtcactgtaagttctgttgaggtctttattatcaagacctgactttttctgttaattcaacagctcctaagtacctagcactatcaaacgggcatgccaccaagaaaacaaaacaaaatatcatcgaaagtacggaccgagcaacaaaatctgaataaaacatcctaccaaagcaacaaatgtgctaaacaaacacaactaagtactattaccaaatactatatcaaatcagatagcgactactattaccaacaaaaatgaaatgatgattctatcgtggtacgctgaattaacaatgcaatgtcaaaagcagtaaactgaactaagtactcaccatccaacagtgcatccgagacctcctcacgcgtgacattcaacgcgcgcagcaggatggcgatgttctgcgccttcttggggtcgagcaccctctcctcctgccggaacgacggcactccggcggctttcctcccgacctctctcggcggcgcggccggcgtcgagttgttcatgaacaacgcctcgatcatgtcctcgtccaacctgaaaggaacgcctcaacgtcacacgcgtaattcaaagaccaaacctgtagcaatcacggcattcagtagtgtggaccaaatctcaactggaatgagcttgacttcagctggtcccagaccatggcgcggtcggaggtcgcccgcaccttgtcccagtgcagcggcttcagcttcggccggggctcgccgctgcccccgtcgtcggcggcggcgttgtccccttcccgcattgacgtgctcccgttgttgtccaccgtcgtcgccgcggtgatcggcatcggcatggcaatgcgcggcccttcgggtggcagaggcttgagcaaccggcgcctcgatgtcggcacggccggcggctccgccggctttgggagattgttgtttgacggcacggatggtggtggtggtggtggtggaggtggtttcggcgctgtattcaacttcggcggtggcggtggtggtgggggaggtggcggtggaggtggaggtgggggtgcattggagggttgcaccggccgcggtgacggcgaggtcacctgtttggtgtcgggggtggagcccgtggagaagcgcgtgcgcgggggcgtgcggcgggagcgcgcggggggcggggcgggtggcgcggcgatggcagcgaccggggggaagaagtccctggtcatgctggggaggctgctgcgttaggc

SEQ ID NO: 51802 - DNA, 780 bp, Oryza sativa
tggtcgccggtaggccagggagctcgcctagccatcagccgcccttctccccgatggccgtcggcgggagaagagggagcggtgcgcgacggcgtcggcggcgggagaggagggagcagcacaagctttccgccgcaacccgcctccaccaccgtcgtcgtgtgcgctcgtggcggaggacggcgagagcggtggccgtggcactcacggcggaggccggcaaggacgtagaagctggagcccttgtgcgcgacggcagcggcgaggtcggtcccctcctcgagggggacacgacgaagacgacgggcagcacggcgggtgcctgctctagctccccgtggctcctctacggcgggtgcctgctcaccgtgatgctggccggtcctggcagcggccgcgtgctggtgctggagcggggcggcgcgcccacggagttcccgccggcgccgctctgggagagctagtaggaaagggaatgatatgtgggcccacgtgggtctcactatttttaattttttttgtgtgtagctgataggtgggcccatggtttttattttttttttaagatataattgccacgtaagcgccacgtcaatgccacgtgggacggagacctagtcaaataaaccacgtaggcgacacgtcagccaaaactaccttcaaaatcactgaaggatctcgtgtgcccggttttcgtaagttgggggacgggtcgtacccggttttgcggtctagcgacgaaaaatcgaactgggcgataaatatgcatgaactactgta

SEQ ID NO: 51803 - DNA, 832 bp, Oryza sativa
accccaagttcatcaggagagaagatttggagaaatcggagtatctcagggacgattcgttcaccatccggtgcgacatcatcgtggtcgacaattaccgtgccgaggacgccagcagcggcgctgccggcttcgtctccgtgcccccgtccaacctccatagccacctcggcgacctcctcaagaacgagaagggcaccgacgtagtgttcgaggtcgccggccagaggttcacagcgcaccggtgcgtgctcgcggcacggtcaccggtcttcaacgcggagctctttggcatgatgatggagagcgacaccaccaccaacgatgccatccaaatcggtgacatggcggcgccggtgttcaaggcgttgctccacttcgtgtacaccgactcgttgccggagacgatggaggagagggaggacaccatgtgcgagcatctgctcgtcgcggcggatcggtacaacctggagaggctgaagctgatctgcgaggaaagattgtgcaagtacattggcataggcacggtgatggacatcctcgcgctggctgatcaacaccactgcaaggggctgaagaaggcgtgcttcgattttctcaggtcgccggcgaacctgagtgccgtcaccggcagcgaaagcttcgagcatctgagcaggagcttcccctctcttatgaaggagcttgttgacattctaggaacttcacataattatgcttggtgagttgtggcaatatatcctagcttatttaggaagaaactccaaatcgggtgcctgattgtttcttaaaaaatcggatggtcaaatattttagttgaccactagtgaaa

SEQ ID NO: 51804 - DNA, 1696 bp, Oryza sativa
ctaagtaactagtcggttcagggaaacctcgcatgccaatagttggggaacgccggggcggggtcggttggagccaacccgggttcctggtaaggcaagaacacgaagcttgccagattaccgatcgaggtggttggagtttgatttgtgaaaactaaaatggcctatatttatgtgaggaattgatccttctatgtggcatgaggtaaccctgggtcggcttgggaaaggctttgttgcgaacctctgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctacgtggcagatggatgacctgagtagtcagaaacgaatctgtgtgattcgggatgtctgtgggcatcatagactaggcttcccgagtggaagcggattgctttgctgctgggcagctggactctgggagtccgagaaaatgaaaaaggctctgggagccgcttaatcgagtgaaaaggctctgggagccgataagtaatgatctgaccctggaggtcgatatattaccatttgagttgttgaaaagcatttcttaagtcaaatcgagacacaagtctcttttcgatccaaactcaaaaagaaataaatcacttagtgttttcaaaatgaattcaaacaaaggatttgcaaaacaaccttgcctctcttccaagcttgcattaaacacctaaattcccgtgacttgctgagtacgaaagtactcacccttgctctatataaatatatatagttcctccgccttgaagtgaagatgaagtgaagtgaagattagggtttcgtccttgttcccagccgtcgcctgtggtgttgggtgttagttcgttggttccgctgctgctgctgttgttggtgtttactcgtccgtgtcgtcggttgcattctcgggttgttctgagctgcaacctaagttaaggtaaataagtcctctatttattttaaggatttgcaatgattcatatttgtcaccgtgggtaccagcactatgtctgggactggtaccgagatcgcggtttcgtaggtagcggttcgcgccgtttttcttacgacacgctcctatcaggtgccgttgtacggcggtgccggattggggtgtgacatgcgcactagggtgatttttacaacaaaacagagcatggagtggacatttgttacaaaataacttatcaaacttcaagtgacttatgggatggtttttgtagtttttcctatcttttatggtacatctataactaaggctcggtttgtggttgttgtgttggtgttgcgctgtgctcatttttaaaattgctctaaaaatttgaacatataattttggtcgtttggtttatagatgaattatgattatatatattatccaactttcacgtctcttccaattgtttcgtattttcataccataataatattgacaagattataagaaaatcagtttaacaaacaccaaaatgtcaaaaagttgttgcagcaaacgagtttatgatcaggatccatatgccgcaatgtcaaactgaacctaaagcattcttagtttgaaa

SEQ ID NO: 51805 - DNA, 754 bp, Oryza sativa
gcgtcgccggccggcggaccggccctggcataccctatataaaccatacctattttctgatttcaacacacttcttcttcttctttcaacacatctccccaccgtatctatttttcatagaaaatatgcggaggtccaaaaagcgtcaacacgagtcgacaaccggtccataccagaggtcggtcgatgcccggcagctatccccgggcatggacgactacgggatggatgatcgccacatggatggtctggagggcgatgacggtgatcagccatctcctggcgaggccaacttctccgtcgacgtcgacgccacgacgttgcccacaccaaattccgataaccagccatctgccagaagagcggagtgttggcgacacttcgaattattcaccgagatggttgacggtaaaagtatacctcgtgctcaatgcaaatattgcgaaaaaattttgtctgcagctacttcttcagggacaggccatctcaaccggcattacttggcgcatctcaagaacaaggcgccggcaggagcaagacagacacatttgtccttcggccctgacggttcagtaagtacatggacctatgattcaaaaatagctagagaagagattgctaagtttattgttgctgaggatctaccaattagaatgggggaaagcaaacattttgagagaatgatccaaaaagctttttgcccacagtacaaaaaagtttctaggaaaaccaccaagaacgatattacatctat
